United States Patent 7,745,391 (HUMAN THROMBOSPONDIN POLYPEPTIDE) - sequence listing, part 249

SEQ ID NO: 702792 - DNA, 2313 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacaggtcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 702793 - DNA, 279 bp, Homo sapiens
gagattagttcagatggtctaaccattgttctatatgtgcattttagttaatattgtgtattaaaggataagtcttaatgctcaaagtatgttaaaaatagatgtagtaaatcagtccctctgtgaatgtcctcctgttagtctttaggaagcctgtcctctcggagtgacctctattagtcaccctggagctagacatactgtactagtcacggggatagtggagaggagagagaggtaggaggctctgtgctagtatctcatatctagacgatggct

SEQ ID NO: 702794 - DNA, 2449 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacagggctggttgttgggggcaggggtagaggtcccctggacatgcagacagcttgtgggttgcctctgagtcctttgtcttacagggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 702795 - DNA, 2632 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgccctttccatgcccaggatggggtctagctggagcggagtgggggatggcctggtggctctggccagccgtgaacctgccccacacctgacagggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaagatatcctctgccccttgccatctacctgtgaccagcctccagtctcctcaactctaggctggggagagtcttccatcctgatggggggtggggtacgggggtgagccctgggtccccctctgggcagatcccgttacacctcttgttggggtccttgattgggctacgctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 702796 - DNA, 2489 bp, Homo sapiens
  misc_feature (2026)..(2026): n is a, c, g, or t
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggtatgtatgnatcagccccacttcccccaatgcctgtgccctcatcacagaccgcaccctcattcagtagccctttcccccaacctggtgcccatgcccccaccatggagcctaccttgatgttgcttctccacccaggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 702797 - DNA, 273 bp, Homo sapiens
ctccgtgctcaggctctctctgtggttccccagatgagatgcgcctcctgggtttctgagtgggctccttctgtctgtctctatccctatctcttgctttctctgtatttctccacacattttcatcgtgtctctgctccagtctctgcactctcgggacatccctgcaggctgcagcactcagctcttccccgtaatgcatagctacccactatgctccttccatgtctccactcggggcatccatctacgagtcgaccatgcaggatatgc

SEQ ID NO: 702798 - DNA, 468 bp, Homo sapiens
cgtttcctttccttttttaactttttaagagacaaagtctaggccaggcgcggagtctcaggcctgaaatcccagcactttgggaggccgaggcgggcggatcacttaggccaggagttcgagaccagcctgatcgacacggtgaaaccctgtctctactaaaaaaacaaaaaacaaaaaaacaaaaaacaaaaatcagccgggcatggtagcaggcgcccgtaatgccagctattaggaaggctgaggcaggaggatcacttgtatctgggaggtggaggttgcagtgaaactccgtctcaaaaaaaaaaaatttcactttttaagagcgaaactccgtctcaaaaaacaaatctgccaggcgtggtggcgcaggcctataatcccagctacttgggaggtggaggttgcagtgagcccagatcacgccactgccctccaacctcggtgacagaatgagactgtctc

SEQ ID NO: 702799 - DNA, 2600 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaaggtggggctgcctgcctgcctgagggctgaagggcacagggtctgtgggaggggctgtctcatcctgtcctgcacctctaaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaagatatcctctgccccttgccatctacctgtgaccagcctccagtctcctcaactctaggctggggagagtcttccatcctgatggggggtggggtacgggggtgagccctgggtccccctctgggcagatcccgttacacctcttgttggggtccttgattgggctacgctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 702800 - DNA, 395 bp, Homo sapiens
atgaaacatatcgggtgcatctttaactgaaaaatccagatggaaatattaaaataaatgaccagtaacagcagttatacatgtgtactggttccagtatagacatctgtttcctctatagttgaattggatgtgaatgataggaaaaaggcttggtgcctttgtaacctgcccccttttctccattgcttttgagctcagctgccactggtccttatgcgtttgcagttcccacaggcagaaagccttgtacgatgcggacacctgtagtcccagctactcgggagtctgaggcaggggaatcgcttgaaactgggaggcggaggttgcagtgagccaagatcgtgccactgcactccagcctggccaacaacaagagggaaactccatctcaa

SEQ ID NO: 702801 - DNA, 639 bp, Homo sapiens
gggcaacccgctccggtgtccttccatgctgtggaggctctgttgtttcgctctttctactgcttactcttcgggtccacactgcttttatgagctgtaacactcaccctgaaggttttgcaactttgactcctgaagccagcaagaccacgagccccagggaggaacgaacaactccagacgcgctgccttaagagctgtaacactcaccgagaaggtctgcagcttcactcctgagccagcgaggccagaacccaccagaagggaagaaactctgaacacatccgaacatcagaaggaacaaaatccagacgtgccaccttaagagctgttaacactcaccgcgagggtccgcgggcttcatttttgaagtcagtgagaccaagaaccaaccaattcgggacacaataccaactctttcatgccaggagaagcctccttaaaaaattccggtgattaacagcagcacatggtcaaaaatctcctgaaggttggagcagggggagcttgtagaagactttcctccttttctcgcagatgaaatcttatgatatagcaggcgttaccttggccagagggaccaccagaggagaccaagacaaattcaggactaaattccttctccactaaccacagatt

SEQ ID NO: 702802 - DNA, 125 bp, Homo sapiens
cacggcgcaggtgttggtctcagccgtgcttggccaggctggcagccggatcctggggcacccatctggtctcttgaataaaggtcaaagctggattcttaaaaaatgccgcagccgcggccgct

SEQ ID NO: 702803 - DNA, 334 bp, Homo sapiens
gtgggctaccgacgagtagtatcattctatttccctctattgatccccacctccaaatatctcatcaacaaccgactaatcaacacccaacaatgactaatcatttattattagccacaacataacctccatcggaactcctgccatcactctatttacacacaaccacccacactatctcataaacctagaccatggaacatcccacttatgacgcgggcgcagatgattataaggctttcgcatctaacgcttaaaacatgccctacgcccacttattaccacaaggcacacctacaccccttatccccatactagttattatcgaaaccat

SEQ ID NO: 702804 - DNA, 106 bp, Homo sapiens
ctataatgtgtgcccagaagctgctgctgtaggctgtattcaattaacacttttaatgttacaggtgtggaccatcacgagattgtctctccctggctgccgaatt

SEQ ID NO: 702805 - DNA, 605 bp, Homo sapiens
  misc_feature (142)..(142): n is a, c, g, or t
  misc_feature (485)..(485): n is a, c, g, or t
  misc_feature (538)..(538): n is a, c, g, or t
  misc_feature (541)..(541): n is a, c, g, or t
  misc_feature (546)..(546): n is a, c, g, or t
ttgcatcacggcgcaggaccaccagcttacaccagatagctgcatcatcagcatggtgtggcccagctcaaggctgatgaagatcccatcagggtttccaccagatgtttctattaaggaacatcaacgatgcttggggttngcaccaatgacatgttcaggcttgccctgcacaacttcggctgacctcctcctggccacagtcacgctgtttcctcctccctcttcccaatcctagctcactcctccagatgctccaaatatcatacacaaacgagcagggccgaggcgggagcgggtgcagggcgcttctgtcaccacggtgttgtgcatgatgtttggatgctagactagtcgcatctgacaggaagtttgtgttgtaccagcgcatgccttggaaagacttaagtaatgcaaacgattgtcgggttttgtttttgttttattttttgttttgttttgtttttttaatctactgacaagtngctctagtaacccaaagaagtgaaggagaaagcagctgcctcaccgcccaganatngattngttcagatgtttcaatgcctcatgatacaataaaaccacaaaaattttcttaacagtta

SEQ ID NO: 702806 - DNA, 97 bp, Homo sapiens
ggatttgctggtgcagtacaactaggcttaatagggacatgaggtcaggagatggagaccatcctggctagcacagtgaaaccccgtctctaccaaa

SEQ ID NO: 702807 - DNA, 219 bp, Homo sapiens
tcgacgtgaacgctaccttgagaacggcgaaccgttccgcattgaaggtttccatgacggtgtgcgtgtccctgggaaagcaacggcacactgaccatcagtgaaaaaggcggccaccgcatctacaccggcagcatgcacgacgaggtggtctaccatcagcgtcgcaatgcctttcgggcagcgttgaagctggcccaactggtcgacgcggccgcg

SEQ ID NO: 702808 - DNA, 316 bp, Homo sapiens
aggtaaagggaaaagagaagagaaaaaagcacctttgaaattccaaacaaattatattgtacttgtatctttttacctatttttatactttttataatgtttacgtttgtcctgaatatatatatatatatatatatatatatatatatatatatatatatatatatggtataggagataagctatttctttccaaaatctataaatctttgaatatagtcccacagaatacttatgttcactttctatttttaaaagactactctgaaaaacactcttggataataaatgtattatgtgcatacttaaaaaaaaa

SEQ ID NO: 702809 - DNA, 968 bp, Homo sapiens
ggatgcctttgcctcaagggctggttaactgcctgtattgagacaggaactggagagggtgttaaatgagcttgggatacagcccttgatgcctttgcgtcagacattgagcctttatcaagacccattctatcctgggtttccttgtaatgaaacacgggagatcgatgccattagtatcaccttattcactgtgtccacgactggggatggacctacctaagagataaggaatattcttcgattcttcttcaatcttggtgtgaaggcatcacagttgtcctatgtagggcccctacattcattaccgtgtacccgtctgcacgcaggcgctacctggcatgctgcaaggatgtacccaaaggtccctgtaacctgtttatcctcataatccctggttccaagaggctcctgctgctctagaatgaacatgtgattgtacctgtactgatgcccacgtttcctatgcagacatgaggccagatgttcaatggtcaaatgccacagccagagattggacccgacgacatgttcttcacctctggttatccctccatctcaggatgtctgaaagtcatggacaattgtcttaccaggctgatcttgaatctgagacccctgggacagcttctgcgatgctgattatcgaagagtcacgtaagtggcaagaatatgttcccccagtcatcttttgggacccaatccattcttagggccagttcctatttgcatcctcctttctttccctcatagttggtattgggtacccctttagcaggcattcatcagaaaacattccagtaactggagagcagaaatattgtcttgcccttcttgtcgcaccaaagagaattggcttctgcctcttggaaaatcttggatcttgtcacggactggggtgcagtttcaagagtcaatgagtctccagaatgcctgggtgaccttgtaatccttcctgagcacagttg

SEQ ID NO: 702810 - DNA, 875 bp, Homo sapiens
  misc_feature (161)..(161): n is a, c, g, or t
  misc_feature (459)..(459): n is a, c, g, or t
agcgggtgctagtgaccggaggcggtggcggtgagcggctccttgatgggctagaagaatcctgctagaaatgtctctctgatccatctctcgaagacttgaatggtagacaaaggtagattcgatggtctcaacaccgtagcattgtgtatctgcaaganccctggcagaatcgcgagacacattgagtacagaagcttctgctccgtatccctcacgagtggaaatctctatcccaaactgtatccaaagactctctctatatactggaggcatgaagatttagagtgagatgagagatagattactgtgctaaatgtgaggcgtggtatctgtttgcaccgactttcgagggtgcaggatatggatatcgaagagcttatactagctagtgaaactaatatgagtgcgcgtccgtagttagatcttaggtaaatgagatgtaaggaacacttcggnatagagccaagaagaattgaatgcacacggtgattcagatgaatgctcaagttcttgctcgataaggcatcaagggatgcagaaataagtgtggcagctcaggctgtatattcgaagtgggcataaagtaggttatagtgttggtttcgaggcttgagttccaacggcggtaagttctccaggcactgcattgagttggatctgtagattgggtggtgagccgaagatagcgttcaggagtcaattcggctgaaagatcctgtgcgaggagtgtgagctcgtgataagagcgtcacaagggtgttcaaaatctaagggcttttggaagagacagattgaccatggactcaatatctgtgaacaggtccttctgaacgggacgaattacccatgccatagaggactaggcacttgga

SEQ ID NO: 702811 - DNA, 244 bp, Homo sapiens
aaactgtgatacactaaattcgtggagtgcaccaggaacccgaagtggggagacctgttggcttccggctggggcagcatcgaaccagagaatttctcatttccagatgatctccagtgtgtggacctcaatatcctgcctaatgatgagtgcgaaaaagcccacgtccagaaggtgacagacttcatgctgtttgtcggacacctggaaggtggcgaagacccctgggtggggataccagggg

SEQ ID NO: 702812 - DNA, 448 bp, Homo sapiens
tgtcacaaaaaatacaaaaaaatcagctatgtgtggtagcaggcggtcccagctactcgggaggccgaggcacaagaatcacccgaacccaggaggcggaggttgcagtgagccgagatcacgctgctgtactccagcctaggcaacaaagtgagactgcatctcaaaaaaaaaaaaaggggggggggctcctgttttccctctttaagagcttgagaccaaattgtggcatctcgtggggggctcagaagaagggggcagaagtgagtttcgtgtgatagtgtcattgaggcccttgtctcccggtgaaaaagttgcacccagagaaccttgcccatgtgggccccagggctccaaccatgtcaagcccccacaattttgccagcacccaagtttctctgataaggtattgggtaaaacacaccgtgtggtgtgatagctggctttt

SEQ ID NO: 702813 - DNA, 311 bp, Homo sapiens
gtagacaactagggtcagtttgcaggtgtaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 702814 - DNA, 491 bp, Homo sapiens
aggaatgtaatagtaaaatctcatgggattcaaaaattcattaatttcctcaaccaatgggggcagggtccctatttataagtgcggctcgggataactgcctagtcatatgcagaagaatgaaactggccgtcgattctacaggcagatataaaaattaactcagaatggatcaaagacgtaactctaagactacaaaccataaagttctaggagaaaacctaggaaataccattctggaaattagccttggcacggaatttatggctaagacatcaaaagacatcacaacagaaacaaaaatagacaaattgggacctaattaaactaaagagcttctgcacagcgcgcacacacacacacacacacacacacaaaacctatcaacagagtacacagataaccttcagaatgggagaaaatatacacaaactatacatccaacaaaggtctaatatccagaatctatagtgaaatcaaacaaatcaaca

SEQ ID NO: 702815 - DNA, 258 bp, Homo sapiens
ggagctcggtacccagtctttcccctcaaactccatgattagtgcttctgttcacttattaaaaacactgggccaggcgcagtggcccacgcctgtaatcccagtcactttgggagcccgaggcgggcagatcacttgaggtcaggagttcaagaccagcctggccaacatggagaaaccctgtctctactaaaaatacaaaaaattaaccaggtgtggtggtgcatgcctgtaatcccagctgcgtttcacttccga

SEQ ID NO: 702816 - DNA, 278 bp, Homo sapiens
tcggtaccgtactgtggtgtaccgccacagctcattggcaacaccggatattaacccactgagcgagggcaggacctgaacccacaaccatcatggattcccatggacatatggaggttcccaggctaagggtcgaatcagattgactatagccactggcccacaccaaagccacagcaacgtgggatctgagccgcgtctgcgacctacaccacagctcacggcaacaccggatcattaacccactgagcgagggcagggaccgaacccacaacctc

SEQ ID NO: 702817 - DNA, 460 bp, Homo sapiens
  misc_feature (22)..(22): n is a, c, g, or t
  misc_feature (30)..(30): n is a, c, g, or t
  misc_feature (33)..(33): n is a, c, g, or t
  misc_feature (43)..(43): n is a, c, g, or t
  misc_feature (190)..(190): n is a, c, g, or t
  misc_feature (208)..(208): n is a, c, g, or t
  misc_feature (223)..(223): n is a, c, g, or t
  misc_feature (371)..(371): n is a, c, g, or t
  misc_feature (400)..(400): n is a, c, g, or t
ggcacgagggtagatatactanaattgacntanaatagacaanatattctaacataaatattcttcccttgtttctagaaagaagtcacacatacagtaaaaataattagagaggacctagttcatatttagcaatcttccccaaaccctgaaacaggtcttctttctaacaccagaggtatcttgagtnagtccaacccctgcagtnccctctggtctggantagatggaggaagtttgctccagccttagaacagcatgggctggcaaacgttctcaagagaggtctcgacttcaactctaaaagggcctgaggaatatgtgcaactgggtcgggttaaggccaagcttgaatcacattgaccaagggntctcaccagcgccaaagtccagttggaanggatatcaatccccaaaagctcttgtcacaaggccatggatgctccatgggaggggtggt

SEQ ID NO: 702818 - DNA, 307 bp, Homo sapiens
ggcccgtctccgtgagactggtcatagatgtggcttggatctggcgatgccatggctgtggctccaatttgactcctagcccgggaacttccatatgctgcaaatgtggccctaaaaatatatatttatatatttagaaggcgagcacaggaagacctgcactgacatacatttccccagacctttcaagggctttcagcactcatggcagttttggaccagagtttgaattcaggagtgctatttctgaggcatggcattgtgaaccatgtgtccataccaaaagcgtttttcccagatggttagg

SEQ ID NO: 702819 - DNA, 686 bp, Homo sapiens
gcccgggtatgttggcgtgtgcgcgcgcctttcttagaccccggtcttggtgtcgggaaccccatatgttccttatttccccccctcttaggtgggcaccaaaacactcttcttggtgtggtgggcaagactctaacgggtgggtgtgtcccccctgggcgtggcaatgagccccccctctggagacccacttggtgtcatctatcagaggagaagaagggggtgcactcgctcgaaggattcgtgggggctgtctcctgcacaaactgattaaagacagcgttctcactctgctgcccacacagaagggtacactccccctccctctcgcaccaccgtgcgcaccacgcgcgacagaaggggccgaagatgaccacaccaccacagcgcgaggctacgcacacagctggtgatataaaggacttggcctcccacagcaaggggcaagcgtgcgaagcagtccagctgccccgtacgtgagagataggccttgtaggagtatgtggtgagcgtaggagatacagcgagagaggtcctcgccagtccccgcgcgcactgttgtgtcttttgggcaagaacgggagcatcctccactgccaccgtcttcttacggccactaagcatggtccccaccttttatctcgcctgtgattagctcccacgaaacggcccaccatagaccaaga

SEQ ID NO: 702820 - DNA, 118 bp, Homo sapiens
tccgatctcttgactcgtgatctgccacctcggcctcccaaaggtgctgggattacgggtgtgagccactgcgcctggcagcctagtggcttttaactgctctgccgagacgcctggg

SEQ ID NO: 702821 - DNA, 153 bp, Homo sapiens
tgatctccccctgcatgaacatcatgtccagtaaggaaaatggaagacatctagtgctcctaaccttcattttcctttcactcattctcagtttgggtatgggagtgctacgaagagtaagtagaaaggaggaagtgatcatacttaactctt

SEQ ID NO: 702822 - DNA, 107 bp, Homo sapiens
ctcgctaccttctaagagaagagacgagatgtacaagagaagagacgagatgtacaagagaagagacgagatgtacaagagaagagacgagatgacagcacctacag

SEQ ID NO: 702823 - DNA, 931 bp, Homo sapiens
cgcgcgggccatgccttggccccagcccacaccttcaccagtgcccatgagccaccatgtggcggatgtccactggtggctactgctgttgctgcctgctggctggccacttggctctgggtgcccagcagtggtcgtggtgctgcctgtggagctagcacctgtgtgtctgcacctgcgtggtgcatccgggacgcgggagtgcctggtactgccagtgagcaggacctgtgctgccgctggactgtgcctgacgactgtgccctgccctacctgggcgccatctgttactgtgacctcttctgcaaccgcacggtctccgactgctgccctgacttctgggacttctgcctcggcgtgccaccccttttcccccgatccaaggatgtatgcatggatggtcgtatctatccagtcttgggaacgtactgggacaactgtaacctgtatgcaccttgccagtgagaagcaggcagttggcgagttgtgaccaaggaaaccagtgccttggtggatcacagacgattgatcaagagccatcaaccagggcaactatggcttggcaggctggtgaaccacagcgccttctggggcatgaccctggatgagggcatacgataccgtctgggcaccatccgaccagtctatccctcggtcatgaaccatgcatgaaatttatacagttgctgaagccagggtgaggtgctttcccacgggcgtcgaggcctctgggaagtgggccaagcgtgattcatgaggcctcttgaggcgaaggcaacgtgttgcaagggtacctttgggccctttcgtatgcgcgagggaggcgtgtgggagtccggatacaggggtctcaaggtcgagtactcttggagacacgttagcgccaggatcctgacagcccgagagaccttggtggctatgatacaacgca

SEQ ID NO: 702824 - DNA, 234 bp, Homo sapiens
ctcgttttgaggttgcaggctcgctcctgccggccgagcactgactgaccgatgcagttctcaagccatacacacagtacacgagactagcacgcatgctactggatcctggcgggtaggagcatgacaagcccctacgccttgggcctcaaggatgcagaccgctgttgcacccacacctcctcttgcagaagcaccttttccaagtggatctgctggaccagaacagccact

SEQ ID NO: 702825 - DNA, 186 bp, Homo sapiens
ttccggcgcagatatctatacgaaatacccacaaagttcccaacccaaagagatttctgtaattcatttaactgcaaaagtctaacctgagcggagaggagctaattacggattgcttccctcgtgctgtgaatgttcacacgctcattgcagcagaatcaatatgctcgactccagggtgttgcc

SEQ ID NO: 702826 - DNA, 113 bp, Homo sapiens
ccccccactgcgatgtcctgcacctacactcctgctcacacttcctctctcctactcgatgccctgcctctccctcgttgtcacctcctcaccctctgacctctttccgatcg

SEQ ID NO: 702827 - DNA, 181 bp, Homo sapiens
taccccagcttatggagaccaggctgagcagacaggctagtatcaagactacagagtgacatgcaactcagtctgaaagcaacacagcacacgctttaaactctcaacacagtataccttgcggaaaggctgatcttacagcatacactgtccactctgtcaactagagcatagcttcttc

SEQ ID NO: 702828 - DNA, 673 bp, Homo sapiens
  misc_feature (625)..(625): n is a, c, g, or t
  misc_feature (661)..(661): n is a, c, g, or t
gctgtccagaaagttcaacagagagaccagaagcagcactgaagtcgagcgaggactcggcagctcccttagttggtcgtgtgtggtcatgatgttccaaagctgggccaaagctttgttcttgtctctagatttgatgcaatttcacagagtcgaattgctaaccagccttccaagagaaattgtgtttgcatgttgtatttatttgcgacaagtaacattcctctcagtggagcaggatgttctcgttgggtggtgacccttctttgtactcaggagagttgcataataaaccagtttcataactggaagattgcgtttggaccagagtgtggaactggggtaagagaaatgaactgggtggccttcgtagctggtggtgtggacgaagcctggcctgtctgtactgatggggttggagttcttggctctgttgtgtgttgtgctaggtcgtcttactgcctgctgaccactctccttttgtcaacaggaattgtaaacaaacagttgactggctggaatttgggatgttttgagtctcctcaggcacccactttagggtttgctggtcagggtgcttttctcatagtttaggggatagcttgctgggtgagcctgggttccnaaggatacggttatacccaaaaacaaactggtaggntcagccagactt

SEQ ID NO: 702829 - DNA, 210 bp, Homo sapiens
cagtgtgagcattgacgacctagaacaccacccacacgcccaggtgagcatcgacagcctggaaaagcacccacacccccaggtgagcatacgacaccctgtgagcagcacccacacccccaggtgagcatctgatatcctggaacagcaaccacacgcccgggtgagcatctgacagcctggagcagcacgcacacccccagtgagcat

SEQ ID NO: 702830 - DNA, 263 bp, Homo sapiens
cccttccccctttttaaaggggaggtggtttttttccccaagcccccttccatgcctttcactcccaatggcaagctcttagggggagccttgggacgggtttgggtccccaggaggaaagccttgggtataatttatttttttaggagcctcttgccctgtcccttgcagctttcgccctctgctttgatgggtgaggggaactcatgttttttgggaaaaaggaaggggggctgtggaaataaaatgtttttttgcttcca

SEQ ID NO: 702831 - DNA, 150 bp, Homo sapiens
tggtcgtcatctaacaatcgtcgtaactggtaaaatcctgcccggtcagttaaaggataagttgttgtgtttggtctctcccacaaccaaaaaacaggcacaactgcctaatgagcatattaggatcgaggaagcataatgttagagata

SEQ ID NO: 702832 - DNA, 116 bp, Homo sapiens
ccctagatttcccccttatgtgcgtgtgcgtgatgttatggctttcgtctatgattaaaaatgcctagcccacttcttaccacaaggcacacctacaccccttatcccgtacgagg

SEQ ID NO: 702833 - DNA, 611 bp, Homo sapiens
  misc_feature (176)..(176): n is a, c, g, or t
ctgctattattactctctcaaagcaaatggaaggtttccctcctctctcccagctggaagcacctatcaaggtaactaagcggtttgttttttttttccttaaagccacaaggcccttcttttcggcatcgtgccccagttttagtggcgcccttctccaaagcccgttttggccntggcttttcccgggcccgccccacaagacttgcaccggcacagccctcgctaagcggggcagaaagctcatggtgtagtttcgtgggatcgtgcaaaagcccacgtgtttgggggacacgtcaatgtccttaggtgactgggagactttgaggcgaaagttctgcatgacggtggtaaagaagagaaagagctccattctggccaggccttctccgaaacagttccgcttcccgatggaaaagggcacaaaagcatcactcttcttaacttgccctttctcatcaaggaaatgttggggattgaagtcttgggggttggaaaagaacctgggtcctctcagcacaaagcccagcatagggtcccttccgttgccttggtaggaagaagaaagttgtgtgtttaagaaggttcgggggattgcctcgtcccgaatt

SEQ ID NO: 702834 - DNA, 115 bp, Homo sapiens
ctttctccgtccctcttgttcttcagtgtgcaggttctcatacacatctccttgtgtttggacgaggtggccatgcctcgaggcctgaccctgtggaagcatttcgcgatggaca

SEQ ID NO: 702835 - DNA, 222 bp, Homo sapiens
tcttgactagcaaggtagaagcctacctagtacattctaccaaaatgaatatacaaatagtaaggctacccctgagagcataactacactagtaccctactacaaaccacagataaactactatacgctatacaagtatacactaagcctatagtacaacacctaacacaagacaagtatagaaatctatatcccagctaggcctaccctcagaaacagatc

SEQ ID NO: 702836 - DNA, 1098 bp, Homo sapiens
atggccccttatgcattttccacctgcctgcctgcctggtgcctatgttaccatcacacccctgtgggatggatgcctgcatgtctgcctgcatgcctggccccagtcaccatcacctgcaaccatgatgcatgctgatgtgcctgatgacccaatgcatgcctggccctgcctgccccccctggtgcccccgccctctgcgcctcccccttcctggtttttgtcgtgtgctgcatatggatgccttgtgttggccctggtgctggtctatctacatctgtgcagtgcagccattgctcagcgctgacgtgtgacacacgacacgcgtcaatcagtcaacctgaatgtgatttatgatgcgacacaagtaaacacatttggttccacattgttatagtgaactcgagactcttgcgatttcattcaacaaagtgaattgaacacacaattgaaagatatgtatttaacggtaacaactctaatataatatttgagcaaatataacagaaactgaaaataacacccaccagagaaaagattacacaattccagcaaaggatagatacagagaagaatttctgtacgaatgagacattgttacgagaacaagtatttagaacttagtaattaagataatagagaacggcatacaatcaaaggagcttagtctgagcatgaacacagtcataaaaatagtataaacaaatgattcattagatgaaaggcatcgtttacgaaaactataaaagacgacgacagaagcttataatgttatgacagatctaagaacaccgctaaacatacatttagatagtaacgatctaataccaacggatcagtaatagaaggattccattcaagagaacacaacttaagacagacataaaatataatcagtacaaattagatgaatcagttgatgataaatatgtagatgataaggtgaatttgaattatatgttgcattcaaagtaaatgagatctgaggaccacaagagaagaaggacgaggaccgattacacatcaaatgtgcaagaatatataccatcaaatattagatacatattcgaggtatgatccttatatggtgcgcctaac

SEQ ID NO: 702837 - DNA, 376 bp, Homo sapiens
  misc_feature (18)..(18): n is a, c, g, or t
  misc_feature (22)..(22): n is a, c, g, or t
  misc_feature (27)..(27): n is a, c, g, or t
  misc_feature (38)..(38): n is a, c, g, or t
  misc_feature (40)..(40): n is a, c, g, or t
  misc_feature (43)..(43): n is a, c, g, or t
  misc_feature (50)..(50): n is a, c, g, or t
  misc_feature (65)..(66): n is a, c, g, or t
  misc_feature (71)..(71): n is a, c, g, or t
  misc_feature (102)..(102): n is a, c, g, or t
  misc_feature (120)..(120): n is a, c, g, or t
  misc_feature (139)..(139): n is a, c, g, or t
gccgtcacacgcacgganaggnatcanagagcagaganantgntagtgcnccaattgtgtcacanngctgncgaggtcggtacatcccgatactgataaatngtgtggaggaatgggtcngggtctgtgttagcgggtncggttcaactcagagatttgtgaatattagtcttaaatggaaggacttcaaaatccagagagcaaaatagatgcataagccttctccggtggcgtggtgcgcacggcgccggagaagggaaaaagggctacctaagtatgagtcgccaatcaagagacaaaccgatagacagctgtccctgattgaggccataaccgggccaaaaacacaagaactacagaaacatagacaagaaaa

SEQ ID NO: 702838 - DNA, 200 bp, Homo sapiens
ccatcctcatgccttccagtctgcagacccctcagacccaggagcagaatgggattctagactggcttaggaaactgcgtttgcacaagtattaccccgtctttaagcagctctccatggagaagtttttgagccttactgaagaagatctgaataaatttgagtctcttaccatgggggcaaagaagaagctcaagacc

SEQ ID NO: 702839 - DNA, 104 bp, Homo sapiens
cctaccacaagtgctgccattttctcagtgtgcaggcacagcttcttcacgctagaaattgggaataaagccaggcacagtggcccaagcctataatcccagca

SEQ ID NO: 702840 - DNA, 873 bp, Homo sapiens
atgcggggcttttagctatgccgctgggacctttaatctcgcctggcgcgctgcgtattcctgatttgaagctgcggtgatcgctagtggacaggcgcctatcagagtggacggtggccattggaggtcctgcacttagcgagctccccgagcgtatcgagtttcggagatggtagtcgctaagaacaggtcaaccaatatgctgtcatgggcactagatgtgagaattggtgtatctagctgtaccaaaaaggattttcatgtttagaagcagtctattcgaaaataggaggctgattggataaaagcttgcagcatgccagataagtacgaaccccgaagatagtgacatgcttgattgggcattggaggatatgggagataagagctgtgtagtgaactgttgtgtggaggtccaagagaaggttcccagttcgtgtgatggggtttacacacaaaaagagtaaactgaaagagacgggatatcaatgtgggccctgctgatcatacagtggaaaaagagaaatttaaatggagacttttgatgctgaaaatcaggttgtcgagaagtaagctgagtgttaataagaatgtactagcagctgtgttgtgcattcaagcttttgtctggattgtacactgtggtatattgtaaaaccgtgggcgtttgacaattgtatgggcatgtgtcttgttggaacgatcgtggttgcaacatttgtgtaagaccaaaggaaatgacagataggggagcacgcaagctagtggctgggggaaaaattggggagttggaaagtaaccattttaaaactagggcacaataagatggaccttatttaaaaatattggtttggagcaacgtataaatcttcc

SEQ ID NO: 702841 - DNA, 130 bp, Homo sapiens
cctcttatacaggctaagcgagcgtttgatggagctgctgataagctctgctgtgtggtgtaaggacatatctgcctcttcctccttgctggggattttcacctggagtgtgacgggtgggaggcgggag

SEQ ID NO: 702842 - DNA, 177 bp, Homo sapiens
gttgatcgtcgatcaatgcaacagatacttttttatcctgaaccagtttagcaagagatggtaaatagcttctactttccatgtccatgtcactacctgcttttatggctaattctgctgcttcagatttattttttgcgtaaccgtgattaatcatcaatgaccaacaatttattg

SEQ ID NO: 702843 - DNA, 1541 bp, Homo sapiens
gggcggacgcgtgggtgagagccacgctgctcagatcatgtatacgtcagaccgagtcaggttattttcagggaaggccatggcaggccatcagtgaggttcagtttccatccactcaggcatgtcatcacaggtgcacgcacaccaaacccaaatcacctattctttccatccacttcaactcatcacgtcactttcatctctggtcaccactcagcacatgctagtaggtctatgcagggcacatgttcagccaaggcacaccaccatcagcacagcatttggtgtattccatcaacagcctagtctcagagtgtaggccaggtttatagtgtggtacaccacgtgccatgatttcacccattcacaagccaagggtcccacaggcattccatgcaaccggtggctttcaatggcacacgtcatcacatttagcacactcaagcaatcagcccaacagcacacagtcaggcacagtgcaccaacacatggtccattaaacaacacatccacgcacaggcaataggcaaggcccagaatatacaccagggcatggccaatagcaaccccaacgtgggataaggcaaataaacaaatataccacagacacacataccagccacagccagcacacacccaaacacagacaagcgggatggagcccacacgccacacaattatagccaactatggcccaagagtgaatcgacaaagacgatggctcagaatggagagcaccaatctatggccagtaacccaatgtatcaacagattttcaccacaaagcaagtccagcggcacacacacacacagcacaagtgctgttgggaccacaattcgggggcccgttttcaccccagggcgcacacaccattaggacatgacaagcgggtaaaccgcccactcgacgagtagaacatacagcgagggataaggcaccggcaggacacccccgtaacacacacataacaacacaacagctaccactattacacgctatgagaaccaaggaccacaaagatacgcaacgcatagtgacaacaagccgatatacacacttccgcccaaaggacacacaacgtgggacaacagaacacggacaaggcgacgatcgcgttaacccaccgtacaacgcggcacatataaagacacagattgggaccgcattagggaacagatacatatataagaaacacaagacagagggagcgacccaacgacgtggacacacgagtgagagacaaactagcccccaactgtgcattgacattactggaaggacgcaaccatcatagcagcaacagcaggaggacaacaatagaacaatagaacaacgagccacacacacaacagtgtgaaagaacagaacatgagtacacaacgagaagaaaaacgactgtaacggaccaaaagtgtaataagtaaccagtaagcaacagaaggagtaaacacacaccacagagaggccaacaccccgcacacaaacagtgacgaaacgaaaaaaagccaaaccacggcgacaccacaacaggcgaacgaac

SEQ ID NO: 702844 - DNA, 100 bp, Homo sapiens
cagcagcatagattattaccgagtttccttttacttttgttaacctttccttatgagcatgcctgtgttgggttagacagtgagggtaataatagacttg

SEQ ID NO: 702845 - DNA, 672 bp, Homo sapiens
  misc_feature (245)..(246): n is a, c, g, or t
taaagtaattctgccccgttaaaatggcctgaggtttgcagaaagtgtttttaaaaatagagtatcctaaaggtatagaaagggtccaaaaattagcacagcaactttttcataccttgatccccatttatccagccccattaaaaggtaaaaagctacaccttaggcacttggccaagcttagtccaccaaaattcaggtattagtaaatgattgaatcctcataaagagtaacttagaagacnntgtaagtttttgaaaaagtgactgacaatttaattgcaaaagacacagaatattaaggcataacaaagtaaactgaaatgaagtttagttatcaatattcatctctgagaaagttgtgaatcagttcctttagataacatgtggctcaggttgatttaataatgggtctggggtgtctgcatctctatgctgcttttccagcactgtactgcctgtagtggaaaagactcttgaagtccaccttgcgagatttctgcacagcttcagcaaaaagtttggtcacctgaaaattagtgaggagagggattccactatcaacagctgtcctccgaatcacataattatcatggacaaatttagtgttgttgttgggaaggttaatcactaggtcaatgctgccatctctaatcaattttctgatgaaag

SEQ ID NO: 702846 - DNA, 614 bp, Homo sapiens
  misc_feature (189)..(189): n is a, c, g, or t
ccagagcctgactggcggacctgctgcgggagccgctggaattggcatgcctcctcggggcccgggacagtctctgggcgggatgggtagccttgtgtgccatgggacagccacatgtcatctctcagggcagcacgccatccatgggatcctcggggaatgggccgctcacagtcatggcgtgtcgtngtctagcggcaactccagcagacccagtctgcagctccaggcaggtggcgctgcagacagcaggggagaaacagcaagcagttcgcagcacgcagcagcaggcgggcgcgtacagcaagcagcgaagcagacaggagcaacagcagcagttccaggctcagacagagtgccatgcagcaggcagtccaagcagtagtgcagcatgcagcaagcgaggctccagcaggcagcaagccaggcagcgagcagcattctaaattggagttggcattcatcaaaatcagacaaggaggaatacgaggcaggctagcgaacgcagcaggctgggggcggaaatagccacaagggtgcagcccccaaacaacagaaacagcagcagcagcaggagcagcaggcagcagcagcggctttggaggacccagcca

SEQ ID NO: 702847 - DNA, 744 bp, Homo sapiens
  misc_feature (353)..(353): n is a, c, g, or t
  misc_feature (389)..(389): n is a, c, g, or t
  misc_feature (422)..(422): n is a, c, g, or t
  misc_feature (447)..(447): n is a, c, g, or t
  misc_feature (488)..(488): n is a, c, g, or t
  misc_feature (490)..(491): n is a, c, g, or t
  misc_feature (497)..(497): n is a, c, g, or t
  misc_feature (499)..(499): n is a, c, g, or t
  misc_feature (506)..(506): n is a, c, g, or t
agcgggctgttcgcctgcgtcgctccgggagctgccgacggacggagcgcccccggccccgccgggccggccgaccgccgcgcatgcccttctccaacagccacaacgcactgaagctgcgcttcccggccgaggacgagttccccgacctgagcgcccacaacaaccacatggccaaggtgctgacccccgagctgtacagcggagctgcggcgccaagagcacgccgagcggcttcacgctggacgacagtcaatccagacaggcgtgggacaacccgggccacaccgtacatcaatgaccagtggagctgcgtggcgggcgacagaaggagtcctacgaaagtgttcaanggatctctttcgagaccccatcatcgaggaccggcnacggcggctacaaagcccagcgatgagcacaangacctgacctcaacccccgacaacnctgcagggcgggcgacagacctggaccccgaactacgtgcngnngctcgngnggtgcgncacgggcccgcagacatcacgtgagcattctgcactaccccccagcactgcaagccgacggggaagcgcacgcgcacatcagagaaagctcagcggatggaaagccactgtccaagcctgggacgtgcgaacctgagcgggcctgatactaacgccgctcaagaagcatgacggagcgcggacgcagcagcagcttcatcgacgaaccacttcctctttcgacaagcccgtgtcaccc

SEQ ID NO: 702848 - DNA, 174 bp, Homo sapiens
ggaagattggcgagacgagcacaggagcaactttgctaggacctggtgtaccagatagatgggggcgacatcgcaacagggtacttcggtccttggtggagcatctagctcaggtgtttcggtacttagcctgttttagaaaggtgatgccatgattatggaggacacagggaa

SEQ ID NO: 702849 - DNA, 1101 bp, Homo sapiens
agcgggctgttcgcctgcgtcgctccgggagctgccgacggacggagcgcccccggccccgccgtttgggcctgccgaacggcttctgcttggtgcctttccatggaggcgcgtgcgctgtggcctttgtcctgtcggggcttgggtgccgatggcccgccgccgtgtgggtgctggccagtgcagcatggattcaggccgcgaggcagcacggagctgctattggcgcagcttgcgtcgttttgcgccggggaccgctgaaagggcgatgcccacatcgtcgtgagctcagtctctgaactgaatacagggacagatgtgagactttgccacggaggacacatttgcagatatccctcctttggcacagtcgagtgacttcagggttgtgccgagagagtaaacgtgacgaaagataggtaaaagaacgagtgttccttgacgaaaacggcattcgattcgcaaatctctttacccgggaactgtgcaaaccggcttgagacgcacctacattcgtccaattcgaagagtggaaaggagcctaattagcaccgcttgcctcttgcatgcctacgagacccatatgacgtcgtagcgagagggttggggaacctgatgacgtagttaaacttcgacaaggacctaacaggttggtctcgcaagagtgctcgggtgtgggtttgcaagacttatcccgaggacaagttatcctttatccactgaatttgacgttgaacatagcacggaacaacggtttttagcgcaaatggaaaggaaagggtggggagaaaagcagaattcgatggaaacagctttttacaacggacttcgagggggggggacctaccaagcccctgggaatcatggctccttggaataacggacaattgtgtggccagcgttgtaacaggggaaacagtcctttccagctttccaacaaggcccactttgggctggtagggaccgtaagggaagttttgccaagttggccatgccgggcggttgcaaactttgcaatcttaatcattcccagttcacgaggtttgggactcattgggggccaggtcttcgtggacgaatgacccggttgtaatgtgcctg

SEQ ID NO: 702850 - DNA, 1053 bp, Homo sapiens
  misc_feature (1053)..(1053): n is a, c, g, or t
agcgggctgttcgcctgcgtcgctccgggagctgccgacggacggagcgcccccggccccgccgaggccagcacgcccggcggaggcgatagaccctcggtctacgagcactccaccaaggcccctggacggttggcgctatgctccagggcgagggtagataggtgttcgcgagagacatcggactcgccctactagactagtcagaattggcccaatggctgggtagatgtcacgtacgcctagtcagcgccgcgacgctgttgactctgccaaaggaaacgacaggccgcacgacgaggctgtgaagcgtctcgcgaaccgtaccgattcattacccaaggaccaatgtggccgctagggtaccaagcaccggccgagctggctagttacccatgctaatagtaacacagctggggcgttggtgttgggccgaggtcgaactgaagtcagatctctggcatagggctagatgcttcgagacactcattgctgagtctccagttggctccaaggtgatgccgagactgcaaggcgtactgaccaaagtcacaagaagcactcgcacccaaccaagggacacaggacacattcatgtccacggaatgacacccttgtaagagtgtcgtgctgtacttcaatctttgggtacaaccgggacactaatccgtcggcgcggaacttacggagtggctcgcagacgaagcgcaaacgtagtacgatccggattgacttacacgctttgcgccctcaccgtaacttgcatttacttgctcgtggagaggaaagccaagccaccgatcagagggaattgcatcttgggcgaagtcacagaccaagaaaccggtacccaaaggaggttccggtagtcggtaggggcagcgtcgtggtgacacataacgctgtctctagtgaggccttgggaaccgtgagacgggtttcagccaacattcttagcggcatcaaattttgacccgaaccaagttgtcccaatctaacagtctccctccaccgggggtgttacgttgcattggtttccattgggaccctacn

SEQ ID NO: 702851 - DNA, 780 bp, Homo sapiens
agcgggctgttcgcctgcgtcgctccgggagctgccgacggacggagcgcccccggccccgccgaggcgctacgacgcgcaggaacgcactgtcctagagggtacctgcaagttggtattgatcttggaaccacctactctggtgtgggtgtatttccacgccaaggtagaaacgtcgcagcataattgccaattgatcagggtaaatgcagaaccacatcctagatgctatgtcgctcgtttacggacactgaacggttgatcggtgatcgccgcaaaggaatcatagttgcaagtggatgcgcccaacaagcgagagtttcgtgatgtcaagaagtgctgagttgtgacgtgcgaggatgttgatgagtgcatgtctgatccaggtcgtgactatgaatactattggcacctttatggttgggtgaactgatgactggcaggtcccaaggtccaaggtaggaactacaaggggagagaccaaacagcttctatccagaggacggtgtctactattggttctgacaaagatgaaggacatcttgcaggaagcctaccttgggaagactgtgaccaatgctgtggtcacagtggcagcttacttgaatgactctcagcgtcaggctaccaaagatgctggaatgtacttgcttggtctcgaagtagtacgtgtagagattgattaactgagcgcaacatgcatgcatgcatagttgcgttacggcttagacaaatcaggttggagcagaaagaaatgtgctcatcttgtgatctgggagg

SEQ ID NO: 702852 - DNA, 166 bp, Homo sapiens
  misc_feature (30)..(30): n is a, c, g, or t
  misc_feature (70)..(70): n is a, c, g, or t
  misc_feature (81)..(81): n is a, c, g, or t
  misc_feature (130)..(130): n is a, c, g, or t
  misc_feature (153)..(153): n is a, c, g, or t
ctatagtcccacctactagggaggctgagncaggaggttcacttgagcccaggaagtcaaggctgcagtnagctgtgattncaccactgcactccagcctaggcaagagagcaataaatcttaaataagntttattatcgtacttagcaggangttcattggtaag

SEQ ID NO: 702853 - DNA, 323 bp, Homo sapiens
  misc_feature (45)..(45): n is a, c, g, or t
  misc_feature (68)..(68): n is a, c, g, or t
  misc_feature (97)..(97): n is a, c, g, or t
  misc_feature (192)..(192): n is a, c, g, or t
gtcggtctagaccgcagatgtaggaaaggggacgtcaggccgggnacgccgaggccggcgaagtcgtnggcgtacttgagcttccaggagcgctcgntgggcccgttgaaatccgagtactgctgggagttgtccaggtacacgctgtcgcactgggagcgcgatatcgacctgaaatatgtggtgcagggnggcaaggccaaggacttggccgtgcgcctgcaatgggcgaccaatcgcggcagcaatggctactctgcagtggaccgcgatgtggatgaataccgtatgatcgtggattacccgatcaacgtgttctgagt

SEQ ID NO: 702854 - DNA, 657 bp, Homo sapiens
  misc_feature (507)..(507): n is a, c, g, or t
tatagttagtgagaatgttaataagtacaaccactatggagaaaagtttagaagttcctcaaaaatctaaaaatagaactaccctgtgatccagcaatcctattgctaggtgtatactcaaaagaaaggaattcggtatattgaagagatatctacattcccatgtttcttacagcactattcacaataaccaagatttggaagcaacttcagtgtccatcaacagatgaacagataaagaaaatatggtacagatatacaatggagtactagtcagccataaaaaggaatgagatcctgtcatttgcgacaacgttgatggaactggaagtcattatgctaagtgaaacaagccaggtacagaaagacaaacttcacatattctcacttgtttgtagaaactaaaacttaaaacatttgaatttatacagcctagaatgatggttaccagaggctgagaaagagagtgggagactgtgtagaagtgggcatagttaataggtacanaaatatatttagaatgaatgaataagagctagtatttaacagcacaataggatgactacaatcagtgctaatttatggtacattttaaaataactaagataccagttggatttgtggtaacacacagattcatgcttaagttatggccct

SEQ ID NO: 702855 - DNA, 812 bp, Homo sapiens
  misc_feature (6)..(6): n is a, c, g, or t
  misc_feature (92)..(92): n is a, c, g, or t
  misc_feature (115)..(115): n is a, c, g, or t
  misc_feature (118)..(118): n is a, c, g, or t
  misc_feature (124)..(124): n is a, c, g, or t
  misc_feature (163)..(163): n is a, c, g, or t
  misc_feature (168)..(168): n is a, c, g, or t
  misc_feature (172)..(172): n is a, c, g, or t
  misc_feature (184)..(184): n is a, c, g, or t
  misc_feature (302)..(302): n is a, c, g, or t
  misc_feature (309)..(309): n is a, c, g, or t
  misc_feature (321)..(321): n is a, c, g, or t
  misc_feature (331)..(331): n is a, c, g, or t
  misc_feature (547)..(547): n is a, c, g, or t
  misc_feature (641)..(641): n is a, c, g, or t
ccattnccccccgagttcataattaatcagtatgggggaaagcgcgagagcagcaccatttcaaacaaaggcggcgcattcaacatgggggngtgtgcagggtgtaggcgtgggngtnacgaancaccagcgtttcttccccatggggcccagttcaggcggncccancctngggcgcttcttncccctcccctttagtaaccccattcagcaggcagcataaaacactctaacccttcattttgctgaaagcccctgcagatgacagtttccttcctatcatgtctgcggagctccaaggntgggggngatgttgaggcngaagccagcnacagtgcctcagctgtgcctttcctggagagcgggtggccgcccccagcacatccctggcacacgggcttgcataacagactcttgtaccgccatctctagcacaagaccatggccacatctccccaaccactcagcccgcacagcgtgcaaaggtggggagttcactttaatggcattcctccaacgacttattgtaaaagaaacaaggcatctngtcctgggtgcgcaacacccagcagcatccgtttagaccaccaagggtaggctgcgcggggtgcacagggatcccgctgcggctcggcgaaagnggagatcctgggatccagagcagcccggggagccctggagtctggaaaggacacagcagtgggggcggcggcggcaactccagctctgagcccgttggcaccccgcacggtggccccagccagctggaggcaggctcaggagcggctcctgttcttgtggttcccacgatc

SEQ ID NO: 702856 - DNA, 467 bp, Homo sapiens
cgcggctgcgcggggcagggagcccccgcccctgcccctgcctcccatacgagccccttcccatacgctggcaccatgtgggaccagcggattttgcgaggaggatggggcctgtgttggtgagggctggttgggagagagggacacagagggtatgcctgctctcacctgcccctgtcgctgtgtcccttgcttccggcccctgccgaccgcacctgctccacggctcacttggctccattcagagacccatcagcttcctcttccgttcctcctctcagagtggctcagcgcccttcctcaccatactctgtcctgcagacctctgccggtacccccctgcgttccggatcagaaggactcagtgactcagctgcgcccggtccttgagtcccggctgctgctccccctgcctcaggacctggccgaggctcttgccagtggggtcatcctgtgccagctggccg

SEQ ID NO: 702857 - DNA, 900 bp, Homo sapiens
  misc_feature (594)..(594): n is a, c, g, or t
cgcagtggctcacgcctgcaatcccagcaccccggaaagccgaggggggcggatcacttgaggtcaggagcccgagagccgcctggccaacgtggtaaaaccctgtctctaccaaaaatacaaaaatcagctgggcgttgtggtgggcgcctataatcccagccactcgagaggctgaggcaggagaatcacttgaacccggaaggcagaggttacaatgagccaagattgcaccactgtactccagcccgggcgacagagcaagactccgtctcgaaagaaaaaaaaaatgtctttagctattaaacaaaggaaaggccagagcaatcaggcaagagaaagaacatcaagggtctccaaattgggaaccggaggtcgtcaaattagccttgttaccagataacatgaccttatatttagaaaaacctaaagattccaccaaaaaactgttagaactgataaattgaggaaagattgcaggatagaaaatcaaaatccaaaaatcaatacaatttatatacatcaacagtaaacaatctaaaaaagaaatcccaagtgagtaaatcccaagttaaaatagctacaaagaatatnaaatacctaggaatccagtttagccagagatgttgaacagatctattaaagggaaaacctattaaaattactgatgacacgacacttgcacgaggacacacacacaaaaagggcacaacggttattcctatgctccctggacttgggacctaacttacagtctttgtttccctattctttatatctctgcccttttggacacacccgtctgaaggtcacttttcggacagaccctttcatataacgggacacggggtcttcatatcaactcggtgccacgaccttcgggtcaaaaccccctattat

SEQ ID NO: 702858 - DNA, 589 bp, Homo sapiens
  misc_feature (120)..(120): n is a, c, g, or t
  misc_feature (263)..(263): n is a, c, g, or t
  misc_feature (435)..(435): n is a, c, g, or t
  misc_feature (534)..(534): n is a, c, g, or t
taagcaacgtcgtggttaaatgatgcatatgttgctggagttgatatcacggtggacgacgcgtggctctgcttatcgtcgtggaggaatccagccctcttgcggcgcttacggcgatcntcgacccgctgcatccatgataagactggtcctggctgggatcccttgacaccctttttaccatggagaatatcatgcaaggagcctcttgtcgcatactcataagcaagaacacgggtgctccccacagctcagtacccganaagttggatcatattgtcatgtttgtcctcgtgaaacagccgacacctgcgcaaggaactcttggtcaggctgtttgccagagtcgagcctcttcaccgcgcatttcttgccatctttgagtacaccaaagaaaactctcgcgtacgacccctctcctataagagcatcatngctgaagttcttggttatttccttcagttcttctaagggaatgtctggtacttcaattggctgagttcttacggtacggacggcattagtaggggctgnaccccggttatatccattgttacctcctggggcagggacccaggggatcctctag

SEQ ID NO: 702859 - DNA, 383 bp, Homo sapiens
  misc_feature (367)..(367): n is a, c, g, or t
acccgttttacactacgaagaaaccaataaccaaagcatctgacacaggacaaagttaggagatccaatttcaaaacgtaatacaaagctatagtaatcagaatagcatggtgttggcataaggatagacatataaaccaaatggaatagggtctgtaaatcctaaaataaatctctacctactataaccacattgttttttagacaaggcgtatcaagatccattcaactggggaaggaatcattctcttcaacaacatggtgcttggacaaccaggatatccacatgcaaaagaattaagttgcacccctacttcacaccatatacaaaaaaattaactgacaataaatcaacaatctacatatnagagctaaaaccataa

SEQ ID NO: 702860 - DNA, 196 bp, Homo sapiens
  misc_feature (131)..(131): n is a, c, g, or t
  misc_feature (159)..(159): n is a, c, g, or t
gtccaatagccatctcagtcagggttggttgggacagcctttttccatcaaattccagtccttaaccatgcaaagcagcaggtggtgcatccctcaccagctgactgcatctccaccccaaccaccctcgntttttccagcatacaactggcaggtccncagtggcaggttttggtggcacttcacatcccaggca

SEQ ID NO: 702861 - DNA, 363 bp, Homo sapiens
gatgggagaagcagcaaagtcaggaagcaaaaggacatgaatagaaagaaaagggaagtttgggcacagacacagacaagcacacaggaaagatgaggggaagacacaggaagaagacagccatgtgattggagtgatgcatctacaagccaaggaacaccaagtattgccagcaaacaccaaaagctaggaagaggcaaaaacttcccttacagatttcagagggagcataaccctgatgacaccttcattttagatttctagccaccagaattgtgagacattgaattcctgttgttttaagccatttagttggatgtacttagttacatcagccctaggaaataaatacaaagcccattt

SEQ ID NO: 702862 - DNA, 294 bp, Homo sapiens
  misc_feature (29)..(29): n is a, c, g, or t
  misc_feature (143)..(143): n is a, c, g, or t
cccccccccatttttttttccattttttngaggggggggcgttttccccctttgggccaaaatttgacccccttttttttttttggggagggggggccccccccccccttttttggggtttgtttaaaggggccccccccctnacccccccttaggggtgggggggggggggcccccccccaggccccggcccccggggggttttaaatttttttttttttgcggggggtttcggggggtttttcccctaaagggggtttttttttttttttaaaaaaaaaacccccgttttga

SEQ ID NO: 702863 - DNA, 607 bp, Homo sapiens
  misc_feature (143)..(143): n is a, c, g, or t
tggggtctcccgcggatccctcccccccccacaaaaatattttttttcccccccccccccccaaaagacgaaaaccttcccaaaaaacaacaccccccttctgttgttggggggggaccccacaccaaaaaaaaaaaaggccnaaaaaaaagaacgttttttttttaaaaaaaaaaaaaaagagggcccctccttttttccccgagaagaatgggcccccccccaaaaaaaaaaaaaaaaaaaaagggggggggggggttccccccccccaaaaaaaaaaaaaaagggcgcccctctttttttttcacaaaaaggggggggcttccctcctaaaagacccccccccccaaaaaacctttgttttccccccccaaaaaagaaaaaaaaaggggggggggaaaaccccaaaaaattttggggaagccccacccaatggggaaatccttttccaaaaaaaagccccaggcctttttttatttttaccaaaccaaataccttttcggggggggccccaaaaccaacccaagccccttccaattccctgaccaatcgggttccaaaatccccttctgggtgtgcacccagaatgaccttgtaggataaagcc

SEQ ID NO: 702864 - DNA, 83 bp, Homo sapiens
gggccagcagggatggggttgggggggttgtcccaaccccacctgtttccttccccaggtccactaaattccctcctgcccta

SEQ ID NO: 702865 - DNA, 109 bp, Homo sapiens
aaacagcttcagcatgacaagctaatggtcacttcaccatagtggacaaagcacccagagggtgatgctcttgtcagataggtcatagtcagtgggggtaccgagctcg

SEQ ID NO: 702866 - DNA, 262 bp, Homo sapiens
gggccggtcccgatgagatgcgtttccgatgaagatgcgttttcgccgatgcgttttcatttctctaaaaatgtttctatacaataccaatctttttttctttgctttagtttcagcggcacatatcttagaagggtccatgttgtaaaataagtcaaaagcagctctaaataattagaaccttctgccagatctgttttctggcactgcctcttctacgtgttacatcgcgccatcattggtacgaaaacggcatcttcat

SEQ ID NO: 702867 - DNA, 235 bp, Homo sapiens
catgggatactgtatttctaggagagagggcatgtccagagggtggtttgaagccagtcagaagactataggagagacctgttcttttccgcagaggtcctaggccatctgtggatttggagggttatgggtgatgaggggctgccggagtgatgcggagtccttgtctcagtcgtgactggtggtctcctggcggagggtgggagggattccctgatgtagactcaggtgttag

SEQ ID NO: 702868 - DNA, 673 bp, Homo sapiens
  misc_feature (537)..(537): n is a, c, g, or t
  misc_feature (667)..(667): n is a, c, g, or t
ggtgtatggcacatgtatctcatggggtcgacgggaccctacttctcctatcataacaagaacttatcgcctttcatttcacaccctcataatcgtttaccttatctagctccctagacctgcatgcgctcgtaataacattcacaacagacctaactaatactggcatctaagactcttaggagatagcggccgacctgaactatcctcgccattcatcatactaatccttatacccctgtcatgggtacttatcctttacataacggacgaggtctacggtccttatcttaccattaaatcgatggggcaccgatggggctggccactcgaggacattgtctaaaacggactattcttcaatttctactttcttgcccgatcattgctagaacgaggtggcctccaactacctgcacttgactatatcgtcgttttacccgactgacgcccccctttgactaataattagggcacatcaagcagtggcactgttgcgctatcccaacctttggattgacccatatggaaaaaccnggcgtttaatcccaacttctttctacatacacgaccgttgcatacttggtggattgccttagagcccttcagccatccacagttgtatgccctgtgctagatcaatttccctaaagggctcggtggcttntcacga

SEQ ID NO: 702869 - DNA, 758 bp, Homo sapiens
aacccagctacgcaaaatcttagcatactcctcaattacccacataggatgaataactagcagtgctaccgtacaaccctaacataaccattcttaatttaactattgtatattatcctaacatatcgtaccgcattccgtacatactcaagcttaaagcgtccagcaggcacgacccatactacgtatctcgcacctgaaacaagctaacatgactaaacacccttaagttccattccaccctcctctccctaggaggcctgcccccgactaaccggacttttgcaccaaaatgggccattatcgaagaattcacaaaaaacaagtagaccctcatcatccccaccatcatagggcaccatcacccatcctttagaccgtctacgttcgtaacctacgtccgtaatcatacgtccaactcacatcacactacatccgccagtatctaacaacggtaagaaactaaaagtgacagttggacacagtacaaagaagaccaaaccacccaatttcccgttcgcagcagcaacgtcatccggcccctttacacaagagcttacgtccttaacctaattcttcccccgttttaattaactaacataaattctttattcgcacaacgggacaaccaacgcgcgaccgcaaaggaacagcatagataccataggtaggctacgagcgcggcacacatccaaaaccggcgagaaaaaccgatcacatgcgggcaacggcgccacaacagcgacaggggacagggc

SEQ ID NO: 702870 - DNA, 964 bp, Homo sapiens
  misc_feature (664)..(664): n is a, c, g, or t
  misc_feature (683)..(683): n is a, c, g, or t
gggaggttgcagtgagacgagatcacgccactgcactgagcctaggcgagagaggaagactccagctcaagaaaaaaaacaatggactggccctaattggtacagccatttaaatgtgtctattacatttaacttttcttaatgttgtcaactaaagagtttattcattatactgggagcatactggaacacaaatactggattcctttggaaaaactaaagagaagctcgataaaacaaaatacagaagctctagattcctaatggaagtgagcgtactctcatttttaaaagagtggacgatgccgtaataaaagccgaccatgaaattaacttgattctttctttcatggagcttgcacaggaaagctagaaaggagggtctgtgtggagacacggggctcaacactaagagaggggaaaatccaagttctatacgccaagaaccatatcggaggccgggcacagtgtgctcacgcctatatcccagacacctggggaggctgaggcgagcagagtcacctgaggtcaagagttcgaaaccagcgtggccaagcatgggtgaaaacccatctctactaaaaatattttctaaaaatttagctgggaatggtggccagatgcctgtagttcacctacttgggacgatgcaggcgcgaaaatnggttgaaccccagaagtgnacgttgcactgcagcccaaatggcgccatgcatcccaaccgggggaggaaccaaccgggtccacacaaacaacacacgggtcgggcctggcctccacggatggggcccagaggggcttttccccagctactcccacgatgggccacctgcctcgggccgaggaggggaaactcaccaaaacgcgcagaagacacacgcgtgagcgaacacggaacacggggcccgcacgacacagcgacactcccaagggacaggacccaccacaaaacacccagactcac

SEQ ID NO: 702871 - DNA, 112 bp, Homo sapiens
cgattccttgaggtatccccattcattgcggatgagccatcatcacaccactgtactcctgttctctagcctgggcagcctcggtctttaaagtaagacactgtctctttat

SEQ ID NO: 702872 - DNA, 233 bp, Homo sapiens
tagttggtagctgatccagcatttggatcttatccaagaaggatgtatcaacatgacagggttgatgctatagcgattccacggggagcttgtcatggcttcgcgaggaggtgacgtcatcctttcatactgctctttgatcttctcttcaagtaagatgcaaagtacactaacttcctgacagacacacgcatggagtaccgatgctcgcacagttcgtcaatcattggttc

SEQ ID NO: 702873 - DNA, 390 bp, Homo sapiens
cattgagcccctttgatgctacttacatacaagaagactttataaaataatcactgcacaaaatgttaaagggtggggttatgcatgtgatattaatttttcctcaataatgtttttcttgtactgttcatgagctcattacagtttccacggtaaatttgttttcagaatgccgaattgcgaaacacttgctggcttcacgtttcttaatacctttaatattttctctgcgttgcagttagtaagtttccttgtcgtgacacagactatcattgaagaaggccaggttatcaatgttttcaatgcgatcagtaataaccatgtgctcatgaatcagataggactgatgcaaataggttccagccttgatgttcataagtactccagtag

SEQ ID NO: 702874 - DNA, 151 bp, Homo sapiens
ccggcgcatccgtgataagcaagaactcttccacttcggagcgcaagaagttcccatcctcctcctcttcctcctcctctccacctcctcctcggcctcccgtgctctcccggcccaatggaccgcccatgtacgaagtgcctgagcattg

SEQ ID NO: 702875 - DNA, 429 bp, Homo sapiens
aataatacctaatgttttttttccttaccaccatatatacttatttataaaagtttaatctaataaaagtggggcccagccaagagattaacaacaactaataaaatagaactataacaatgtattgtaataagttatgtaaatgtaggccaggcatggtggctcacacctgtaatcccagcactttagaaggcccacgtgggaagatcccttgagtccaagagtttgagaccagcctgggaaaggtagtgagacttcatccctacaaaaaataaacaaaaaattagctaggcatggtggcacatgcccatagtaccagtgactcagaagaggtggaaggatggcttgagctggggaagtcgagactgcagtgagccaagatcatgccactgtactccgagcctgcgcaacagagtgagatcttgtcta

SEQ ID NO: 702876 - DNA, 1261 bp, Homo sapiens
  misc_feature (483)..(483): n is a, c, g, or t
  misc_feature (486)..(486): n is a, c, g, or t
  misc_feature (488)..(488): n is a, c, g, or t
  misc_feature (492)..(492): n is a, c, g, or t
  misc_feature (631)..(631): n is a, c, g, or t
ggccgtgggacgggcggaggcgcccgagttcccgcttccccggtcgcccttccatccccggagcccgactcatgcccgtcggccacctgcgtccccgcccctgtcgaggcgtgcccgatgcccagcgccgcgagaccgtctcccctgggcgggctggctccttggcccctggaagcgcgagctgttcacttatggcggcgtagtggctccgtctccgcggacagagtccgcgcgccccctggcccggcccgcgaggggctcccggcgtcggttccctcgtagcatttcccgccggtgtggtagtcggtgccgtagcccgggcaggagtgaccagaccccggcggccgctcaaagccggggagattcgtacttgtttgatgacccggcaagtcagcatgcatatgctggtcggaagcccggtctcgcgtgagaaaacgggtcggcccgcgcggatgctcgcgagattccgcatgaaggagctgnatngnaganaaggaggtagaagagagaccagaaaaagattttactgagaaggggtctcgtaacatgccgggcctgtctgcagccacgctggcctctctgggtgggacttcctctcggagaggcagcggagacacctccatctccatcnacaccgaggcatccatcagggaaatcaaggactctctagcagaagttgaagagaaatataagaaggctatggtttccaatgcttcagttagacaatgaaaaagacaaacttcagtgtaccaggttgataccctaagaagatatgtggcatggagctttgaagaaacagcttggttgaattcttaggcgggcaagtacgaagagacaaaacaaagaattcgacacacggggaaaaacacgcccacagtatacttgcaatttccagttgctgaagtcaaggcaggcccttgaaggcaaaggaggaggaaatggctcgagttaacattgggattaattcctaaattcaggacaatagctaaccattggagaagccttccggaaaacccttcaataaattgttcggataccaaggtcctaccaagatgacaacacgaagagttaaatgccctcaaagtcgacaggggatgggaccctaggaagagccagtgaagtggagcgtgacaaaatgaacatcgtggcgacatgtcgccgcaaaagagaactcttgcagcaactcactgaccaaagaaacacccacacgaggacacagtgaaggactgtgtggacctagagtatccctgctgggagaatc

SEQ ID NO: 702877 - DNA, 140 bp, Homo sapiens
gaaagcatgctgcagcctctgcagttacagggacactaacagctggctcctgaaggagcggagcgaaaccagcgacaagcggaagttcctgaaggagcggcttgcacggctgacgcaggctcgaggcctggttgcccagt

SEQ ID NO: 702878 - DNA, 82 bp, Homo sapiens
tcttctgtgtctctttattaccctccaggcccgtcaaaccctcaatctctccctttaccccctttaaagccaaaaaaaaaag

SEQ ID NO: 702879 - DNA, 322 bp, Homo sapiens
cagtattctgaaaccctgtctctaccaaaaatacaaaaattagccgggcgtgatggcgggcacctgtaatcccaggccactcgggagactgagacggagaatcgcttgaacccgggaggcagaggttgcagcgagtcgagatcatgccattgcactccagcctgggtgacaagagcaagactccatctcaaacaaacaaacaaacaaacaatccacacttttccctgaaatgagaggcactcatcctcattctttggtgtccctgtggcccaggacagagtctactcccaggacagagtctactcaggacagagtctaactc

SEQ ID NO: 702880 - DNA, 980 bp, Homo sapiens
aacagaggaggtattacaatgttatgtggaatgaaatcctttatctccctttattactgtggtaggtccctcacttggatatacctctgttatcacgatagaaataagggaggtctagagactttctattccttggacatcgtcgacggagagctggccatgtcttcacaaacccttgctagattgactgaagtttatggaataagatgtattctcactcccttgatctcaagggcgtaaccatctggaagcacagcttgactacatgtcatttttaccaatgattttcaggtgacctgggctaagtcatttaaacgtagggtctttgataaacagtaaagaggccaaccatttaattattttgcaaagcaatctaagagctaaagatgtaatttttcttgcaatgtaaatctttgtgtctcctgaagacttcccttgaaaattagctctgagtgatagaatcaaaagagacaaaagacatcttcgaatccatatttcaagccctggtagaattggtttgctagcagaacctttccacaagttttatattgagattcataactacaccaagaattgattttgtagcccaccattcattccatactgtatatcagaggagtaggaagacgaggcaacctttgacttatcttggaacagccacaatgtgctttagaataagaataactggtccattccccttttatgttattgatatcgtcttggtcaatcatttggtttggagttttcccagaataggccccttggtcatcttgggctggccagacacggtcttggtacttggactttaggagaccacccttctctggttggtattatgaggggccagcaaggagagtagtttttggggaaaccttggaattaagggctctcgaaacaaaataaaacacacggcgagtccctcgcccacctaagcgtcagcggctcgctctagaacttcacattctatcgtttaagtctat

SEQ ID NO: 702881 - DNA, 396 bp, Homo sapiens
tagttaagtggttactccaacctctatggcccggggatttatgctgactctgaatgggagaggggcaaggtagaccgcaggttactcacatgtaaaaggagttggggtaggtaaataaaagctatccatgctagcctgctgtgtttattgtagagactgtttaagtatatgtggtaagcattcttttcgcatcctctggattggatgagaggcaggaagatggcttgccagaaataggacaagacataaaacccaaaatggtcctgtcctgtggtgtccacagcttctccacctggaggagtgccttgcatcgggggactcagaattttgtaattacgaatctcctctccgtgaaacacctttaacccaattccaataaatcatgtatttgcttta

SEQ ID NO: 702882 - DNA, 651 bp, Homo sapiens
  misc_feature (277)..(277): n is a, c, g, or t
ggagtcggcgcttgcgcggagaactcagcgctgagattgtctaaagccccaggaaaaatggtggaaaattcaccgtcgccatgccagaaagagcgattatggcttgtcttttcttaagctcccaagttgcttcatactttacctcgtgtgggcctttattcctgaatctttggctaaactctttaagtttaacctatgtggcctcaaaaatagttgggcagttgcattacctgtctacctccttatttgctatagtaatgggctacgtgctcttgtngggattaacatgatgagtacctctccactcgatccatccatacaatcacagataactatgcaaaaaatcaacagcagaagaaataccaagaggagggcattccagccttaagagataatttctatagtgaagtaaacaaatgttctttcttgcagccaaagaactttacacaaaaatgaatgtgtgtaaccaatagtaacacaaagcaagtatttatttataagttgtgcattataattttgacataaattaattgtgaccatctctcttatcaatagagaagtaaaaaatgtatgtgaccttctcttagatgatgtcactgaatatggtaatgtcagtatggtaatgaatagaataaatacaatatgggattc

SEQ ID NO: 702883 - DNA, 1432 bp, Homo sapiens
gctgccttggaagagtgtgggggcggcgacgtggagtgggcggcgatgcccccgggagcctgggcgttaggccctgggcgtggctggggccccgtgctggcctggggggtctcctgggccccacaccacaaccatggagcccagcagaccctggaggatcaggtctcagaatgacatgaactggagcacacgaagctgcccctgagtgtccctcagacagatgaacatgacgccagaagggagacaagctatgacacggaatccagacagaccatcatcacggcagagagatccaagaaagacctcactgagagagaccaatagcatggacagagagagagtcatgagagcaggaagcggcacataggactcaaacataccggaggatttagacaaaccaagcacatcatcgaagattggacccctagaggaagccttctttcaaccaaatgcttcagacccggcatatgagcaacgaggcaacagaaaatagaggagaagtgttctaacaaagagagccattcggaataaacacacacaaaaggacgagtaggataggaacaaataaaagactcaatcagaaaccttggaagagaaagagacagaaggtgaattgaaagaatcaaaagggaaaatacacaagacaagaagaatcaacctgatccctcgaggatcaagatgcaagaacagaccccaataacaaatcaaccccggataacaatttgagaaatacacatacacattaaaaggatggcaacccaaaagacatacatggacattcaatcgaatgagacaggataacccttgaggaacggaataaggatacaagaaacaatagggaacaattggcctctaaaaacccagaggaccaccttgagaagggacgaaccaataccaatttgagccaacaaaaccatagagagaaagaatacaatgaaggggcacctgagataaatcgtgaaacccagaaaagacaagaaaccgacaagaagacaaaattacaaaggttgccaactgtgattaacacaacgagaagaaaggtgattgacaataacagctggtcaggacaataggggataacaagagcagacaaaacagaaaacggacgaattaaaaggaaccaacatcgacggaacaacccacaatgaaattaaaccgaggctaaacaagaaggcgacctaaaataagcgaaaaatagcaccatggaaaagaaaacacgaaaggacagggagacacaaaataagcacacaccgaaaaaaggacaaaaacaaaaaagccacaggtggcagaaagaacacaagaatgaaggaactaaaaacaacagcagagaagagaaaacagaagacaaaacccgagaaagaagaaaggagacaaacagaaggacagattcactgccactctctcagaagataataaagaacaaaggaaaaag

SEQ ID NO: 702884 - DNA, 1409 bp, Homo sapiens
agtgttggtagtgtcttgtgtgagttttctgtcgtggagagtgtgttagcgtgtcaggcgagtgtgagggtgtgttgtgtgttgtgtagttgttgtgcgtagggtgtagttgaggtatgttgtgtgtgaggtagtttctgtgtgctgtgtggtttttgtgcatgagcgcagcgctgctgcgtgtgtagtaggggtagttggtctgttggtgggacggtgtttagtaggtttgaggagggtggtagtagtgtgggtgtgtggtactttgtgttggttgttggtttggtgtgtgcgtcgtgtgtagagggtagtagatggatgtgtaagcagactgatggatgtagtggttggtcgttgtatgtgtgttagtgttgggtgtgtgtatttggtcggttgtgatgtgcagttggagtgtcgtttgtatgtgtgattatttggtatctatgttgtttgtatatattgagtgtagtgtaggtttttgggttggttggtttctttgtttgttgtggttggtggtctgttgtatgttgtcgtgtgagcgtgtttttgtgtaaatatgactgaagagagtagtgaggtgatatcgtaggtgttgtcgctttagtagtttgatttggtagagtgttgtacgaggggtacttggtgaggagtgtgtggtgtttggcgtttgagtgatttgcttttggcgctaagtgatactatgtgagagagtgtgttatagtgcgttgtttgcgtgtagtagttgcttgtagggtatctggtagtggagtgggtggtatagggtggctggtgtttcgtttggtttatgtgtttcgtttatctgtgctgcgtgtttggtctttcggcgcgcgtggtgtggttcgtccctccttgtttctctttctttctggctgtttgcgactgcctctctgtttccgctgttgtcgttgctgtgcgtctcgtctctacgcgttctgctctatctctgcgtgctcgcgccggcgactcgtcgcactcaccacgggcgttcattgtgtctgtatgacttgtgagttgttcggggtgcgtccttgttttgtggcttgctccgctccgtccttcggccgtgtggtcgggctggtttctctcgctcgctcgaggagtgccatgctatcgtttatatgagtatcgttagttcgtgttatattgtgtccactctacatgttggtttttgtgttttctttgtgttgtgttgagctagtgtttggagaggttatgttgttgtacgagtatgatgagtgaaagggagtgtttgggtgtgactagagtaagataagaatagtgagataagaatgagataaaatataagaataagtgatataatagagtttattaaaaataaatgttaaaattaaattaaaaattataatatataaaacgttaatagataa

SEQ ID NO: 702885 - DNA, 305 bp, Homo sapiens
gattgtcgctgcctgagcatatgaagatctagcgacaccgaaattggcgtttctagcttggttgagtccttctcgagcgccgcaatttgggcctcaatttctcgttttgcctcttcgacactgtcaagatctcgatgatcaacatgaattgttcgcgtgcccgcaacgtcaaagggtatctgctcacccttcttgatcagttgaacgagcggtttccgaattgcatggcgtattgctagttcatagaacacgtttggattgcgttctgtcagatcagcaatgacaagttgatcctctagagtcga

SEQ ID NO: 702886 - DNA, 255 bp, Homo sapiens
aacaagagacaaaaagaaaggaggagtataaaggaaacgttctaaaacaccaccaaagaagttacagcatatccagacgttctagaagtgcaatcagggagagacgacgacgaattagcatgattggcacaagatctccttaaaagcctcggtctcctaaaagaatattgtcccgctcaccatcccctatggagacatataaaaggagaagaagaaagataaagacaaataaagaagtagggatgtaagagaacg

SEQ ID NO: 702887 - DNA, 214 bp, Homo sapiens
  misc_feature (35)..(35): n is a, c, g, or t
ggttcgacgccccattattcagatataacacagantctaccagagcatgtatcatttcaagctcctgtcactgaggaatagaaaaaacttttaaagagcgtttgtattcaacaacttcctccagcccctaatacagtctctgtggcctgtctgtgaaacaatctctaacatcctagatatgccaggtggaggtcaacttaaagttcgtcgacgc

SEQ ID NO: 702888 - DNA, 107 bp, Homo sapiens
agtttaattaggagcggaaatgtctataagtaggctttatttcatgattgatatgtcacagaactcatggtagtaaatcacattgctattgaaacttctaaaactag

SEQ ID NO: 702889 - DNA, 555 bp, Homo sapiens
  misc_feature (151)..(151): n is a, c, g, or t
ctcacccactgggacgtgcccaacctggagacattgcaccagatgctgaaactggggaggagcaaccgtggccaccgccgccaccgccatgaaccagcgcagtctttctcctggctttccgcatttgcccttggttttcactgcttgactngctgcgcgcggcgtctccaccgcgcgctccaggcaccgcaggcacgctgcacctggtggacctggcgggatccgaacgcgcacggaaggcaggggcggccgggccccgccgcgggtgggagacccagaagggggcccggggccgcctgcgggaggccagaccataaaccgtcgctgcttggcggcctaaggaagggccgggttgaattggccggcaacttgcgggggggcccaaccgggccggcaacggttgcccttccgcgattcgcagttcacgcgattgtctgcagccggcgctgggcccaggcacacaccgcggtgctgcgtggctgcagtggttgggtgcggccccgggggggcggtgggggcaggtgtgtgcgttgcccctgtgttcgcctgacagcc

SEQ ID NO: 702890 - DNA, 714 bp, Homo sapiens
ggacctcccaagtgtgcaggataaagcccggatccacacggatgacaaccttcccaaaagcacccggagatcattcggggcagagcccatgggggagaaagccagttggggtccctggctcgcagacttggcgtgaaaggtcacatagagagcaaggaaggcctagcgtcggtaaaggggggtatgctgacaaagagcaaactgttgtccctctcggccaacgtcttcattcggtgccttcagaggcaacgactgaaggaccatcgtaccagggaagtggcctgccaacgacatctcgtggcgccatacggccaagcagtcccggcgacccgccttcgcgagtagccatgtcgagacgtggttgcggagcgccctatcttcccgattgctctcagggaagctaaaacaatccccagccactcatccagagccagcagccgagtagggactcctccatgtcctctacgaaggaaaagattgctattgtcgtactcactccgacgtactccggggtcttttgggagttttctcccctaaccaggttcaactcttttattggattctcgctcttgcatgcctcccccgtcctctctcctcccttgccagttacctggtgacagttaccagctctcctgtatggagtcaccggccccatccctcaccaaccaccttcactttcaatccgttgatacaatacgccggttttggcagaac

SEQ ID NO: 702891 - DNA, 107 bp, Homo sapiens
cgaggcaagtcaacagtgtggcagctgctgagggcgaggcaaggtaggaaggcaggagtcctaggtgcgccggctgatatccacgcacctgctacactccttcttag

SEQ ID NO: 702892 - DNA, 1004 bp, Homo sapiens
  misc_feature (249)..(249): n is a, c, g, or t
gatcaaaagggacaagcatcaggccaccgcagctaaatgcgagctcaagaaacgtctatagacggctaggctcactaatcgccaccacggggaaatccagacagtgattaatctttagcaataaaacgaaagtttcatatctaacgcttgaattgatctgacactcctcgatgggcttaggctacaagtattcagttggccagcactaccgacggtcacacggaatcaaccacaagtcgatagaaaacnggggtagacagtaggtgtatttaggaacctgatcctccctttcctccaaatacaagacgtaagaacatcagcactgatgcttggtctataggacatcacaggtttgatcaccatacaagtatgtaacttaacggaaaagtggtctgtaaagctactattctgacatgcactacagagtacgactaacgaacctcaaatttggggattctagaatagcgcactcacttaatgcctttaagcactcattagaaatacgtcagactaggttaatattcgaaaacgatacaacgtggcatcagtcgctagaaacaagcataactgaagcgcacaatgcttgtaaggcaacttcggaataggacacctgggactggatgctatcgattatctaagaattaatataagcaagggaaaaatattataaattcaaaaactaatgtccggacaagggaatttggtgtaaacccctggagagaaggaagtactctgggttaagacccaccaggcctttggagagagggcaagcagggtgggccccacgcgcaaaacacatgtggataaagagagtgaaaccaacggggttgtcaaaaaaagtcccatagtggactaattcgagaattgggcgtacagaggaagttggctcaaaagaacaggtttgggcaggaaaataaaaggaggaacgcaattataataagagaaaggcgggggcgggtgaacttcgaatgtaagaatctttgcatgtgaaaagcatataaagg

SEQ ID NO: 702893 - DNA, 262 bp, Homo sapiens
caatcaaaagggttctttattatgtagatggggtcataatccatcaaaataattttataattaactgccatactgtcttataaaggatgccttctgaaggtaaacataatatagatccccttttttaaagtggtctacttaccacttactaaacaaatattagaagttttttttttttttaaacccctatctcctatgaagtctgagaaaggaaatcatgacgagttcctgatcagataaaaaccactgcatcattaaaggg

SEQ ID NO: 702894 - DNA, 1515 bp, Homo sapiens
gccgccctattttttatatattttttattatttaaaataaagacgagggtctcactaatgttgtattggggctaggtctcaaactcctgtgggctcaagataatccgtcttgcctttagccttcccaaaggtgctgggattatgggtgtgagccaccaccacatccagtggctatgggctaccttctggtttttcttttttattttttattggaaaaggagagtttacactatcttgtgtatgcgccacagggctagtgaacgcagtgagagtgtcgcacaggtggcagacaaactcttgtgcgctatcaactgtgcaacattcttcccacctctccaccggagtctacacaggtgtgattatctctcactgtgaccactaaaccacgcacccccgaaaagttaggggtgtgggagatctacacagaggggtcgcacatagtgcccacccacacaccccactgtctgccaaaccttatatcattcacctgtagataattttaacaaaaagataaacaaccaaaagggggattatatcccacccatttggggatgggacccaagagtgtgggccaccacgacacactcacctgagacaccgcccgggcggtgcactccccactgagatgcactcgagcgcacccctccccccaacagagagggcagagaacaattctagccaggcgcatatggacgcccccaaacacaacatcaacgagggcaaggacaccccggggaacgaacagagaaacgcagaagaaacaacaggccccggaacacatccaccaacaacaacctactaagagacaccggggaatagtcacaaacacgcgcctgtgctaggcaacaaacaatgacgccggagaccccaaccacaggcacaaaacgcggggggggctcaacaccaaagacgctccaacgctgaaacgaaccacagtagccacagccaagaccagagacaaacaaggcgagggcagcgccaacaccacaacaaccgagacaaaaactaccctaggaccccagagaagggacacccgctcaacacaaaaaagatgtacccacagggctaacacaaaaacaatgccacaggggtgagaccccggccaccccagcgagaaaagctgcgagcggaaataccgacgagaccaccggccacccccgaaaagagaagacaataacacaacccacaacccaaagacactgcttccgcactcaaaaacgaaagtgcccgagcaaacacaacaacccacggggacctaccagcgacaaacatccaaccgaatacataacaaaacagacaagaaccccgacaccaacctccccaagagccacagagacaacaaaaaccaccactaaaccgccacacgaccgagactcacagacgaacacacaccgcgcggaacaagggagaacacccacacgagaaaccacacctagaccaacgaaccagacaacagacgggaacgacacacacacaacatcacaaacaaacagacaaaacacacccggaaactaa

SEQ ID NO: 702895 - DNA, 907 bp, Homo sapiens
  misc_feature (14)..(14): n is a, c, g, or t
  misc_feature (115)..(115): n is a, c, g, or t
  misc_feature (121)..(121): n is a, c, g, or t
  misc_feature (132)..(132): n is a, c, g, or t
  misc_feature (148)..(148): n is a, c, g, or t
  misc_feature (153)..(153): n is a, c, g, or t
  misc_feature (157)..(157): n is a, c, g, or t
  misc_feature (160)..(161): n is a, c, g, or t
  misc_feature (164)..(164): n is a, c, g, or t
  misc_feature (167)..(167): n is a, c, g, or t
  misc_feature (170)..(173): n is a, c, g, or t
  misc_feature (216)..(216): n is a, c, g, or t
  misc_feature (219)..(220): n is a, c, g, or t
  misc_feature (227)..(227): n is a, c, g, or t
  misc_feature (242)..(244): n is a, c, g, or t
  misc_feature (251)..(254): n is a, c, g, or t
  misc_feature (257)..(257): n is a, c, g, or t
  misc_feature (260)..(260): n is a, c, g, or t
  misc_feature (266)..(267): n is a, c, g, or t
  misc_feature (270)..(271): n is a, c, g, or t
  misc_feature (289)..(289): n is a, c, g, or t
  misc_feature (312)..(313): n is a, c, g, or t
  misc_feature (320)..(320): n is a, c, g, or t
  misc_feature (322)..(324): n is a, c, g, or t
  misc_feature (327)..(328): n is a, c, g, or t
  misc_feature (337)..(337): n is a, c, g, or t
  misc_feature (375)..(375): n is a, c, g, or t
  misc_feature (390)..(390): n is a, c, g, or t
  misc_feature (407)..(407): n is a, c, g, or t
  misc_feature (414)..(414): n is a, c, g, or t
  misc_feature (417)..(417): n is a, c, g, or t
  misc_feature (420)..(420): n is a, c, g, or t
  misc_feature (451)..(452): n is a, c, g, or t
  misc_feature (460)..(460): n is a, c, g, or t
  misc_feature (468)..(468): n is a, c, g, or t
  misc_feature (472)..(472): n is a, c, g, or t
  misc_feature (474)..(474): n is a, c, g, or t
  misc_feature (481)..(482): n is a, c, g, or t
  misc_feature (490)..(490): n is a, c, g, or t
  misc_feature (523)..(523): n is a, c, g, or t
  misc_feature (529)..(529): n is a, c, g, or t
  misc_feature (533)..(533): n is a, c, g, or t
  misc_feature (542)..(542): n is a, c, g, or t
  misc_feature (544)..(544): n is a, c, g, or t
  misc_feature (567)..(568): n is a, c, g, or t
  misc_feature (572)..(572): n is a, c, g, or t
  misc_feature (610)..(610): n is a, c, g, or t
  misc_feature (793)..(793): n is a, c, g, or t
  misc_feature (797)..(797): n is a, c, g, or t
  misc_feature (812)..(812): n is a, c, g, or t
  misc_feature (835)..(835): n is a, c, g, or t
  misc_feature (839)..(839): n is a, c, g, or t
  misc_feature (841)..(842): n is a, c, g, or t
  misc_feature (844)..(844): n is a, c, g, or t
  misc_feature (906)..(906): n is a, c, g, or t
cattcctcctcttncatcccaaatctcctcttcccaccctttctcccagagccctccaaaacaaaataccagataagcactctccacccagcagccagacgcctccttcttgacnccatcncccaccctctntcttctcgagcccagnaaatncctnaannaanagnccnnnnaaatatccctccctctctcccttttccctccatccacccatcnccnncatcttnagaccctatttcccnnnctcactnnnnctnctncccctnnctnntcctcctcttttcttttncctggggccacacaaagccagtnnacctttnannncannattttatanacttttccaccaaccccccttaccttccagttactgtngtcaataccacaatntcactcacagccctccnccatcanatncanacccagaatctctcatcctacatcatcccanncacatatnctcacatnaacnantacatcnnccaacatnacgagaggcgtgcgtggattacaggctttacanggtctncagnaactctttntnactattaagaaagcagctgtctnnaccnacagtcgctactggactcaggctgagcggcagatggantgcaactgggagctccataaggaagttggcaccactcctattgtcacctggctcctcaccgagattcctgctggagggcgtgtgggttttgaccccttcctcttgtccattggtatgctcttccttcagtccctgaatttgtccatgctaacgagggtgactcagcttccctaggatataaanaaanggaccttggtagaangaaggggcggtgggactataaanatananncnttgaaattgtagttgcagaatgttttgcaatgaggatgtattcatggattgtgtaattaaana

SEQ ID NO: 702896 - DNA, 122 bp, Homo sapiens
attactactatctcatgagtaacgaaaagataaaaggtttctaataacatgacggaggttgacgatgaagcttcttcatggtagtacaaaatgtatttatccagaaaattgacgagaaagga

SEQ ID NO: 702897 - DNA, 117 bp, Homo sapiens
  misc_feature (7)..(7): n is a, c, g, or t
  misc_feature (17)..(17): n is a, c, g, or t
  misc_feature (91)..(91): n is a, c, g, or t
ctgtggnagttgctgtnaaatatgcatgttcctttcatgtgtatttaatcatgatgtttaattttgcacaatatttgtaatgtttcttttnaaataaaagtgaaaaattttgttgta

SEQ ID NO: 702898 - DNA, 435 bp, Homo sapiens
  misc_feature (117)..(117): n is a, c, g, or t
  misc_feature (142)..(142): n is a, c, g, or t
  misc_feature (406)..(406): n is a, c, g, or t
  misc_feature (418)..(419): n is a, c, g, or t
  misc_feature (421)..(421): n is a, c, g, or t
  misc_feature (433)..(434): n is a, c, g, or t
gtagtagccgcttgctgtgaagacacatcttgacagtccaagtgattttgtgaccagtgatttgggtcctgttttccgctcttctaagaaaaagataaaaagagccgtgagttattngcccagccaataatgcatgttgttnactgtgagttagcaagccatgcctgactgtcctgatagcatatactgttttctacgttgttgttgtattggtatattatggtgtggttcttatttgggtagtttatttagtgtgttgaaggttctctgcaactgtctttatgtgtcttcctgagtgactaataacgtgaaaggttctgtaaagacatgtagagatgtcaaaactctgcggatgaatgtctataacgtgttctttagtgtagaagggaaacactaaagttctagnatctactggagnnanaaaagagaaaanna

SEQ ID NO: 702899 - DNA, 2312 bp, Homo sapiens
agaggttgtggttgtgttagtagttgtgtgttattgttgtagtattttggtttatgtagttgctgtttcttgttgtattgtctatgttgtgtgtatgtttatttgtgatgagggtctatcgataatagtcttattatttttatttgtgattgtgttataggtattgtctatttattgttgttgatgttgtgttattgtgtgcgttttgtttgagtaatttggatatgcatgtgtgatgttatgtatatgtgtgctcggttatgtagatgtagttgttttttttttgttgtatcgattatattatttgtagtgatatattcgttgttgtgtgtaggatagtcattttgaagtagaagtgatcattatatatgctattgtttagtgttattatagtaagtatgtatcgcttatgtcgtcgtttcgttgtatgtagaatcgatggagtgagagtgttgagagattattgatgtgtatgtttagttagtgtaagtagttggtgttgttattatattgcttaatacgtggtgattgatatggagtaagttgatcatgatagttttgaatattagtgaagtaaagtatgcagtatagtagagtatagagagtgtatgtatagttatgtgattatacgtattgtgattgtgatagcttttgtagaggtaatagtaggttagatgttttaaagtgaattagatgtattctgagaggtcattgttagttgttggtatatattattatgattagtgtagtagatgattagttatttgtggatagttagtttgtgatagactgtgagattgtgtagtagtgttgatagattggtatgaggtgatgagtgtattgttagagagttgtgtgttgacggaatatagagtgtgttatatggtagagtagtataaatgcgacagtattatagtgatttaattgtgtatgtagtagagagtagttgtatagatgtggtcagctgatatctggtattgtgtgctatgcatatgatgtgtaattttgactgatgtagctgctggaagattaggcacaacaacaagatgtggaggacactacagacacaagagaatagtaggcacaggcacgttgttcttcatatggtttataaggtggtgtgcctctggtgatcacgagctaaggtacgtgtgtcttgtaccacacacagacgtgggtgtgtgttcgacgctgttttcgctctgtgggttatggagaggtagatttcctgatgggtcaccctagtatgccacttggtgtcggtgtgttgactcgccgtttgttcatggaacttcgggttgtgggctttgactcttttaggggtgtccataatcctgtgtggtgtggggcaaacgaccaacgatgggacctctgtgttcgctcgtctacaccctccacagggttgtggtggccaacaggaacttcgggcacttataggtgttccgttggcggttgaatgctaccccggcgctaatggtggggccccaccaacaccggggtggggtttcccgacacgcgtgtccacatccgtttgtggactgcccgcaaggggcctggttgtctatcccaggcacgccctttagcagtggtgttccgttgtataaggccgcccttttggcgcgccagagcgccgccgcacaggtttagttgggaagagggccacaggctcaagaggcgcaccattggtgttttgcccccccaatataggaggagcctcgggggccctcgtgctccagtgcacacaggggtttgggggctcttataatgagctgttgagctaaaggttagcccgccactgcctgtccttggcccgcgaaaatagggaggatgcctatgaggctcacactgcaacggggcactgttgtggctgtctgaacctctgtagaagggaggacgcgtggttgtagcctggcttttctggagaatgtgagctgagatgctcactatcgctaggaaaagggctctgggggccacgcgaaggaaggtggggaaggggccctctccttcggacaaggtacggaattatgatcacttatgctcacgtgaacctccctaagggtgtttcgaatgtggctaatggtgttcataccgtaccacacttgggcttggtaaatgatgctgcccaagcttccccgaggaggccaccacgcaccacgctttgccgagaacgctttccatataaaatttataccaacccaggtctggcactttgtaacacacccgccttgcgaagcctcctccaactcgcgggggccgggggaccccgtgaaccgaaaggccctttgggctccccttaagcaaatgccacccca

SEQ ID NO: 702900 - DNA, 440 bp, Homo sapiens
  misc_feature (49)..(49): n is a, c, g, or t
  misc_feature (51)..(51): n is a, c, g, or t
  misc_feature (333)..(333): n is a, c, g, or t
  misc_feature (407)..(407): n is a, c, g, or t
ctgtcactcaggctggaatgcggtggtgccatcatgactccctgtatantntaactcctgggatcaagcgatcttcctgcctcagcctcctgactagctggatcacaggtgcataccgccatgcccagctaatgatttagtttttatagagatgtggggtctcactatgttgcccacactggtctggaactcctggggctcaagtgagccttccagccttgacctccccaagtgctgggattaactgttaactggttgattttatggacttttttaaacaggatttggaggcagttacattgggaacactggcatttacttttcatttataanttagggatgtttcaaaaaggctattacaacttttaggctctcttacagggacacaactggaatgtttaagggantaaatctggcaagtattatggttctaaatatgg

SEQ ID NO: 702901 - DNA, 939 bp, Homo sapiens
  misc_feature (429)..(430): n is a, c, g, or t
  misc_feature (435)..(435): n is a, c, g, or t
  misc_feature (438)..(439): n is a, c, g, or t
  misc_feature (444)..(444): n is a, c, g, or t
  misc_feature (447)..(448): n is a, c, g, or t
  misc_feature (450)..(450): n is a, c, g, or t
  misc_feature (499)..(499): n is a, c, g, or t
gatccttatatgctgtctcactctgtcgctcaggctggagtacaatggcgcagtcttggtcactgcaacctccacctcccaggtttaagcaattctcctgcctcagcctcccaagtagctgggattataggcacatgccaccacgcttggttaatttttgtattttagtagagatgggggttcaccgtgttggccaggatggtctcttgtctcctgacctcatgatctgcctgcctcgacttcccaaagtgctgggattataggcgtgagccaccgcgcctggcttgacatatcccattttttatctcttttttggaatataatattcttgccctcaactcttcctagtgtcccccattctagagaccctctgtttgcccttctagaaaataactgcagtcttctgtagggtgaggaaaagacattcannctctnggnntcctnaanngnagagaggatctaggagtctttcttatcttcctgttataacgtttgccancatttccagagggaattggttctccccttcctatgtattttcatagtgtaagtctcttcaccaccttcccatccctaccctgtgtttgccacttaggattcagctttcttggctctgctgagacatgtattgcttatctacctgctttccaaatttcaaattttgtcgctgctatcactttggttcttttttgtccttatggttaatgcttatgttttcctccctactcattcagtgaggtatgagaaagaacagaggctgtgcactcattctgctatctctgactggaagtagcccgagctgccctttatctcctctcttctcactttttatcctgccttttatctatttgtcgcctctgacttctgacttttaccctcaccttgttccaagcccagtcatctttaaataccttacttttctcatctcattgggcctct

SEQ ID NO: 702902 - DNA, 1210 bp, Homo sapiens
  misc_feature (688)..(688): n is a, c, g, or t
  misc_feature (746)..(746): n is a, c, g, or t
gcatgacgctggaggatgggcggggatggcgccccgaaccctcctcctgctacatctcgggggccttggctgtgtacccagaggctggtgcgcgcgctcgcagtccaatgacgggtaattctctgcgcaccattcctgatgttgcacgagagcgcagagctaggtgcgcatgcatgacctccggtcttctactccgccgaaggtaggcgccgtagcaggtgggcacctgaagaccggcgagctattcgctggctgagttgcgcacaggctgaatgcgcgagacgaccaacgtagggtagtggatgcccggcggcgtgccgtggactcgagtcgacggataacggctcgtcgaaggatactttcgtgcgtatctccaggcgacctagcagccggcaggagtgctgcagacggtccacaggtcgatggaaccatcgtaccaccgcatgttggcacgctggttgggagctccatgccggccgggatactgagcaatgcatgagacgcaacgccggtttcgtcgcatcgttgatcgatcagtggtctgggcggtgcggatcgttggagggatcgggagtcgtagcagcgtcttcgtccgttggagatttggggaccgtgcattgccctaccatagtggcgtagcggactttccgaatcaagcgcgcgtgatcacccgacgtagttcgtggcngcgtcttgatggccacggttgcacggacagttgtgcctggttgtctccgcatggtcancaccaaagcgcctatacggtaggagcaagcgtcgggagccactggtccgttgggcacggatggcaacggggttggacgcaaggtccttaccctttgtgtacgcgtggcaaactgttgtcggttaggggaatgtctgtggcattaccgggcggaggaattacccctttgggtagggaaaacccgtggcaaccgtgagggtacgttcctcggaaaaggaccgcatattaggggatcactctccacattccaattcgcaaacattccactttttcgcagtcggcttaggcgaccaccacaagagtccatccctccgagccctatctggagggcggttcggaccgccgtgcattaggaatgagttggggggcccgcgatattggccacttttattaacccccctttgataggaaggggagtgctagctcccatgttgcacctgttgggcgcctggagggactgggggc

SEQ ID NO: 702903 - DNA, 292 bp, Homo sapiens
  misc_feature (101)..(101): n is a, c, g, or t
  misc_feature (119)..(119): n is a, c, g, or t
ataaggagagtaatatgggtttgcctatcccaccccatggtgccaaacccatatactctcctatcctcaatacctccctctactacccattactctgttcnggatctcaaacatgcttnctttactgttcccttgcccccttaatcccagcctctcttcgctttcacttggactgaccctgacatccatcaagctcagcaaattacctaggctgtactgccccaacgctacgtttcttttaattcttcaggcttcccttatctctgctgttcctcttctggtgaggagataa

SEQ ID NO: 702904 - DNA, 1392 bp, Homo sapiens
tttattattatttaattacggttcagtctaatccttatataggtagtacactcataggccaaacttagggctaggatgcatgcattacactcaagaagggcatgcaccatcacactattaggtggccaggttagcttgcttcgctagggcctcagtggctcaggggtctaacaaggcaggagcaattctcctagaactccacacatcaatcaagacaaggctaactcacgctctcactcttacacacacagaacattatatcatagagacacaacgagggcacacgcgggcgcggtggcggcacttatcaggcgctccgcacacgcccgccacatcgtataacgaggtggtggcaattttctctctagtgatacgccgagtgggaaacgatatgagtgaggtagacgcgcacacacaaatatgtgcacataaacatataatatatacatgctacaacgtaaacatgcgcgtacaagcggcgacgacgtgtgtgtactgcgcactatcctatactcacaccacccgcggtgctacacaatatgagcgcgctatatacatataccagacacacacaccttccgaaaaaaaacaatcggcgcagcgtcgtggggtctaaaaaccagcatactacaccccgcagacaaactcgtcgagtaccacgatgcagaagcccacacattgcacacaaaaacgcagcgacactaagagcgccgacagcagaccccacaccgaaggagccggcaccgccaccgccgacgaaaacgtcattactaaatagtcacggtcaggagcacggacgcagaaaagtaggagtatcccaaatacaaaaaggatccaacaaaaatgaataaacgacagagacagaccacagggtggctaatgagagcaatccccaaggagcggtagctagggccaacaggagacggattaaacgacccatcctatataactcataagcaggaaccttaaactactataagagccagaggtagtagcacgccccccatacaaaagaaatattgatgcggagaaaaacccaccaccttataacagcggagacgacaaattcattggggctggttaaacccaccccgcaggcaaatgattacagcacccccagacacccatataaccagatagtgcgagagaaccacccaaaggcagtccaactatatatcaggagggagcgcctgttggacccccacgccaggggtacagaatgtaccccgcgagcaaaggatcgaacaaggtatggtgcactctaggcaacaacgcagaaggggagttacaaacgacgcgcaggtagaacaagactacaaaggacacgaggagagcaccaaagcggaggcacattaaacagacgaggagcaggcagacccccacacaggagaa

SEQ ID NO: 702905 - DNA, 136 bp, Homo sapiens
gattggaggaggtgcagaaggtggacagggtaaaagaaagagattttttctaaagaattgcgatgtatgatgtatggctttggggatgaccagaatccttatactgagtcagtagatatagaagagtgcacttttg

SEQ ID NO: 702906 - DNA, 1169 bp, Homo sapiens
cttgtgaacactgaacacaacaaagagtatggatatgggaaagcaacatcctatctattagtaaggcttcatggaacatcccaacacaggcacagtcaacacaagtgtagcacacagcaagttcatcggcttcagtggtctgtccagatgcacaagcaattaccaagcaacactggagaggattcctaacacaaacagcttttgggcaacatcagactctgtcagcatactgaaggaaaaggagatattcagcaagctaggaagcgggcagcacaggagacagaacgtctactcaaagagtcggagcagaatgcaaaccacccacaccggatcgaactacagaacatttttgaggaagcccagtccctcgtgagagagaaaattgtgccattattataatggaggcaactgcgtaactgatgagtttgaagaaggcatccaagatatcattctgaggctgacacatgttaacacctggaggacaaccatctccttgcggcaagcaaggtatcacactttaaccacaaatctgtgcggtgcaagagataatcgaagactgcatgaaaaagcagacttccctgccgctataccgaggatgcacataccttccgttgccacaatcagattcgtgatgtgtgcaggtgaacaaggacagaggggtcctgatagcacttctgcatgggtgtgaacaagaatgaagacctggcaggcaccagtatcccggtgagcacacggggaccgctcggatgagccgggatcgactacaatgtgtcgggcccgaacaggaaacaccaactaaccgcagcacagcagaaaaacgacacaacacaccccgaccaaacggcaacggcacaagacacaccgaacgcgagcaacggaatggaacgagaacacaagcaaccaccgaccacatagacggacacaaaaacgcaagaaaaagaggccagaagaaggccaaaaaaaagaacgagacgcaacgcgaagcaagacgcaagaagcaacaacgaaaagaaacactgagaaacgaccggaggcaacaaaccaaggagagagagcacaggaaaagaacgaacgaaaaggacgacgacgaagcacaggagcgaggaaaggacaaaaaagccgcacacagagacaagagacaacacgacagtcacgcaaaaagagaacaa

SEQ ID NO: 702907 - DNA, 161 bp, Homo sapiens
tgcgtgctttggattcattcactgacaaagaactaatcttccgtgatggtctcctgggttatggccttgatcttgggagtgcagacactttcatgctcgactttgattcttcccgtgtccttcactctctccctccaggagccgtcggtacgtggtgattt

SEQ ID NO: 702908 - DNA, 881 bp, Homo sapiens
  misc_feature (1)..(1): n is a, c, g, or t
  misc_feature (67)..(67): n is a, c, g, or t
  misc_feature (71)..(71): n is a, c, g, or t
  misc_feature (91)..(91): n is a, c, g, or t
  misc_feature (97)..(97): n is a, c, g, or t
  misc_feature (122)..(122): n is a, c, g, or t
  misc_feature (138)..(138): n is a, c, g, or t
  misc_feature (143)..(143): n is a, c, g, or t
  misc_feature (171)..(171): n is a, c, g, or t
  misc_feature (173)..(173): n is a, c, g, or t
  misc_feature (176)..(176): n is a, c, g, or t
  misc_feature (178)..(178): n is a, c, g, or t
  misc_feature (181)..(182): n is a, c, g, or t
  misc_feature (192)..(192): n is a, c, g, or t
  misc_feature (196)..(197): n is a, c, g, or t
  misc_feature (244)..(244): n is a, c, g, or t
  misc_feature (255)..(255): n is a, c, g, or t
  misc_feature (259)..(259): n is a, c, g, or t
  misc_feature (279)..(279): n is a, c, g, or t
  misc_feature (282)..(282): n is a, c, g, or t
  misc_feature (313)..(313): n is a, c, g, or t
  misc_feature (321)..(321): n is a, c, g, or t
  misc_feature (343)..(343): n is a, c, g, or t
  misc_feature (352)..(352): n is a, c, g, or t
  misc_feature (354)..(354): n is a, c, g, or t
  misc_feature (364)..(364): n is a, c, g, or t
  misc_feature (367)..(369): n is a, c, g, or t
  misc_feature (382)..(382): n is a, c, g, or t
  misc_feature (392)..(393): n is a, c, g, or t
  misc_feature (400)..(400): n is a, c, g, or t
  misc_feature (406)..(406): n is a, c, g, or t
  misc_feature (426)..(426): n is a, c, g, or t
  misc_feature (430)..(430): n is a, c, g, or t
  misc_feature (435)..(435): n is a, c, g, or t
  misc_feature (450)..(450): n is a, c, g, or t
  misc_feature (455)..(455): n is a, c, g, or t
  misc_feature (461)..(461): n is a, c, g, or t
  misc_feature (467)..(467): n is a, c, g, or t
  misc_feature (469)..(469): n is a, c, g, or t
  misc_feature (501)..(501): n is a, c, g, or t
  misc_feature (508)..(508): n is a, c, g, or t
  misc_feature (519)..(519): n is a, c, g, or t
  misc_feature (525)..(525): n is a, c, g, or t
  misc_feature (542)..(542): n is a, c, g, or t
  misc_feature (547)..(547): n is a, c, g, or t
  misc_feature (552)..(552): n is a, c, g, or t
  misc_feature (554)..(554): n is a, c, g, or t
  misc_feature (558)..(558): n is a, c, g, or t
  misc_feature (651)..(651): n is a, c, g, or t
  misc_feature (663)..(663): n is a, c, g, or t
  misc_feature (751)..(751): n is a, c, g, or t
  misc_feature (875)..(875): n is a, c, g, or t
ngcacaaaaggccattgggtggggctggatggagcatgaactggtccttaaaggatgcggatcgccnggcnggcccagcctatggagaccnggaggngagggagatgctggtgactggaganggtgagagcctgggcnggggnagtttttagtcatgggcttatggacccncnccncngcnncagcgagcgnaggnntttaagaggcaggcccaagaagggaaccccaggaagccctagaagcnccccagcgccnccancccatggacccggatccccngcnggagggggaagttgagcagtggcccaaaganacagtcgncctcctggcttggggctggggntaccagggncnccaagggggnggnnnggaaccagagggncgcagagganngggggcngggggngaggcccgccaagaggggcngagnggagngacagcggagagagngcccnggcccngggggngnggggcggcccaggagcgggccataaaggaccngagcgcnggggccagacngggagnggggggggggggaaacngcgcnggggncncccnggagcagataggtctggaccagagtggggaggccacaggtctctgagctgttatgggactcccagggcaccggcttcttttcatcctcctccngcactgtgagcntggtgatgggtggcgtgccaaggccgggcagctggaaggcatcctcctccatgattgtgggcaccaggagcccaggctgctgttagcngggtctgggacacttggccagaggggattcttcctgttggggctgcaacagagccaggcagtaccacagaggcaggtgagccacagcaggaggccgaacaggcccaggatgatgtgtactccgnccctct

SEQ ID NO: 702909 - DNA, 923 bp, Homo sapiens
ctcgtagaatatagcgtgggttgagagttgagccgccgctttgccgtggtttgcccgaaagatgtgtccgggttccaagcgcgttgataccaaacaagggttgtatctggccgccacgcgtgtgcgccacagatttccaatatgtgtggacgacacaagaaaccgcgaagggtcttccctggggtgttgttaaccaccaggaggcactgcccgctgtgtcgtgtgtgttgttcaagaaaagtgggacacccctttatggcgaaggcaccctcttgtcacaccttaggtgcaggccataagtgtatgtattaccaaccttcgcttggtgatgtacccgctcgacctcacttttgggagagcactcacacagagatattagccgtggagttacgctctgggcaggaccgccccgcgggtttctcgtggctcctcctcgcttggcggggggacacactatgtagggtgggagctcacctcacgtcgtttgtacctgaagtgctgtagaatagggtctgtggcgccccggcacttgagttgggaggagcaagacttgtgggggtggacgcactcgttactttgtcggagagcgccgacgatgtagtgaaacttgagtctgctagtgctcccctcggttgggtgttatgaagaattggccctggtgcggcgtttctgttactcctatctgctgttcctcacctggggcgatcccacgtctcagacactcttgcggcataattctattgggctcctgaaaagcacttcctgctagtttattatgaaacctagtgttactgtctgatgctgggacgacattgtatttcggaacagacaaagtttcccacaatatatgacccaccccgtgaaacctcctgtcactcctttcgcctgcaaaatttttttttgcccaaatcagcccacataac

SEQ ID NO: 702910 - DNA, 92 bp, Homo sapiens
tgtgtgccttttctcatccgcttttgttgtgtgtgactccaaagaatgccaagtgtgcgctggggcgtgaattaaactgaagcccaggcctc

SEQ ID NO: 702911 - DNA, 390 bp, Homo sapiens
  misc_feature (152)..(152): n is a, c, g, or t
caggatcccccggccgccaagcttctcatgttggctctggttaccagcaagatgttgcctcgcaatgtgtgtttaggttatcttatttgttagatggaatcggccttggtgtccctgaagtagacacaaggtgctccatggcacatctcaanaaatccacagatatttggtacctccaggtccaggcaattgtggttcacgcactgttatcccacgcactttgtggaggcctgagtgcgggcaagatctactttagcgtcaggctgtttgcagaccagccctggccaaggcttgtgaaacccctatcttctactgaagaataccatacacttagcttcgtacattgttgagtgggctatcctgtacatctccagttacctttggagatcc

SEQ ID NO: 702912 - DNA, 231 bp, Homo sapiens
ctgacgtggaggaatgtggcctaccaatggtgtcagaggtaagtacacccatcatgcctgctctatcgtgaaggatactgagactctcggggggaacagcgatccgtcacatttacagacaaagaacagagtgacctggctaacaaatggctgatgcgaggttgaatccgtctgacccgaagcctgtgacaaggcgccctaagacagaggttgacaaagttctttttttct

SEQ ID NO: 702913 - DNA, 502 bp, Homo sapiens
gatgaattacttctgggtcttgggaatataggtttctccaaactccgggtaggtgtcatgggccagtgggtgcgcgcgaggggctgggagcatagcggtggtcaaacaagccgggtataaggcaaagggtgtttgagggcaccagctctcttgaagccagtggcaggcagagcaggggcacaaggccctttccggtcaatttcctttaaaggtttcaggctttggcaaccaatacttccccccggtgaacccaaaggactttgggtttcccgggaatgctggcccgggggggtcatgggagaataacggccggccatcatctgccgggtcgggcactcgttaatgggtcgggaacatacagagggtatctggaatcggtcttcgaaacctccggactttcggtctctggattattggagaaacattcttggggcaaatggctttcggctctgggtccggtcgtggcggccggcgtccaagaaatttccacctcttagcgggg

SEQ ID NO: 702914 - DNA, 219 bp, Homo sapiens
  misc_feature (208)..(208): n is a, c, g, or t
tgactctccaaaatgcttggattaaaggtgtgtaccacaatgcctggctccttttatgttgaagggacttaaagggttcagagtcagtcctgaagatactcttaaagctctgggaccaggagacgaaatgagctggggaagactgagtgagtgagtgagtgagtgagtgagtgagtggctggctgtgtgcacacattggttgtctganaagttctgtca

SEQ ID NO: 702915 - DNA, 100 bp, Homo sapiens
agcggagccgttggcagcggcagcaacaggaagccgcggggtctcctcccgcacctgggaagcaggcttctcgctgttacccgtggtgatcgccgctcgg

SEQ ID NO: 702916 - DNA, 334 bp, Homo sapiens
tcttggtccatcaggtgggagtacactccctcaggtacggacataatcttgtgatccatcgtctctcagtccacggaaaccgacttatgaatactgactgctcaccccacaggacacaatcttggacattaacccctgaggctccacctacccaccctttcatttcacccccatgaagcctaaggtctaatacctgatgggagcacagatgtgagactcaagttaaacgaatggggcaggaacaacctgtccactgcaatgcatcagcagttacatcatatgattgttgccccacttcgattctatcttgagatctgatgtgacgaatactgcg

SEQ ID NO: 702917 - DNA, 523 bp, Homo sapiens
cagtcagcatttcaggattgttgataaccatgggcatattttccccaaataattttgccgtccttgcttctcaatggcccgaattcgcgtcacatttacttcaatagacagtacctttggtaactaacacccaaagttgtatacagtgcggatgagggattcttctttacaccaagtattgctaggcaaaaggtggctttcagttcaggatgtgttacatgggcttgcttgaaacgcaagcccattggcctgatgaatctttcatatttaggtggttttcttgtaaagccatctccaacaaagcacactttagtaaccattctcttccatgccttcttctttttctttcctgttcgaataacttttaatacttctgtttctccctgggcacgtactttaggcagagggacttcccattttcccgccttctcttttcttttctgtttaatcatattggaaagtactttagctcgagattgtccctctctgtccagcagataggcaggtactgctccctgtggtg

SEQ ID NO: 702918 - DNA, 700 bp, Homo sapiens
  misc_feature (38)..(38): n is a, c, g, or t
  misc_feature (131)..(131): n is a, c, g, or t
  misc_feature (376)..(376): n is a, c, g, or t
  misc_feature (384)..(384): n is a, c, g, or t
  misc_feature (623)..(623): n is a, c, g, or t
tagagaggctcagtaaccagcccaaggtcacctgggtnagaaatggtaaaatgaatccaaagggaaaatcttacatacacttcagatatagctgccaaccataacaataacgtaatggggcagggcacagnggcttatgcctgtaatctcagcactttgggagaccaaggcaggcggatcacttgaggtcaggagttcgagaccagcctggccaacatggtgaaaccccatctctactaaaaatacaaaaaggtagccaggcatagtggtgcacgcctgtaatcccagctaatcaggaggctgaggcaggagaatcacttgaacccgggaggtggagtttgcagtgagccaagatcacaccattgcactccagccngagcaacnagagcaaaaatattccgtctcaaaaaaaaaaaggagagagagagatagagaacatattcatgttgtttttgtaataaaaatgtaactgtaaagcattttaaaaattcatagaggataattggagaaataggattggactaaattggctgatttgcctcaactctggaaatgggaaattcaggaattcagtccccgtcccctgggtaaaagacatattgaagggctcccccatttctttnttttttccttttttattttttatttttttgtattgatcattcttgggtgtttctcgcagagggggatttggcagggt

SEQ ID NO: 702919 - DNA, 1168 bp, Homo sapiens
  misc_feature (596)..(596): n is a, c, g, or t
gtgcacctgctttacttcgctctgcacgatgtgccggtggcgggactcgtgggggaagataacggtgttgcttcttccgcacatgcgtgatacctcttatagaaatgctggtggtgtttctaggaattccaaaagttgttacaaggacagggaggatgacagaatcaggtcctgcgagttgcttaattcaccgaatatggcgtgagattctagatgaattgaagttgaaaattaggtgacctatgaactcagggaataactacttaccatactattgtagacatggacaacgatatttacgaatatatagaatgtgagacgaaagatgagggaacagttgatatttaagcatggtacttaaaaacagatgataagggaatagctaagaatactaaatagcattgtgactataacacgacgttgtttttacccacaaggcaggacagggatgacaaacatcaaagggtccagattaggagaaagataggctatatggaaaaatgggtttgcataatactttcacttctatgaaatgcatataattaatttgacgcgagggttgcacaattagcgaggttcgaagcatgcaaaagtanaggtggctcgtaaatgggttgacttcctagccttgtatccctttggaggtttacgctacgttggagaattcgcacccgtgtatgaacttccttcatactcaaaggattgaactttattaaggactgattgactgaaaggtaggggctttaggcttgggctaccggaattgataatagatttcctatttcctcaacgtatagttgcgccggttgaaaattttgggtcggccagtcttaccccaaagcggaagtaatttggctaccctataggggcaagagcaacgagagacactaggattatggctcaagtaattgtttcacatgtgtccttccagcgaactagactaatttccaaatgtggggcctatgtctctcacacactgttaacaattggtttcgccattggctcactgaatgtgtcttatgcgcagggcccaaagaattccccataaggactaagtttgaaagctctggcggccacgagggaaacccccctgccgtgtgggggcatttaactaaacgcgcaacacctgtgctgccgccatgttgtggcttggccgacaatagtgttc

SEQ ID NO: 702920 - DNA, 980 bp, Homo sapiens
gtgtgacgtagagcctgggggagagtggtatccaggtgaagggggcagaggactgtgagttctcgtcctcttgaatattagaactcggacaaacagagtggtaagcttacagtctctgatcgatccgatgtgcactgtgtgtcagcacttggagcacagtatgacactacgatcgtgcggcgcgcagggcgggggggtcggcgttgctcgccgcgtgatggctggcgcatgggctcggcagtcgagtagcgcggcgctgattcatcgtatcagccctgacatctggagatggtcagagcatgctgcttgtgttgtgcttgctgtccaatagcctccggggcggtgaggttctctgtcattttttgtattcttcgtatgctgtgatcatcacgatcagtatctgttgctatttcccggtcgagctggttgaattcccagccccagaaagtggaagttaagatatgtcggatgactttctcattggccgctatgtcctgtctcggactttccttcagtagccatcgttccttgtaggcctcttgcttggtttttatccatttatgttcttggtaggccgagtctatgccaaagcactgcactccgtagtgaccacatcttcaggattactgaccaaccgtgttctctccttcatcgtgatgacgttgatgagcaggaaggtcactattcagagtccgtcgtttgacatgcctcaatgcttaaggttagaggagtatctgttccatcatggagaacaaatctctggagtccttggctcccagaaactgattggcaaatgtccctgtgggggtagattcttacacgcgtaaaacgaattggcatctccttagcaccggccttagagttccaccgtttgacgggaaacaacggggaccgcaacggctccccgcccctcgggcttggcaaccaccggccggcccgcaactacaaaaccacggcgttgccgcccccacggtggcccg

SEQ ID NO: 702921 - DNA, 385 bp, Homo sapiens
agctcgatccctatccgtgcccggggttggtggcttacgcctgtaatcccagcattttgggattttgaggcaggcggatcacctgaagtcaggagttctagaccagcctggccaacatggttgaaaccccgtctctactaaaaatacaaaaattagccgggcgtggaggcaaatgcctgtaatcccagctactcgggaggctgaggcaggagaattgctcgaatccaggagacagaggttgcagcgagccgagattgcgccacagcactccagcctgggtgacaagagtgagactttgtctccaaaaaaaaaaaattgtactgtttaacagctgtaaaaataaaaaaacgttaaacagtaaggtgcatgtacatttcacgattct

SEQ ID NO: 702922 - DNA, 276 bp, Homo sapiens
gtctctttgaacaatgactgtagaatggctacataagtatataataaatattttattaatattttgtactgaaacccgtggccaattgacaaattttactttggggaaaggaacatattcggacatatctcaggcatagactgtatcagaggatatataaggctaccatagttctcatcttagagtgggagagaagagtctaaatgttaaatacagttctgtctcaatttatctcacagccagttcacagtattcactgtgaacccaacgcatgtg

SEQ ID NO: 702923 - DNA, 1041 bp, Homo sapiens
gtggcgcgtgtaggtcgtggtacttacgttactgtctagtgaagcgtcccgcgaggtctccgacagagcaccatgagagatgtgcatgtactcacaatcagctgatttaagaatacgactctaattcggcgcctatcacgtcctcaaatgcgcacagaaccccttctcggagtgtagcttctctatgcttaactagtgacatcgtgtgtggtaaaacagcttatgacgtcgcacgccaaactccgtcacagaagtatcttcgcccaactataatgggaatagctgtgattacaccggggtccccatgttgactaccacaccaatactgcggcaacaagtaacaaagtcccacgaagccggaattgttaccccaaattgcagcggcgtagctatgaacctctctgaattgcaggcacacatatggcatgactgttctaggtggcctgggattctgagtcgctaatagggtcatgcctgtcttggtgatatatcctgggatgctctcgcattataatggtatagttcaaaagataggcactaaatgattttctgcctctctatgtgacacgctcatatcaacatgtggcctatgaacgtgcacttaggacccgacggatccatacctactatttaaaatggttgaaatacgaggtggtacgttaactaaaaaattgttttcatcatgtccaaacacaatacataggaacaagggtgggcactccgctacatatactctccacaagggggtcccctaaagtccctaaagtaccatacctagtcttctccttagtgtttggaagagagcggggcactactcaaaagtgggggccgtaataaataaagcctagagggcactgtggcccgtaggtttgtgaccaccggctcgtaagagtgtgggccaacacatggggccccaagggacatcctttgggaaccagggaccccttttattttccggggggggggccattattgggggcgcattaccatatacgaagatttaagcggctcgagggtaaaattataggttttggagagcaa

SEQ ID NO: 702924 - DNA, 263 bp, Homo sapiens
tccctctgagccccacgccagacgtgccaccatcagcgtctcgttctcttcctctcactttccaattgctctgtatcggagagtaggagcacggcacggagggagcgagagaattgctcaacagttgcacgagctcagactagtgagcagcactagggaagagcccgccatcaatgcctcaccactccacttctggcacatggccttcatgcctttacactatccaccttccaaccctcctttgctagcttaagtaaattctg

SEQ ID NO: 702925 - DNA, 111 bp, Homo sapiens
tattacataaatgctgttaactatgtacacacatcaattatgtgcgtgatttaaaatctacttattttcatgatattcagatgtgttagtattttttttttttacttggcg

SEQ ID NO: 702926 - DNA, 107 bp, Homo sapiens
gtattgcatcacaagtcataaagggatcaaatccccgcaatattccttggacatgtctgccacatttaatttcaatgaaaacttcttgtccgtaaattttttcaact

SEQ ID NO: 702927 - DNA, 759 bp, Homo sapiens
  misc_feature (328)..(328): n is a, c, g, or t
gtgcgccccccatgggtcaatgttcacgtgtcttcgaaaatgggaaaccgtcaccccaggagtgtcagagacatcttcctgcccagggaagacccccttgttccgcaagtgtcccctatcgtccccgtcctgccctccagctgaggacgtttacgactccgggtggacccctggggcttggatgacctcttttccagccctgggagtttgatgctcccagccctctccccgagactccgagacgtggtgtgtgccctgggcctgactgtgggtctggtgggcatccattattgggacccatcttcgatcaatccagggattgcgccanagccaatgccagccagaccccgggggcctctgtttaggccacctggaggtgatggtgtttcttagagagaagatccctgagagaaacttctgctttaatggctttaccaagctggccatattaccatccttgacctccagtgaagcccgtcatcttcagccttttcccgccctatagccacccccagagtggttatgcctcctcgattgctccatactctaacatctagctggcttccccgtctattgccctttcccgtatctattttcctctatttcctatccttttattatcccccagccatagcctctgggattaaacataccggagtctgtctctgctatgggatgccccctggggcctctcttgtgtacttattgtttaaggtttcctccaactgtgatttttctggaccccataaactattttga

SEQ ID NO: 702928 - DNA, 585 bp, Homo sapiens
  misc_feature (13)..(13): n is a, c, g, or t
  misc_feature (46)..(46): n is a, c, g, or t
  misc_feature (69)..(69): n is a, c, g, or t
  misc_feature (74)..(74): n is a, c, g, or t
  misc_feature (91)..(91): n is a, c, g, or t
  misc_feature (94)..(94): n is a, c, g, or t
  misc_feature (97)..(97): n is a, c, g, or t
gcaggcccaccgngcgagcggcaaggtctccgcgcgctcccgggtntcctctccccactgtggccgcgnggganaggacagtgagcggccngantgnctgacgagattgccaaggctcaagtggcccagccggcggcgacacgatcttcggcaagatcatccgcaaagaaatccccgccaagatcatcttcgaggacgaccggtgtcttgcttttcatgacatttcccctcaagcaccaacacactttctggtgatacccaagaagcatatatcccagatttctgtagcagatgatgatgatgaaagtcttctaggacatttaatgattgttggcaagaaatgtgctgcagatctgggcctgaagcgcgggtacggatggtggtgaatgaaggtgcagacgggggacagtctgtctatcacattcacctccatgtccttgggggtcggcagatgaactggcctcctggttaaagcaggttggggataaagtgtccttctctagatagttggcaagctccagtaagataaatggcacacgtagttttgcctgtatatggagaaattgaagagatcatttaaaattc

SEQ ID NO: 702929 - DNA, 106 bp, Homo sapiens
  misc_feature (44)..(44): n is a, c, g, or t
  misc_feature (50)..(50): n is a, c, g, or t
caagacagggaaacgttatatgaaccatccataagcgtgcggcnagtcgnctgctttttagcgaacgacgagcgcagcgagctggagcgaggaagcggcgcatacc

SEQ ID NO: 702930 - DNA, 257 bp, Homo sapiens
ccgggctttggcggtaaggttgtttacatttcgtactcgagccctgcgctcttctgagagcgagcacgcgggtctgtatatgtcgcgtacgggcggtacggaggagaaaccaaggtgtatttttggtaaccccggacctgcgctggcaaaggagaagtagaaagggctttcagatattattggcccctagacctctatggattcgagaaacctccaggatttccctttgtggattcgagatcccgagatgcagaaga

SEQ ID NO: 702931 - DNA, 944 bp, Homo sapiens
gctgaaccgcgcggccgaaccctccggtgttccgacccaggctaagcttgtcgcatggcttgagcagggagcccacagcctgagcagctggtgcccagattgctatgcggataacgatgaggatgaggcactcggtcaatctacggagcgccccgggaccagaagagctagtccaggagatccaggagctggacacaggagctactgagagcctgcgaaaagtcacggcggccctgctgggccgcgtggtcctggtttccgcataccccagagcgtctcccaacgtcttggtgactggcctggccctggtgtgcacgtctcggccccgggctcccctgtgagctgggacctgagcgtggtcgagctgggtgagcttcaacgatctcagtcgtttgtgctgaatggagggtgtggccgtaccggattggactctctttccggtgttagcccgagagtatatgagtcgctggcattaagtacaagtcccagagtacttcacggaggagccgtcaacgtattgacaagacgtgactacatgtgttaggaccagcatagtggcgccctcgggccgaagacttactgaggtccgctgtagccccggtggaggacgcaccctacgggtatgcttgcccgggctgggtagcagcgtcaagtgccggttcacaagacgatcaggaaacgagcacgctgtcctggccagttgccgatcttcaccatccagaagggcctgtaattggcttgtgcccctgcagagggcgggcaggctgactgacggaccgacgaggacaggcgttttgtatcccgggagaccaggggagaaggcgcgtctcaggcagaagactccgctccgaaactccaggcacaggcacaatgaagtaccagaggtatatagcccctaagcaccctgtataagaaacacgctaaaagccgagtacaacactgat

SEQ ID NO: 702932 - DNA, 472 bp, Homo sapiens
  misc_feature (40)..(40): n is a, c, g, or t
  misc_feature (83)..(83): n is a, c, g, or t
  misc_feature (94)..(94): n is a, c, g, or t
  misc_feature (102)..(102): n is a, c, g, or t
  misc_feature (120)..(120): n is a, c, g, or t
  misc_feature (147)..(147): n is a, c, g, or t
  misc_feature (154)..(154): n is a, c, g, or t
  misc_feature (157)..(157): n is a, c, g, or t
  misc_feature (171)..(171): n is a, c, g, or t
  misc_feature (175)..(175): n is a, c, g, or t
  misc_feature (184)..(185): n is a, c, g, or t
  misc_feature (199)..(199): n is a, c, g, or t
  misc_feature (249)..(249): n is a, c, g, or t
  misc_feature (264)..(264): n is a, c, g, or t
  misc_feature (276)..(276): n is a, c, g, or t
  misc_feature (282)..(282): n is a, c, g, or t
  misc_feature (286)..(286): n is a, c, g, or t
  misc_feature (305)..(305): n is a, c, g, or t
  misc_feature (371)..(371): n is a, c, g, or t
  misc_feature (377)..(377): n is a, c, g, or t
  misc_feature (402)..(402): n is a, c, g, or t
  misc_feature (437)..(437): n is a, c, g, or t
agcttgaccacaagcctcgggcagaacagattcgcctatnactgaatcgactgaatggatggccagcaacagcctggcctggnaatggattggnagctcatnactaaaatgactcctttnatggaatccactgtaatgcagccaaantgaccanagngcaactgaataggngagnattggattnnagaggacaactctncagcagaacaattgtatgtataaagggactgtattatgatgaaataactntaatttcctggagcnaattgttgaatnaaagtntgtnaactgtttaaatgaatttnatttgaattaacaattatacagccactcagaggtcctacattcgccagaattggcatccagtggangggttnatttgaatgaaatggtttggaggcnagcgtgattgtttaaattgaatttcatcactattntgtgtattctatttatcactattctaaatgactca

SEQ ID NO: 702933 - DNA, 784 bp, Homo sapiens
  misc_feature (38)..(38): n is a, c, g, or t
  misc_feature (84)..(84): n is a, c, g, or t
  misc_feature (188)..(188): n is a, c, g, or t
ctgggttcaagccattaacccctcctacaacccccctntcacccacccatcagaatcccctatttcccccacctcaggcaactntgcccacctcagggcatgcccctgcagctggcccagttcaaggtgtgggccccgcccccgccccccattcgcttccagagcctggaccacagcagcaaacattngcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtaaggaacctgcttttctttcctcttctctcctctctcctctcctttcttcctttctttctctcggctattctttctcctaccttccttccttcctctttctttgcttgactaatatccaagcttaaaatggctcagttcccaggctaagatttgagatcatagttaaaccttcttagctcatgaatatagagtgttg

SEQ ID NO: 702934 - DNA, 608 bp, Homo sapiens
  misc_feature (130)..(130): n is a, c, g, or t
gcgatcgtgggcatcgagacgtctaacggcgccctcaccggccgctatcgggtcgtcgacgcgctcgccacgctcgccttcgactatgcgccccgcgccgcctacttccgcggcgagctcgagcagttcntgctgctcgcgcgcgaggcgcacgtcgacccgctgaaggcgacgggttcctacgccggcgcgatgggggccggccagttcatgccgagcagctaccgcagctatgcgcgcgacggcgacggcgaaggccggatcgacctgtggacgagctggccggacatcgccgagagcgtcgcccactacttcgtggcgaagggctggcgggggcacgagccgctggtggcgccggcgacgctcgtcgacccggacgtcgaggacctgccggccaaccgcctcgagccgccggatacggtcggatcgctgcgcgcccgcggcgtcgagatcgccgcaccggcggacgacgcgacccatgcgtggttcgtggcgcttcgcgatgcggacgcaccgagctaccgggtcggcttccacaacttctgggtgatcacgcgctacaaccgcagcgtcatgtacgcgctggccgcgaccgagctggcggccgc

SEQ ID NO: 702935 - DNA, 90 bp, Homo sapiens
aagagacagtcttgttctgttacccaggctggagtgcagtgcaatcctacggagaatttctagcccattagaagaacacatccatgaccc

SEQ ID NO: 702936 - DNA, 3468 bp, Homo sapiens
  misc_feature (38)..(38): n is a, c, g, or t
  misc_feature (84)..(84): n is a, c, g, or t
  misc_feature (188)..(188): n is a, c, g, or t
ctgggttcaagccattaacccctcctacaacccccctntcacccacccatcagaatcccctatttcccccacctcaggcaactntgcccacctcagggcatgcccctgcagctggcccagttcaaggtgtgggccccgcccccgccccccattcgcttccagagcctggaccacagcagcaaacattngcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttacgtgtgatactgacaggtaagcaacagtgctagcattctagattcctgcctttttttaaaaagaaattattctcattgctgtattatattggaaaagttttaaacaaccaagctaaagctatgtgaaagttgagctcaaagtaggaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggatttttttttttttttttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcccctgcgcagggccgtatgcatcctgccaagctgcgttatattctgtactgtgtacaataaagaagtttgcttttcgttta

SEQ ID NO: 702937 - DNA, 195 bp, Homo sapiens
gagacaggaatgtagtttttactcagaaatgacactgaaaagtgcatttatccacagagggacacaagcatgtcgcttagtaagggtgattcattccgatgatgccatgcaatgaggagaagtccaaccctgtctgatttcacttggactgtaggagatcattattagaatcaggaatgcctagtagtcacaaga

SEQ ID NO: 702938 - DNA, 189 bp, Homo sapiens
aaacccgtattctactaaaaatacaggaaagttagctgggcatggtggcacatgcctgtaatatcagctactcagaagactgaggcaggagaattgcttgaacccggtgaggcagaggtttgcagtgagccaatgatcacgtccagtgcattcccagccgtgtgcaacagagagtgaaactcagttctc

SEQ ID NO: 702939 - DNA, 3028 bp, Homo sapiens
gaccacagagctgcagttgaccgatgtgctgtttctgctgcagaaactattgacaggattgtgtccacctttgctttcctttcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttacgtgtgatactgacaggtaagcaacagtgctagcattctagattcctgcctttttttaaaaagaaattattctcattgctgtattatattggaaaagttttaaacaaccaagctaaagctatgtgaaagttgagctcaaagtaggaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggatttttttttttttttttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcccctgcgcagggccgtatgcatcctgccaagctgcgttatattctgtactgtgtacaataaagaagtttgcttttcgttta

SEQ ID NO: 702940 - DNA, 835 bp, Homo sapiens
tccccaccaccacaaaaaagatttaaaggggggggggggggtccccccccccccccaggggggggcgaaaaacccgcgggggggccccaccccacacccccccgcgggcggggcagacaccaaagcaggggtcagcaagcagaaggaggggagtagataactaaaacaacacgcgcgcgggggtggtaggtagaaaaaaaaagaacagggagtccacacgcgggaagaaacaaaacatttaagacacagcacccctctataaagagaaagagaggttgcccgacgcgggggagcgaaaacttacgaaaacgagacgaaaacggggggccgacgtcacagaaggccatgaccgcgcggagcaccgggtgggaggaaaggggaagcgacacactcggacaacaagatccgacggggcaacaccgaaggtcacccctacatcgagaaaagagcaacccgacgcagttgtcccctccagaaaaacgcgatgtcattgattcgatcaaccgctacgtcgaggacaccaaaggtgggagataaacgaagagaacaactctgcaccgcgggtgcagcacaacaacaactgagtaaaaaaaagagaccgcggcggcccccggactgcgtacctaagaaacaagcgcacccaacacaaggggggcggcggcgaacccacacacacacccatgtcactgatcgacagcagatttagtcgaccaaagaaggactactgcccccccagaaatgagaaagcacgccccctatccaatctgtgtcgcaaaaaaaaaatggtggccgccccagacaacggacaaccaactgactcgagacgacgggagcc

SEQ ID NO: 702941 - DNA, 3529 bp, Homo sapiens
  misc_feature (38)..(38): n is a, c, g, or t
  misc_feature (84)..(84): n is a, c, g, or t
  misc_feature (188)..(188): n is a, c, g, or t
ctgggttcaagccattaacccctcctacaacccccctntcacccacccatcagaatcccctatttcccccacctcaggcaactntgcccacctcagggcatgcccctgcagctggcccagttcaaggtgtgggccccgcccccgccccccattcgcttccagagcctggaccacagcagcaaacattngcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttacgtgtgatactgacaggtaagcaacagtgctagcattctagattcctgcctttttttaaaaagaaattattctcattgctgtattatattggaaaagttttaaacaaccaagctaaagctatgtgaaagttgagctcaaagtaggaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggatttttttttttttttttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcccctgcgcagggccgtatgcatcctgccaagctgcgttatattctgtactgtgtacaataaagaagtttgcttttcgtttaccaggcacccgaaaaaaacaaaaacaaaaagagaaaacaaaacacaaacaaagaggggggg

SEQ ID NO: 702942 - DNA, 1124 bp, Homo sapiens
  misc_feature (332)..(332): n is a, c, g, or t
  misc_feature (422)..(422): n is a, c, g, or t
  misc_feature (485)..(485): n is a, c, g, or t
  misc_feature (505)..(505): n is a, c, g, or t
  misc_feature (512)..(512): n is a, c, g, or t
  misc_feature (540)..(540): n is a, c, g, or t
  misc_feature (654)..(654): n is a, c, g, or t
  misc_feature (671)..(671): n is a, c, g, or t
  misc_feature (683)..(683): n is a, c, g, or t
  misc_feature (687)..(687): n is a, c, g, or t
  misc_feature (698)..(698): n is a, c, g, or t
  misc_feature (704)..(704): n is a, c, g, or t
ccaggctgtttccgcccggagttacgggatctacaagcttctttctcccccaccacattcagttgttctcaggtctgaattccaaatgggctcatctcctgctgttcttcgagctgtccggctgtaccaatggagcctgaagagttcggcgcagttcctggggtctccacagctgaggcaggttggtcagatcattagggttcctgctcggatggctggcgacgctgatcctggagcctgcgggccgctgctgctgggacgaaccggtgcgaatcgccgtgcgctggcctagccccggagcagcctggtcactgctgcgctgctgtccctgncgctgacgagaagggctgctgcttttcccatgtgcccacgctgcgctacctgctgccgacactcttgtgctgagctggacctggagcgcngctgccctgctgctgggctgtgcatgcttctgctggggcttgagccccatgggggcttgctcntgggccttgtgagccctgangaaaccntttggtgctggctgtgtgaatgcgcganggtgctgaactgcccttgtgccgtggatgctggaggttgctggatggccacgacccctgaccccggggcggctgcttgttgccagactgcggcactgagcgctacttcctcccngccctgggggttgcggngcgatgccgggntgcngtgggccgggntgcganggcacgctcttcctgccgccagaaacctggggccctttccctgtggattgtgcggaccattgttcgcgggaacttgcgcgcgtgagccctgcatgtacgtaatcgcggcgcttacgtctgctggcttgagaacggggtaactggttgctcgatcggctctgcgctttctcactcacctatgaacgaccctccccaagatccagtgcaccacgcctccccatcttggcgaactaacctttcgacagcaaaccccattgaaatctaactttggcactcacgttccattcccggacgcctcatcacctggccccagcggaccctcggggccctgcttcgcaaacttcccaacacgcgggcggtgaaccccgtgcctatccaagtccctcctaccctgacggggcactcccagagctgcagacg

SEQ ID NO: 702943 - DNA, 452 bp, Homo sapiens
agtcctgccaagggtgaggcggcccagagaggtttttccactgggtattcctggtacgggggcaggagccaggcctcccaattggttctggctcttgggagatggtggctttcaaaatgccaaataatgtactttatcctcaagaggaaagggccttggctgggcatggtggctcaagcctataatccatacttgggtaatttttgcatttttagtggagagggagtttcaccatgttggccaggttggtcttgaactcctaacatggtgaaactccgtctctactaaaaatacaaaaaaaaattagccaggcgtggtggcgcacgcctgtagtcccagctactccggaggctgaggcaggagaatggcgtgaacccggaaggtggagcttacagtgagccgaaatcgcgccactgcactccagcctggacgacagagcaagactctgtctc

SEQ ID NO: 702944 - DNA, 3233 bp, Homo sapiens
  misc_feature (38)..(38): n is a, c, g, or t
  misc_feature (84)..(84): n is a, c, g, or t
  misc_feature (188)..(188): n is a, c, g, or t
ctgggttcaagccattaacccctcctacaacccccctntcacccacccatcagaatcccctatttcccccacctcaggcaactntgcccacctcagggcatgcccctgcagctggcccagttcaaggtgtgggccccgcccccgccccccattcgcttccagagcctggaccacagcagcaaacattngcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttacgtgtgatactgacaggtaagcaacagtgctagcattctagattcctgcctttttttaaaaagaaattattctcattgctgtattatattggaaaagttttaaacaaccaagctaaagctatgtgaaagttgagctcaaagtaggaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggatttttttttttttttttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcccctgcgcagggccgtatgcatcctgccaagctgcgttatattctgtactgtgtacaataaagaagtttgcttttcgttta

SEQ ID NO: 702945 - DNA, 148 bp, Homo sapiens
tggaccgctcgtctacacagacttccgcgggacgtgacggcgagatgtatgcgagctcttctacaggaagctgacgggactgccacgagaccaatcccccggtttgttcatgcgttacccttggcgtcattttcatttcacattatga

SEQ ID NO: 702946 - DNA, 204 bp, Homo sapiens
gaggaccaagaaacctgtggttatatcgtgccagcaaggcagtggtttataaacatcacgggatattaagactgcagccaaggaattgttaaaaaaggtgaaatttattcctggatcaagactgaatggcatggttgaaatgatggacaagcggccatattggtgtatatcaaggcaaaaagtttaggggcgttccaatcctgt

SEQ ID NO: 702947 - DNA, 392 bp, Homo sapiens
gtttgggtattctcagcatatataggcaatgtaagtatagtgtccacttgtaggcataggatagatctagaactgatttctcacatgacatgacttttttccatctgactttctgtcacttcctcagacttctaggaagggtttggtggtctgcttcatttaggaagaagtcggcatcctgatttttccgcaaatatttcagtcccagaacttgtcttagatggttctatggctacatcttcttcctatattgttggcatttatatctaatctgatatttcctctcctccgattaggcacatgagttcaccactcggacttttaacttttctcttcatttctggcacctgagtattacctttccttcctttgagctcagctgtggatttaaa

SEQ ID NO: 702948 - DNA, 280 bp, Homo sapiens
cgtcgactttttttttttgattcttcatttctgaaagctcctatgttatataaaacttatattaagtaaatttgtatgcttttaccttcttaatgtgtcttttgttttaagggccttagccatgaacctagtgatgggtgaggaaaagctgtttctttttgcccatcctacaaactattcctgagagaaatttaaaaggacttaactaagtagagatacatgccttattcatgtgttggaagactcaatatttctaacatgtcagttgtccagtcgacgc

SEQ ID NO: 702949 - DNA, 292 bp, Homo sapiens
ccaaggggtagagatttatgtattttatttcacagattctctggtcacaggtttttgcccagggaaattctgagaaattcggaatatcttaccagataaaacatgaaaagtttgccggtagtggaaaaaagaagcgtcatctctttttagttttaatttattggttaaactgatggcagcaatccatgaggtgtgtcaaagagtgtacatatgtatgtgtgtatattgaatgctaaacatattactgaaagacacattttaataaagatttctgtcataattcaaaaaaaaa

SEQ ID NO: 702950 - DNA, 211 bp, Homo sapiens
  misc_feature (118)..(118): n is a, c, g, or t
  misc_feature (120)..(120): n is a, c, g, or t
ccgtaacttttggacaaccacaaggaggttgttattaccaacattaaccttattattattagggtttttcacaccgaatttaagaagcccttggggagccaaggttttttcctcagtnantggcgtgtagatgagctgtccattcttctctgtgtagaagcgcacagacttgatggggctaccaccacgatcatgcacagagtgacaggca

SEQ ID NO: 702951 - DNA, 653 bp, Homo sapiens
  misc_feature (181)..(181): n is a, c, g, or t
  misc_feature (186)..(186): n is a, c, g, or t
ggggttttgtgccaccgaacccttgaactcccccgggaaaccgttttttgttggtgcggctccccaacggtgtaccccctttttaatttgccgggaaattgcgggcctgtggggcccaagacccatggcccttttcccctggggggttccctcccggtttccccccgcgcggggtttgganccccngcccttcccggctctgggggttttccggggatcccgttttgggggggggaggccgggcctccccttaagccaattgggccggcccgccaaaaggggaaaagggtttttttttttttttgggcgcctttaaccagaaacccccccgcccttaaaagccctctttgggaaaggggggtccaaaaaaattggtttttaagaaccccgggccttggggggggggcccaggcctttggggggattcctttaaaggccaaatttggccgggggggtccccttttggttttttggccccccccccccatttttggcccccataaattttttaaagggggtaaaaaatttgggtttttggtttggacccaagggggttctggtttttggttccccctggaggggccaaggggttggcttcccccggccttttggttttaaaaaaaaggggggggggtggggtcccctttacccga

SEQ ID NO: 702952 - DNA, 295 bp, Homo sapiens
actactactattaaattgcgcggcgggcgtcgaccccacctgccgctgccattcctgagcaagctctgtactggtggtgccccgatcccgcagctcaaactttacaagacagtcctggtgcttactggaccttcttgggcgccctgaagccaccttcacaacaattgaaccactctccttgaagttgttgatgatccgataaatggttgatttaggtgcaatcttactggcagcaatatccttgcctgtgaagccctttttgtgcaaagcaatgatgactgcacgtctttccttg

SEQ ID NO: 702953 - DNA, 710 bp, Homo sapiens
  misc_feature (395)..(395): n is a, c, g, or t
tttacaccgggggaaacatttttttcacggaacaaaggtgatttaccaaagttttgatacttaaactcccagccctctgtgttcatataagggaaacccaatgtgttgccatgtagctttgtttatgtaattactagcaagatgctttaatactcagctgggaattcagcatctctgactgcacgcgcaatatttatcctctgattgtggcccttaacgtcagttccaatcgggcgcgtgttcttggttttatcatggctccaatatgcatctcctcagtcaagtgatagttctagaaatctcatttctctctggcattcagtattaagaacactgttttctagcgtttaagcatagggtcatttcatgtgtcttttgcagttaatggcaataangtgtctatatgtgcgtctggcaagtggtgctgtcttgaatattagcacagtttgtggcctcataaggtgtctctcttaagttcaagattcagggtcccgtctggcctaagtggataaaacctgttcttactaacaatgcacaaataaacttgtagcttgtgctcacgcaccggtatcctctgtatactcgaaactctagtcttagcttctgcttaacccagacccatggttgtagttagcatagatcgtgccttgagacactgcattgtacggtgggagcatcactctgtcgtgtgagtctctctttaatcttga

SEQ ID NO: 702954 - DNA, 462 bp, Homo sapiens
  misc_feature (70)..(70): n is a, c, g, or t
  misc_feature (394)..(394): n is a, c, g, or t
  misc_feature (412)..(412): n is a, c, g, or t
  misc_feature (429)..(429): n is a, c, g, or t
aaaccaaaaataaaatttgaagaccctccccaaccatctaaatgggcttcctcctctaggccagggcgtnctaaatttaacctgaaagactggttcaggccatgatgggaagtgggggtccaacacgcctctttacaccctccagcattaacatcaaatggaccttcagtctgataagaagaaacacttaccatctatcctctctgaagcctgctacctgggaggcttcatctgcatgataaaatttggtctctgcaacctcttattcataacccagacattgcttactattgataataactctttcaaccaatcaggaaaaatcttaaatctacctgttaccggggaggcctgcacttcgagttcttaggagttttgactcttctggcaacantgtgggatttggattccnattgtaggtaatcctcngtttttaggcttaaagggattccctttaggttt

SEQ ID NO: 702955 - DNA, 120 bp, Homo sapiens
  misc_feature (19)..(19): n is a, c, g, or t
tgcagcccctaatcagagncaatttacacacatttctgctcatttacacagtcatatttaaagcagggaaattgactcttggtgggagcttaagctcataaaggagtgaaactccgactc

SEQ ID NO: 702956 - DNA, 172 bp, Homo sapiens
ggaccagtcgtgacagcccctgtccaggtactaacctgcccatagccatccaagccactagtagctctctcccaagtagtggaggcccgcaagccaaagagcatgtctacagtgggcagaggtgctaggagcctttttcttaggcactgagtaagggtgcatggctgcttca

SEQ ID NO: 702957 - DNA, 440 bp, Homo sapiens
  misc_feature (33)..(33): n is a, c, g, or t
  misc_feature (36)..(36): n is a, c, g, or t
aggtgactctacaggatccctcataggttcgcnggngctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgcaaaatgaaaaaaaa

SEQ ID NO: 702958 - DNA, 343 bp, Homo sapiens
aaaacgaaaaggatacattactttttgaaaaagttcactggaggccaaatgcactggctcatgcctgtaatcccagcactttgagagtgctagacaagcaaatcacttgagatcagcagttcgactccagcctgggcgacagatcaagactccgtctcaaaaaaaaaaaaccaaaaaaaaaacccaaaacaacaacaacaacaacaacaaaaaccccaaaacaaaacaaacataatagctgtttggagggcagccagcatacttgtgaaaacatgtccaggatgactactttttagagaatggcaattcaaacccacatggagacagcatatcggggtaccga

SEQ ID NO: 702959 - DNA, 859 bp, Homo sapiens
gaaatgggtagcaatgtttgaatgcaaaagcatttaagaacgtcacatggaaaaatccacattaaatatataaatatggcaaatgtattttgtcattatgaataacaaattctattttcaatctttttttagtcttatttacttgacttcttttctttcataaaatctgagtcattaaacccctttaaaaaaaattctgatacagatgcgttgaggacttttctacttggtggtggactatatccaaaaaggtaaagttttttaaatgcacactatacattattcatttattttataatacacgaattcattgaaatttaaagatttaatttcaacatgtatagaaacgtttaaaactagaggtttcacattgtcatcttttcttactgaggctttcataaccactgcaaaggtccttattgagccactaaaacaataaaagagagaaaatatcctttcttcacacacaaattggaaaagaaaagagggatctttcagtagaataatatttgcagctacttttaaaggttactgaaaggtgagggcatcatcttaagaaaagagatttgtaggcatatttggaaaaaccagattagtacctgattgtggactcttaaacgaatctaggtatcgaataagcgatctccttacccaaaaaaatggaactgtcccttttaaagagacaattaggggttaaaacacgtcgtgaacatgagctcccttttaggttgggacacgtcactttggggcaacccccggttcgcaaaattcggtgcccaaacacatttcttgggacagaagctttccaaggagggttctccccaacatttaacctattccacaccgggattagacacac

SEQ ID NO: 702960 - DNA, 115 bp, Homo sapiens
  misc_feature (82)..(82): n is a, c, g, or t
gtctcacgactggtctacagtctgggaacatccaacgcttggtgaattctgcttatgagagcgacatcgaatggatcaaaanagcgacgtcgctatgaactgcttgtgcctgcca

SEQ ID NO: 702961 - DNA, 429 bp, Homo sapiens
tccccctttgggtcgcgttgctgttcgtggtatgggaccgacagttgcggtgggtgtcctcaaagcagtggacaagaaggcttctggagctggcaaggtccccaagtttgcccagaaagctcagaaggctaaatgaattttttccctaatacctgccccccccctcttaatcagtggtggaagaacggtttcagaactgtttgtttcaattggccatttaagttttgttgtaaaagactggttaatgataacaatgcctcgtaaaaccttccgaaggaaaggggaatgttttgtgggcccctttggttttcttttttgcgtgtggccgttttaagtttttagtttttaaaatccgtactttttaatggaaacaacttggccaaaaatttgtccccgaattttggggccccttaaaaaagttggggggga

SEQ ID NO: 702962 - DNA, 194 bp, Homo sapiens
tttgaattaatgttttattcactagtattcttaaggtagtaaaggaggatgtaagttgtatttcttcagagaagttatgagtctctaatgctgtgctgacagaagttctttttgcgagtacacactttgttcaagtattgacaaagaggctaagggccactttttttttcacggacaagaaactgaacagaatt

SEQ ID NO: 702963 - DNA, 279 bp, Homo sapiens
  misc_feature (63)..(63): n is a, c, g, or t
  misc_feature (81)..(81): n is a, c, g, or t
  misc_feature (87)..(87): n is a, c, g, or t
  misc_feature (152)..(152): n is a, c, g, or t
  misc_feature (241)..(241): n is a, c, g, or t
caaagagttcctgactggcaattggttgagagagttaaactttacctgaaaagatgaagtcancttaagttaaagtaaggnaggctnggcttaagtcatgtagatgaagcctccaggtagcaggcttcagagagaacagatgatgaattttnctttttaggccttaaaaggtgtcagactctccagaaaagacctaataagagaaggagattctctacagaatgcagtttcccccacaagngacagctttgtagggccatttcaaaatacgtcaaataa

SEQ ID NO: 702964 - DNA, 150 bp, Homo sapiens
ggatcctttaaatcgattttaaattgttgcctagtcttgccaaggttattatgtgcatctgttatttttccaatacatgtaaacaaagcatcatgctgcaactgtttacatgtattggaaaaataacagatgcacatgataaccttggca

SEQ ID NO: 702965 - DNA, 165 bp, Homo sapiens
gatcggtattgcaccccagtcgactatgcatgaacgtgctggctatagaagatattcactcacatgtaggtcaccgtcgctgacaggcagagcgcaatcattcgtccgtatccatgaagcgcacagcctagcctaatgtgaactcttctacataagtccatacta

SEQ ID NO: 702966 - DNA, 90 bp, Homo sapiens
gtggacacaggcacatattactgtgcacacagaacggtttcctacggtccctataaagcagactggtatttcgatctctggggccgtggc

SEQ ID NO: 702967 - DNA, 1094 bp, Homo sapiens
ggctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaaccctggaaagggcggcgggtgatagtacagatgcgagacgcaactgcagagcattttcgaacgacggtggtgacaaccggaccgttcatcagcacgaggcttttcctggcatgtctcatggcatactcctgacgatgacgaaaaccaaacctaattagctgtatgggggccttcagacagtacgggggtggtctttctcaggagtctcatgaaccagtgtatccagtggattgtcacagtccattcattggtcagcatagtcctaaaagaacttctttctttatgactgcttagccaatggccagttgagacttggtctctttccacccaggctgggtttggtgattccctgataaaactctgacactcttgacgtgcggacagaacacagcttggggccttaacatttaacttggtccggaacacatcaaactcatccaaacaaccctgctgccacagacatagacaccacacaggaacgcttcgaaagccactccgtggcgcaacgggcgaccaaaacaaaagtcacacgcgcgcaccgcgcggccccacagaaccccgtgaaagacaacggagagacccccgactaaacgccccgggggaacacacacggcgttgaaccacaccacaaagagacagcggggcaccgggggcaaaccaaggaagacagagggcgagtaattaaacaccgcagagggcagacccaaagaaagagacaaaaccagacacacaagcacacgacagccacaccaagagccacgtgagcaacaggcagacgcatcaagagcgcgaggcgcctcgaccaagtgtcgctcagagctgcagagaagaggagtcagagccaggaggggcgaagaacgcacatcaaaaaaaagagagaaagaaagatagcgcagcgacgcacaaccagacaggcgagcagagccgaccgaggagcccggacccc

SEQ ID NO: 702968 - DNA, 154 bp, Homo sapiens
atctaccactatggactgtcgcggcagttaatatcatcggagatattgatgatcataggtctcgctcgacagtgagcgtagcttagtacgtagcagcgaagtatttgccatgaatgggtaaccacattgtgaccgtgacttggccgatgtagaa

SEQ ID NO: 702969 - DNA, 439 bp, Homo sapiens
accattcacggctcttctgtcccagatggcacttgaggcggtgacgtggtacgagggcattgccttgagcatggacccctacctcatcatcaccattccgatcgtttggttgctttacgaagtgaagctgaacaaggtctggacacggaactcaccattggcaaattactccttcgaatccggcacgatttcgggagaaggcaacattacgttctggcagagcctcatgccgcactacactcacagatactgtccatgtacatgtcgctgagtcatcgacaacctctacgcccttggctccgatgtaggtctgcttcatggcgttcgagcattttcacactgtgaaaaatcagctggtctatgatctgatggcatccaccatagtcagatatcgatcccgctcacatgtaggctgacatctcccgtgacgctcctctgc

SEQ ID NO: 702970 - DNA, 228 bp, Homo sapiens
  misc_feature (73)..(74): n is a, c, g, or t
  misc_feature (83)..(83): n is a, c, g, or t
  misc_feature (108)..(108): n is a, c, g, or t
  misc_feature (211)..(211): n is a, c, g, or t
  misc_feature (227)..(227): n is a, c, g, or t
agcaagtccgctggatggagaaatggttatcatcaccaccaatgatgctgtgtccaggtaccgaggtcaggannactgcctcnccccaatagagcaccaagcgcttcntcaagtggtacaacgcctggaacgagaagcgcagggtctacgaagaatagggtgaaaaacctcagaagggaaaactccaaaccagttgggagacttgtgcaanggactttgcagattana

SEQ ID NO: 702971 - DNA, 250 bp, Homo sapiens
  misc_feature (73)..(74): n is a, c, g, or t
  misc_feature (83)..(83): n is a, c, g, or t
  misc_feature (108)..(108): n is a, c, g, or t
  misc_feature (233)..(233): n is a, c, g, or t
  misc_feature (249)..(249): n is a, c, g, or t
agcaagtccgctggatggagaaatggttatcatcaccaccaatgatgctgtgtccaggtaccgaggtcaggannactgcctcnccccaatagagcaccaagcgcttcntcaagtggtacaacgcctggaacgagaagcgcagggtctacgaagaagcgcagggtctacgaagaagaatagggtgaaaaacctcagaagggaaaactccaaaccagttgggagacttgtgcaanggactttgcagattana

SEQ ID NO: 702972 - DNA, 195 bp, Homo sapiens
cctacacaacaaaagtgactatgtactatcatctcagatgctcagggacattgcttacctgaccgtatggactcagctgtagttgactgaagtgctaaacaggacggattgacgtagaggtgatatgtccatgtcaccggaatagagacgtcctctgcgtcagcatccacacaaagggctgcgtggtcgacatca

SEQ ID NO: 702973 - DNA, 106 bp, Homo sapiens
ccccccccccccccccccttctttttggtggggggggggggggggggtttggggggccgggttttccccggggttttttccccctttttttttcccccttttttta

SEQ ID NO: 702974 - DNA, 869 bp, Homo sapiens
gacttagtagagtggggacgtccggcttcgtagcgggagtgttcgttgtgccagcgacgtaatagaagcagaattaaatatgggtgatgttgacgaaaggcgagaagattttacttatgaagtgttcccagtgccacaccgttgaatggggaggcagagtcacggatagactgggtccagatctccatggctctctttgtgcgggaaggacaggtcagtgccccctggtatactcttacacagtccgcccatgtagagaacaaaggcatcattctggggagaggctacactgtatggagtattcggagaatcccaaggaagtacatccctggtacacaagacaagtgatcttcgtcggtcatcttaacgaacggaatggcaaagaaagggcagacttaataggctgtatctgcaaagacatacgctactagatgagtaataattgggccactgcgcttagttattacaataagagaagtgtctcagtgaggtcccttatgtgtaccatcctttaatagatctcatacaccagaatggcgggatcactgaatgactgacatgacatattcttgttgggcatgtcctgatgtggaaactaaggactggcttgtggttctaatgacctatgttcaggttgtgaccttgtaactaagtcacctcccaacttccggttctttggcatcactgtttaccactttttatggattttgttagaccttcggagtaatgtcccactttgcccacacgcccgggggtgccgtcttaaactcctgggatggtgttattaggaatttacgggcgcgggaatttgaccggggatgggcgggcctaaccccgaaacccgggtgggccgcctcgcccgcacggga

SEQ ID NO: 702975 - DNA, 149 bp, Homo sapiens
ctagtcagatttctctgcggctctcagtgatagcatctctagatgatggatggacttttctgctattgcttcagaagaaatggtaaaagtggtcccctctttccacacataacctaaacattcagagttaagacagcgagaatgaggat

SEQ ID NO: 702976 - DNA, 255 bp, Homo sapiens
cagcagtattaacctttagcaataacgaaggttaactaagctatactaacccagggttggtcaagttcgtgccagccaccgcggtcacacgttatccagtcaatagagccggcgtaaagagtgtttagatcacccctcccaataaagctaaactcactgggttgtaaaaactccagttgacacaaatagatacgaagtggctttaacatatctgacacaattgctagccccaactgggattggatcccccctatg

SEQ ID NO: 702977 - DNA, 790 bp, Homo sapiens
gatccgatacactttccaaggcccagccccatggccgtgtcagaccaggaatgtattgagacactccgaggagatgaacggatcctgttccattctgatacatcagaattgactgaaggagctccaagaactcgctctccaaggcgccaaggagagggcacaatcagcagaagaaacacagcggttgtgaaagatgaactctcagaggttcttgagaaccagagcatccaggccgatgctgaaagaggcggtggaagagccatcatccaaggatgtttatggagaaaagagaggattccaaggaggcagagaaaagtgtgtgaagccacagacgtgagccaggccccgagagtgcctcccggaggcccatgcaggagatccaaggctgaggggcacacaaatcaggccacatggggcggaagaggagcgcaggaggagagacggccagacaagacaaactcgatcactcccaaggacacgcaatactgcaagaccataacatagagaggggacccaacaagtgacgacatggagacccaagctgaaagaaccatactacaaaagaggacatgagatggcacagagcacgcaggcacaggggggccacacaggatgggaaacaagaaagggataggcggaaaacacagacaagaaaggtaaagaaggcagaacggaacaagaaggcaaaagagcaaaggcaaaagtgagaagaacaaacacaagagagaagagcgagagaaagaacagaacagacaaagcagaaagacgacagcagacaaaaccaggaaga

SEQ ID NO: 702978 - DNA, 333 bp, Homo sapiens
gtaagctctgccaaaccaaagccccctctctagtatgcgcggttagggttaaaaaagggaattggctcacttcccgtgaagggtcagtccagacagcttgctgcttttaatgaccaaaatgccctgtggaagcaacctgggcattttaggaaccagtccctggaaaaggcatgttcccaaaaaggtttttggaggggcaaacccccccagtaaaacataatgtttcatgaaaaaaactgattttttatgccatgaaatgaaaattttaaggccttgttataattactaatggccgctgctgcaggccattaataaagttgcttttttaggcta

SEQ ID NO: 702979 - DNA, 146 bp, Homo sapiens
ttatgttgatgatgaagaagcggcagagttattgacatatccatggacatcccgttctccttcatcatcaacaaggaaaattaaactgagttgaacattgtgaacctgcagatcacggaagaccctggcgagtgaaattacggcca

SEQ ID NO: 702980 - DNA, 261 bp, Homo sapiens
  misc_feature (247)..(247): n is a, c, g, or t
agcgtgagcataccagaaagccatgagatctatgagcaggtggggcaacacaagggataatccttggttgaaatacagggcaaaggattacttcttcaaagcggccctcgtgccatcttccatagtagcacgagttgaatgccaagctggctctgtgagaacatatgacggaaatgtttccgagcatttacgtgattcaaggagaatgtaaattaatggaaaaggactccatagaagctcatgaagnaacagaacagtgaa

SEQ ID NO: 702981 - DNA, 966 bp, Homo sapiens
gcagtaatacctgacacacacgctgcggaaagtggctccaaatgtgtatgaagacattatgaatgggcaatcaccaacctgctcatgtactttaagagcatgatccggtctcgccgggaatccggcacgccatgtggcagttacttaccagtgagtccaccaatcacagctgggatgtgctatgtctggcggctctctggaccaagccgctcttgttcttgggaaggatatgatgcatagaaactgttccttgaacctgtattccatactctcgtaacgacaacaatgaagggtttgatccatatcctccgatttagttcctaggggagctcttggttatcgagatttaattgtaggaacttattaatagccagctaccagcaaactccccttgtgaataacgcaacatcccaatttgcagtagaatatgtcgctcttcctctaggtctgagagtccttatgacctggctttccgatgcggcctggatcagcgtggcgaaaacggggtcagtcttgccagttaggggactctctatgaaagcacaaggccatcaagccttgtgtacagaacttcatgttctgccctggatttaagctgaaggttagactagatgatctcctggtttacctgcactctgatgactcatcactggcaaggagcgtttctccacgacaggtgctaagatttctagacctgtgtactgataggcaggaatgcggggaccgcgtacaggatatgctcgcggactcaagtccggcgagccattgcatcaagtccacatcgtggaactgtatgcgggcagtatctaaagaggttttgatacggtgtgccgggctacgggatgaccttgactgttgccagcttcctcattctttcatggcccactcttcaatcctggagactttgcccattgaacagccccgggaatacaactcttaaccgggattatgtctgcaacgaagaac

SEQ ID NO: 702982 - DNA, 2641 bp, Homo sapiens
gggaattagtaccaagaaaacactagtataattaagaaatgttcagtttgcacaaagaactatccagataacccaccagcatgttagtgagatggaaatacagacccacaacagtaacccaatacttgcaggggttgggggcacggttatagattcaaccattgacctaagtctgcgtagcactgggaagaggctttggtttagaagccaaggaataatgagtatattggggagaacagattatttacaagatgaactctttaatgtttgtgagaatctcaagtttcagagtttctcttttgagaaagaaaaaggggtaataaggtagaaattcacaccaatgaacaagaggattgctgcaaagtaactgaggagatgtctcgccattgggaccctaatgccatttttggtcaaacattgttttgagcaagaatctggcaaacaaaataatcaacaacaaatgtgaatatagtttcatttacttttaatttttaaatctgtggaaaagtttagttgtgcttcttgttaaaaagaacatttctatccctgaaaatgctatcttgggcttatgattattgttaaactccaagtataaactgaaaaaaaaaacatatccctaactctgttatgaaaaatggagacttctgatattaaatgctttcttctacttggaagaggccagagaaaacagggaagagaaagacattattgagtttgaccatgtattatgctgaataaacaataagcactttagagtccctccctcaaactctcatacatttcatatttcttttccatttattttcagttttgttttagaagaaaagttcatcagagaattttgttctgataatttcaagtggccatcttaggtcagtggaaaccgtaagtccattggactttacctcatcctttctttgtagacatctgggagaggaagaggagcttgtaatgatagcacggggatggtgctgtaaacaggagtgaaagtgtttgtggaagtccagagaagtgactcaacaggctacctagctgcagaacaaggagtagagcccacatatccagatggtgttttgagaggtgcgtagacagtgaaattcaattaaagagaggattttctcctcagcctcatgactcagaacagctccctaaatacctctctcatctaattggacccatccatagtccattctcaaacatgtgacattttcccctaagtagatgtgattatctcttaggcatttgttgaaaaataattcttaggtccatggtgcttgcacttgtgtcttttctataaaatgtttggtcttacaggtttcatgtcatttaagctgcacttctcagcaagttaaaagattagcagttaatctttattcatttggcctttgtgaatttgtatttaaattatttttttcaggattggcaaattattcttgtttctcctttacaaaaaaataaatgcgatattttgttcaatgaccccaaaaccaacttgaaacttaggtggtcatattggcttgcaaagcaatgtccctaattgtaccagtcagtcacacaagtggattcaaggacctgctttgccagattgacctgtcaccaagctcacaacacatatcctccacaaacaacatgtgttatgtgaagaaaaatggtaattataaataagaacaggatataacacacctttcatccactttaaatctccacagtttcattttatgtcattctctgagcaaatctctttgggatgtgagctagcgtgttcttctcccatttggaatataaggctgggaatagaacaatgcttaacaaatcagtgaagctcgacagtaatatgtaattttaattcagttaggaaagagttgtattgcattgcaacaagttgacaaatcatagccatctctgtagggtgtcaggaattatctcctggtcaactttaatgataactaggggtccctaagtgggctaacatgtgctgcattggagagaagccaagggctgagagtacagtgccaaccacgtaatgaattgcttgcagaaattccaaagaggactcagccacttatggatttccacacagcatcttttcccagctccacattaagacacaggatcttaaaagtaattttttaaaagctggctgtgtatttatttatatgaaagtgttataaatatcaaagcttacaaatacattaatacatatcacctttgttgaagctagcaaaatggctcaaaattgagactgtagagaaaaatccatgaaataatcacgatagtcataccacaaaagatagcatagctaggtgggcctacctggtcgtatcaacacactttcagatagatgcttcaaaaaaaaagggaaagcttgttactggaatcttatgtgcattacagtttaatttcttcttgtgacaaatggtgctcaaagaaggatcaatccggttgcatccttcaatttcccttttagaatgacttttggttttcattacagtaggctatgttagcctttattttggtggttctcaaatacctggtgacttgaaagagtattatgctggtggcctttcataaaggttactgaactttaatcaggggtgagatgaatgaatgtgaataggcctatatactattttttttaatt

SEQ ID NO: 702983 - DNA, 271 bp, Homo sapiens
atcaggacgactgttggggggtcggacgactgcgggggtccacgagatgtgggggtcggagatgtgcgggtctggagatgtgcagagcagacgcaaagatgagctgatcggaagatgcccaggtccggggatccaccgcgtccggagacagcgcgggtccggagaatgcgtgggttccttgcagactatcgctccgcccgggaacatctccggacctgcacatctcccatccacacattcttcagatttgcacatctttggagccgcacat

SEQ ID NO: 702984 - DNA, 372 bp, Homo sapiens
cagtaatcaccctaatttattatggggaaatgactaaaaatgagggcaaggccaggcgtgtggcttatgcctattatcccagcactttgggaggccgaggcaggcggatcacctgagggagttcaagacctgcctggccaacatggtaaaaccccgtctctactaaaaatacaaaaattagctgggtgtggtggtgcatgcctgtaatcccagctaatcaggaggctgaggcaggagaatcacttgaatccaggaggcggaggttgcgtgagcggagatcacactactgcattccagcctgggtgacagagtgagactctgtctcaaaagaaagaacaaacaaacaaaaactatatacatttagggttgatg

SEQ ID NO: 702985 - DNA, 224 bp, Homo sapiens
atggagcggcatctggctatgaaatatcggtctaatgaaggacatacggtttagagttgtagtgagtttgacggaaattcttagataaatttatttcatgaccttactaaactgtgtaatcattagattgaaaaggcattagttgattaattgttaggctttacttctgggcaaccaaaaaaggaaaccagccaaggtcgaagcaatgagctcactgggtaggt

SEQ ID NO: 702986 - DNA, 190 bp, Homo sapiens
cgacctggccgattttaacaaagtacaaactacagctgatatcactatggtgacctttcttacattttaatatttctcttactgggactctccctgattgacatcacctcatgcgatgacctccctcattctgtgctgcctcagcacttatcttttgagtttgtactgtggtccatgtacttactaatat

SEQ ID NO: 702987 - DNA, 213 bp, Homo sapiens
ccggttctcactcctccatcctggtcgtatatcttgtctctttgtgatacctcagcactttgggaagttggggcaggcagactgttcacggtcaggagttaaagaccagcctgggcaatatggcaaaatcccatctctacaaagagtacaaaaattaggcaggtgtgatggttcatgcctgtagtcccagctactcaggaggctgaagtggga

SEQ ID NO: 702988 - DNA, 1301 bp, Homo sapiens
  misc_feature (289)..(289): n is a, c, g, or t
  misc_feature (602)..(602): n is a, c, g, or t
  misc_feature (1063)..(1063): n is a, c, g, or t
ggagagaactagtctcgagttttttatttttttttgtggcaaagatccccttttttttttctttctcctcccaacattaccttaattaagacccaagggaggaggcaggggggttcgagggtgaaaggatgcagcgtggtaggaacccgcaatgaggggttaggctccccgtgtgtggcaaaagagggttcaaaggcacaagaggagtggacagggggctcaggcgtggacacgtgaggaaccaaggtgtgggggcacactatctctcccctctataacaacttcctcnccctgtgtgtgtgaatagcctcttgtggtgcacgggcaaaagcctcaagagccctgtgaagtgggtgtgaatctctcggcagagagctgctagacacattgtgcggttatcgcctcgtaaagctcgtggctattgtgcgctcgaggagttcgcggggtgtgcgtgcatggagagccttgtttagggtgtcgtgcgccttgtggcgtgttcccgtggctccgtgtggacaccacttgcctcctgtgtggagagtttcaccgcgaattggggagaggagcggtttcatccccactcttgttcacagcgtgtgtcncttgtgggggccagctcttcgggggggaaataccaaacgctttaattgtcacgacgggggggcacaccaaatagacgagaaagggaaaggtttctcccagaattttctaccaagtgtggcttcaatctccagaatgtgtgcgggcgaacagaacgtgtaaaagacccacggtattggtgtacaagcccaaaaaaggtctcgtgttagggatccctccacagcgcttttggggtccccccttccccagcacagaaaaaatgtgagacagcgggggaagtaacactatataaaatatatttgggcgtagaccccaaggtacaataaaacatgtgggcgccacaattacttttacaagagcactttggagagggccctgcttaaattggggtcgaaacagggtcgaaaactttgggtcttcccaaaaaccccgggttggcacatctgaaatttcgggccaaggnggaacccccggaatattaccccgggggttagaattggccccagttaatattgaggacaacactataagaaggttggcccgatggtcctgtggtgggatccccaggctaaggaatgaactaaaattcatcggagatggtatataaaacatttctgcggaggaaactcgcgattaattgtgtggccccttttgcccgaatagtaccagacacggagagtctggacaacatggtgcaacaa

SEQ ID NO: 702989 - DNA, 495 bp, Homo sapiens
cagctataacatgctctgggcgtcgtttacactaacagactattaccatgcacgtgggagtcgtagttacagctaaaacagttataaccatgcacagaggggcactttacagtaaacagtatataaccatgcacagggcgagtcgtgttccaccaatagccattcctgttgactctatcgttggcactgtgaatggcacttctcctgcataactgaggattcctacgcagactaagcacactgtgttgctaaactctctacagagtgtggcagcatcaacccgggaaatggcacattcgaaccaggatcgccctgacaatgggcttgcctttttgtatgtgttttccccaccccctgatctagctgtatcttgtggatgttgctgtgacagtggtaaccagtaaataagattgcatttaaggggtaagcaggtgtataaaaacaaaacaaaacaaataaaaactaaatataaactaaagaggcaaacactgggat

SEQ ID NO: 702990 - DNA, 226 bp, Homo sapiens
agaggatcccccggtagagcggtcgatactctgggtatggcaaagactttcggtaaggtacaacaccaaaagcacaatctatgaaagagctggttgataagccggacttcattacattaaaaacttctgtcctgcacaaggtaatgtcaaaagaatgaaaacaacccacagaccaggagaaaatatttgcaaaagacacatcagataaaggagaccgatcttaccg

SEQ ID NO: 702991 - DNA, 440 bp, Homo sapiens
ggtcggaggtaaaagtctgacggtgaatcttcgagcagaagtaagtcattagagtatacttggtaagcaagagacaaagctttagtgtaatagttcttaggagtatactgttcctaattttattctgaaactcaattttaccccagaccataattaccatattaacttggtaacgcacagttgtatgcaattccgcaaagcagtagtataccatcaggctctattcacccagagcataggaaaaccaggatgggtcacacccattaagaaacaaatctatcccacgctatttgccaatgtgtagtttcagtctaaattctgacaataaaatgtctggatctctatctatatatctcatcttgattttcaaaagtagccaacgggagttcttcagagcttcgcgtcgcctggctgaagctgaagattaggtaacttcatag

SEQ ID NO: 702992 - DNA, 332 bp, Homo sapiens
tactctggcgcgccgtgtcttgtccagcgtggtgtgattctgtgctggctgctgctactgacgctctggctgccctggatcaatcaccggatcacctacgctcctgttgccgaagaattggcacagcaattaccgaacaagagctattgcatcgaagcgtatatcggcccttcgcaacgcagctcttttgcctatttcggaaaaatacagttcgccaccttctccgatcacgagtgtggatatatgctcttgcagagcagccggcgacacatacttaaaaccgaattgcctgcaccttatcaacccgaacaatgggatcaggtctggtctgg

SEQ ID NO: 702993 - DNA, 1947 bp, Homo sapiens
  misc_feature (1143)..(1143): n is a, c, g, or t
agcatgttgctctgttgttttttctgtcgggtttttttgttgtatcgctccccgctatcagatgtttgtgcgttgttgcttcgctaagtgtcttcatcgtgcgtaccgatgagttgtgcgtcagcttcactacggggggggagttctctctcctcgacgggtcgcctctcacatctcggggggggtttgtggacctcacgctgtctctcctctccgaagagttgtttggggtcagtctatagagcatcgcggggcgtacgtcgtgggtgttccttgtggcgtcgatgcgatcttagttctcatgatcggttcggcggagtcgccatccagggcggtcatagcactatgatgtggaacccccgcggtagtatgggtatttttcgatgatcgcggccctgattctccggtctctttttctccgggctgtgcccacaccgtgttgttaggagagtccctctcccccagaggggtatttctctgtgccccacgagagtctgctggtgtgcgcaacacaggagtgttgtctcctggcggctctttttgctggtgtttctacctggggcggacgcctctcctcgtgtgtctctatccttgcagttaggaccacgtggtccgctctcctgagagatggttttagtcctacgaatgagccacccccccttcgggggggttgtgtctctcggagcactaactctactagggggcgacacgcggccaaccgacgtcatattgtagggtggtcatatatccttcctggtgtggggctgttgatccgtctctctttataggcgggggtgactctggatgatgtccctgcccccccactccgcctgccctgcggttgtgcgcagcgcatcttggtgggggtcattgtctcctctgctttggtgctacagagctatcaaccgtcgccgctctatgttggccgccgtttctcccctaaggtgtgatcctctgtgtcaccgcctgtgtctgtaggtgggttagggttgtacccttggggaggattttttgcgtcattatggggggggctcgttacccactatacaaaagtgctggcggaactacgtcgccccccacgcaggggggatagtagcctcttgcctccagcagaatgttatctatggacgaccaataggggtncttccccgcgagctttgtgaggcagcgcccgcaattaggggccgacatcgctccccatcgtggggaccaccacgatcgttgtgccctcagcgagatataggttatgaggtcatcaggaagagaagtggtgcctcgcgaagacgtgaacatcgccaccatgtggggagaccacccctcgcgttgaagttgttatgccacaagagattatctccgccccctccaggtggccgtatacactaatattgtgtcagcacacgtcgcgtcgagagctttatcctggcgtcgtctagttgcgcggaagagtattctcagaaacgcgatatatattggcgcgagatatatatctcgggaaagagtgagcactcataggctacacactcgctccgctcaataatttctttcagagatctctccacgcagagaggaaatatactgcccgcgacactcactggtggcacacgcacaccgcgcgcaatggggcccgtgttacaggtccctcgcgcacacgctcatcgcgcaccctataaatgagtgtctgaagtaaggaatgtggcctcgaggcctcatatgaggcccacggacggagaacccccactcatcactggcacataggttcaacactcacgcgggaagagagtatctccccacttttataactcgcgttgagatatatatcgaggtggtcaccgtaagacccggcgccctttgtggttttttccggactcaccctatgcaaccacgtcccacaccgggtttattgtgaatacagaattgacccggatagagccatacatgtgaaggaac

SEQ ID NO: 702994 - DNA, 305 bp, Homo sapiens
  misc_feature (36)..(36): n is a, c, g, or t
  misc_feature (44)..(45): n is a, c, g, or t
  misc_feature (207)..(208): n is a, c, g, or t
  misc_feature (217)..(217): n is a, c, g, or t
actctagaggattccggcagctatccggttcaatgncactcggnntggagagagaaggccatgctgagtcttcctagacctgctccctgactcttcagatgccacccctctgctgggctgatggcttgggtttcctgtctgcacagactgaacttctgttagaaacaccaggtcccaggagcagactctggtccctgggtgcccagnnctccaggcngtgaagttctgaccaccaccggcgcccaggctgggcggcacttacactgcatgtaccaggcccgccagatggcattattgaaccggat

SEQ ID NO: 702995 - DNA, 210 bp, Homo sapiens
tctggatggctctcccattcttctcttccttccgcctccgccgatgccccagctgctcttgtcactgtctctgatgggtatttgcctggctttgttgcttctctatcttgtatttagctgcatgtgatcctttagctggttggttcagaaaaaaaaaatgtgctttaggtgccctgtaatcctgaggcatagggggaatcgatccttccc

SEQ ID NO: 702996 - DNA, 973 bp, Homo sapiens
gtgatccatttgttcatttttgcgttggctgcctggctgtggggtattactcaagacatctttgttcagtttaatttcctggagagtttcaccaatgtttttgtagtagtttcatagtttgatgtcttagatttgtctctaatccgtttgatttaattttttttagatggcaagagatagaggtctagttttattcctctgaatatggatattcagttttgtaacacaattgttgaagagactcccccattatattgaggcaggaaaatagagtctggaggcagaaaacataagaccacttcacacttcacctttccatagggcatgggccataaataactttgtaactttatttcatcctctccatttacatagggcatactagggggtatttaaactcccaaaaattctgtaatggggcctttgagcccctacgcttgggctttttcccacactgtggagtgtattttcattttcaataaatcacttcatgccttccttgcaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggaaaaaaaactgccgcgaggagggggcacaactattaggctagaaccgcagttgattggatgagcaggggcgcgccccacaatgaggaggctgtattaataaaacgaagagaggaggggaggccatggttaaaaaaacatgctgtggggtggaaaaacaacagtcgtggtcggtgcgtgtatattgttagagagagcaaaccccccaatttattggtgggggtagggaacataatagggaggcaacaaacccagcaataaatatatgccctcgtgggggagatcaaaaaaaatgggggtatatggtggtggataaaagacaagtgtatatgtcggggagaagaatgtgtgcaagatgttatataaaaaaattc

SEQ ID NO: 702997 - DNA, 139 bp, Homo sapiens
gtacgcctcgacagttctgtgtgaaatgactttgcagtatcccttgatatcagaaaaaattcagctcaccagataaatgcatttccacactgagaacattcagggtctatttgctccgtaaattacagatggattcagg

SEQ ID NO: 702998 - DNA, 295 bp, Homo sapiens
gtccgaccagtcttgagagaggtcactgatatatcttcaattggactattttgacctctatcttattcattttccaagtgtctgtaaagccaggtgaggaagtgatcccaataatgatgaaaatggaatcaatactatttgacacagtgtatctttgtgccacatgggcaggccatggataattgtaaagattcaagattgtgcaagtccatcggggtgttcaacttcaaccacaggctgttggagatgattctcaacaagccagggctcaagtactagcctgtttgctacctgt

SEQ ID NO: 702999 - DNA, 412 bp, Homo sapiens
ccgagctcgttacccgtcctacatagtgtttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctggggtctccctattttatgagacacaacaatattgaacttaagccagttaataaccctgcagtggccggtaagtgttcaagtgaaaggaaaagtagcatgtctctcactttaaatcataagcaagaaatgaagctagtgaggaaggcg

SEQ ID NO: 703000 - DNA, 467 bp, Homo sapiens
agacggcggcaggagaagcacgatgtatgctggctcaaaccctgtggccatcgtctcgggggcgcgggccatcataggttccttcactggagccttagctgctgttcctgtccaggacctgggctccactggcatcaaagaaggctcgaagagggccactgcggctccggaagatgtgtctgacgccatctttggacatgtcttggcagcaggctgtggtcaggatcctgttagacacgccagtgagggttgcaagaattccctactctgttccagcatggagctgccagatgatctgtgaggtaggcctagctgcaggaggcatggcaaatatgaacctggcctcctactgggcttacttgaggacaggagcaaagatcggtgagatcccactgactgccggtatactctgagatggtattacagatgcatttaacaactgtcatattgggtattacagctgataa

SEQ ID NO: 703001 - DNA, 111 bp, Homo sapiens
acgggatgacaatgcgcgggatgtctcgacttgtccatgtcctatcctgaagcagtagagcagccgtagttcttgagcagtgtgtcatggtttgtgcgacgtttgtgtcaa

SEQ ID NO: 703002 - DNA, 539 bp, Homo sapiens
  misc_feature (415)..(415): n is a, c, g, or t
  misc_feature (445)..(445): n is a, c, g, or t
  misc_feature (453)..(453): n is a, c, g, or t
  misc_feature (482)..(482): n is a, c, g, or t
  misc_feature (497)..(497): n is a, c, g, or t
  misc_feature (514)..(514): n is a, c, g, or t
  misc_feature (529)..(529): n is a, c, g, or t
caaaagtcctgagataatagacatgagccactgtgcctggccagtaatcaccagcttaagaagttatagctgtgtggaaagacacaggactcataggtcaaatggtaacatcctacatacacagaaggaaacacacacacaaacaaagcctttgttcacaagcaaagaatttctttctcattcttgcctcatcccctgtatccagagatcttatttttttcctcttatcaccttcattttacactggtctgatgttttttgttttgtttgtgtgtgtgtgagtgaatttttcagagctcagctttctagagggtggagcagtgtctgtcacacgggcttctcatagctcaaactgtcatccctgctttagctcatctcttcctaattgttctctaccctccaccccccacaactntgccttttttttttttttcctgctggccangattccanggagaaggaaacgaacctttcatttggtnccctcagatggggcnttctaggaactttggcnccggtttaactcaanggcgtttggg

SEQ ID NO: 703003 - DNA, 1008 bp, Homo sapiens
ggtctgtcgcggctgctgaaaggccccggcgtcgcctctctgtgccgcggcctggacgtggaggccaagacacgacttacgtgcgcgacaagtcccacatgtgaatgtgggtaccagtcggccatgtggtaccacgggaagaccacgctgactgccagccatcacgaatattctagctgagcggaggtggggctaagttcaagaagtacgcaggggatctgaacaatgccccggaggagcgaggctcggggtatcggcatcaatgcgggtcatgtggagtatagagagctggcgtgccacggcacgtagctggcccggacaatggactgggccgggtcatgcagattatgtgaggaatatgatcagaggcactgcacccgcgtcggacgtgatgcatcctggtgtgatatgcagacctaggacggccccatggcccagacccgagagcacttgattaactcgggcacgatcgcgattgggtgtggagcatagtgtgtgggtgtaatagtgacactacacgttgaccgctgtctccacggcactgcgagtgagtgggtggaatggctgtgaacttggtagcatcctgggaagcgttgctcatcgaaggtgggggtattaacggggagggagacccgcagttgagtgcctacgctcttgactctgctggcgtactcttgctgggtctccgaaccgtgaacttatcgactagtaagggcggggtcaagaagcgtatagggatgctgggacggttacattccagcggccgcccggggacaggctgcagcatttcctgggcctgcggatggcgggtactccggcccatgggcgggcgcggtggtgaagcccctaaagcctcgggtgaaggaaggcgagcggtgggccctgggaatcagaactccgcagggggaaagggtgccatttcgccgactgcaggcacgcgggaaaccagggcaggcacgtaggagcaaggggctagcatgcaggggtcaccccgggacgccccggcag

SEQ ID NO: 703004 - DNA, 181 bp, Homo sapiens
ggatgtacactagcagtagccacacggggaacaggcactggcagaacatgccgcatctcctatgatgaggtccaggtgcagccactggcactacgccctggcagcagaggacaccatcttaccttaaagggctagtactatcatgaagctggtacataggactccgttgaacgagactttc

SEQ ID NO: 703005 - DNA, 214 bp, Homo sapiens
accaaaggagcagaaggacagcagggattacgtctactaccttgccggtgaaaacataccaggctcaaggaatacgagaaggccttcaagtacgtccgcaagttgatgcagacagagccccaaaacaaccaggccaaggaattggagcggctcattgacaaggccatgacgaaagatggcctcgtgcgcataggcaatcgggacatttgccatc

SEQ ID NO: 703006 - DNA, 2065 bp, Homo sapiens
gacgtgcgtagtgaactaagggcatcatgaggtagagatgggggctcgcatgacccgcgccttcaggaacttcaacgtggagaagcgagcggagcaggagatcagcaagaggaagccctccatggcacccaagcacccttccacccgcagtctcctgcaggagcacctgagtcagtatccagaaatcgaggaagaagtttctagaaaagataacaagctgctgtccttactaagagatgtatatgtcaattccaaagatccggtgccttccttgccggtaaaagccattgaaccacagcaacaaccaaaggagttcagattgccaataggagatcaatttgacaagaatatcaaggacattcccaaaggcaagatcactgttgtagaagcactgacccttctcaataaccataaactctctccagagacatggactgctgagaaaatcgcccaggaataccatttagaactggaggatgtaaattcccttctcaaatatttcgttacttttgaagtcaaaatcgttcctcctgaagacaggaaagcaatacaatcaaagtgaagaaaatcacaaaacgatttcctatgtgcgctcccaagctctgagtccttgtttttcgtgtatataaattatacaagttactgtgattgagggccataacttggatagccctttgacctcttcaggattgttcatataattttttttttaatttatgtgtagttcctggctatatgtcagtgttgatcatgtgactgattcaatattaagtttcactttccaatttaggatggtttgttctttggaggagacactgaaagaagagccctccctcctgactcctataagactggcattgtgctagggacagataatcagcaatgagacatagtgactatatttcccaagtgaagaaagagagaaaactgagtgcaaaggaagaaaaatatatattagtactcaacaaaataaaaatccgtgagggtttttaatgttttaaatatgaaatcactttttagaattattattagtatctgtgacctactagctgtctcttgacaaatagaaataggtaacttgaaaagttttctgagaggcaatacttaagactatttgaacaaaataacttcctttaatttagaaatgagagaaatattaatagctaaaaataagaggatccgatttgataaccaaatatttatacctgttttcattctaggagaaaaagtagccagtagaagtataaaatccctgaagggacctagaaagttactgattcattcacttaaactcgagtctgacacattccagtattagaatctcaaatgaggtaatatgagtttggttcattctggcatgctgtaccggtgggttcttggccacattgtttgacctctctgaaagtgaatttctgtaaaagtagaactctgcttatgtaaattccaggacaacagtgaagttaaatggcaaaaggccaggcgagcacagagtcttatagttaaaatgggtgtctacagaacttatgatggagttgtctatagtttatgatgcaaggagaccagaatttaggttctcagaatcctactcgtatttttatttattctgccaaatgaaacccatttcaagaggacagaatggagttgggggaactgggcttgtccaaattctttcaagggaacaaacagacatatttgcctcgagattcccctggaaatgatgtggaagatgagaggaattcagcatggtgatggagggaggcagagtaacagcgaagaggggagatgaatggaaagtttgtaaggtttttcagatctaggtctagtgaacaaactatacctacttatttgtggttcggtacagaagtttaagagaacatgctaagtctaatcattgcaaattatattggacaatatagtcaaaaccatcttccttcaattcaaaataagtatgtgaatcagtagtactgactcgtgtttcctaggtggtgttagcagatataaatacggtttcatacggtatcacaataaaatccttccattttactcattagcccaaaaaaaaaaa

SEQ ID NO: 703007 - DNA, 2328 bp, Homo sapiens
gacgtgcgtagtgaactaagggcatcatgaggtagagatgggggctcgcatgacccgcgccttcaggaacttcaacgtggagaagcgagcggagcaggagatcagcaagaggaagccctccatggcacccaagcacccttccacccgcagtctcctgcaggagcacctgagtcgtgagtgcggccccttccaggcctccggtgacattgaggtcgtccccgcgcgggctccggtggtggcagcggcaaggaatcccagagcccaaggcagcccgtgctctctttcggggtctgcacagaatgcgctcagagtctcgccctaatgtaagtccctagggtgtccagatgattgtttttttttaattgtcatacatgtttacgattttagggatatttttttctttaaaaaaaaattacggccttttttctttccctagagtatccagaaatcgaggaagaagtttctagaaaagataacaagctgctgtccttactaagagatgtatatgtcaattccaaagatccggtgccttccttgccggtaaaagccattgaaccacagcaacaaccaaaggagttcagattgccaataggagatcaatttgacaagaatatcaaggacattcccaaaggcaagatcactgttgtagaagcactgacccttctcaataaccataaactctctccagagacatggactgctgagaaaatcgcccaggaataccatttagaactggaggatgtaaattcccttctcaaatatttcgttacttttgaagtcaaaatcgttcctcctgaagacaggaaagcaatacaatcaaagtgaagaaaatcacaaaacgatttcctatgtgcgctcccaagctctgagtccttgtttttcgtgtatataaattatacaagttactgtgattgagggccataacttggatagccctttgacctcttcaggattgttcatataattttttttttaatttatgtgtagttcctggctatatgtcagtgttgatcatgtgactgattcaatattaagtttcactttccaatttaggatggtttgttctttggaggagacactgaaagaagagccctccctcctgactcctataagactggcattgtgctagggacagataatcagcaatgagacatagtgactatatttcccaagtgaagaaagagagaaaactgagtgcaaaggaagaaaaatatatattagtactcaacaaaataaaaatccgtgagggtttttaatgttttaaatatgaaatcactttttagaattattattagtatctgtgacctactagctgtctcttgacaaatagaaataggtaacttgaaaagttttctgagaggcaatacttaagactatttgaacaaaataacttcctttaatttagaaatgagagaaatattaatagctaaaaataagaggatccgatttgataaccaaatatttatacctgttttcattctaggagaaaaagtagccagtagaagtataaaatccctgaagggacctagaaagttactgattcattcacttaaactcgagtctgacacattccagtattagaatctcaaatgaggtaatatgagtttggttcattctggcatgctgtaccggtgggttcttggccacattgtttgacctctctgaaagtgaatttctgtaaaagtagaactctgcttatgtaaattccaggacaacagtgaagttaaatggcaaaaggccaggcgagcacagagtcttatagttaaaatgggtgtctacagaacttatgatggagttgtctatagtttatgatgcaaggagaccagaatttaggttctcagaatcctactcgtatttttatttattctgccaaatgaaacccatttcaagaggacagaatggagttgggggaactgggcttgtccaaattctttcaagggaacaaacagacatatttgcctcgagattcccctggaaatgatgtggaagatgagaggaattcagcatggtgatggagggaggcagagtaacagcgaagaggggagatgaatggaaagtttgtaaggtttttcagatctaggtctagtgaacaaactatacctacttatttgtggttcggtacagaagtttaagagaacatgctaagtctaatcattgcaaattatattggacaatatagtcaaaaccatcttccttcaattcaaaataagtatgtgaatcagtagtactgactcgtgtttcctaggtggtgttagcagatataaatacggtttcatacggtatcacaataaaatccttccattttactcattagcccaaaaaaaaaaa

SEQ ID NO: 703008 - DNA, 568 bp, Homo sapiens
aaatccaatccaaggtttcccaaatcggcccgcacatccaacgtattaataactagcggaaataatagtacagtgccagagtgggctctcttgaggggggggggtacgggacggggtttatgggtgctcgggatagtaataagacctgtggcgtatttttcgggtttctggtgatatatatggaggctcagactactgtaggtttatttgcctttctgcgaagggtggttatctgcatgactaaattataggtccctataatcgtagtaagaaagtacggagttaaataaatggggtggagctgagcggggaagggataggtttgttggggaatcggcgcgcgagcgcgagcggcgttttaaagggggaggggtcgcttcccggagttgacgtatctttgggctggtggtgcgtcgaaaggttttgtactcttaataccggaaaaaccgtatatgggcgcacgtacgcgcgcgcgtacgaagggcgtagaatctggttttaactataatcgtggctgctctattgccctaaatggatcgaatggcctataggtatctcgatttcttcg

SEQ ID NO: 703009 - DNA, 107 bp, Homo sapiens
tagtgctggagtgtgatatctccatgttccagtatcccaagtagctgggattacaggcatgcacgtgccacacctcagctaatctttgtatttttagtagctgacag

SEQ ID NO: 703010 - DNA, 270 bp, Homo sapiens
gtggtcatgccacaagtgcagcaataaaaataataataatgaaaaatttataaataaaaaggaaagttggggagttccctgtggctcagtgggttaaggacctggccaaaagaaaagggggaaatgtgggaagagatccctggctccccttgattctctgagcaggaagggctgccaggtacaccagtctgggtgccctcccacaggggcagaatcaaacacctggacgtggtgaccctgctgagaaggatccaacgaccacgacgacga

SEQ ID NO: 703011 - DNA, 957 bp, Homo sapiens
acgggctggtgataggctgagaaggtcaacgggctgacacgtgtgctctaagcgtgcacggatcagatcctggtgagggaggtcgtacaacatttgctgattgggtgttcgtgatcattgatcgggaggaggtgcaggtagatttctagtcatggagcgagctgatagagggctgggggcgacggcgcaattcaacgaccggcaccgagacaggatgtcacaccgcctgagcacacgagcacttggcaggacccgatgactgaatatgcttattcatgacctgtcttctctcagggggaggacagggagcgtgccggactcaatgttacctaggcggcagctggttcgatacgagcggtggaagaccgaacgagctcagttgaggggcaagggtccggactggcatgctgatccgcacagctctattcattccctgagtcacttagtaacacgggccacgggattgactgtctgtcaatgataactaattggcacgaagggtatttattatgacatttgtgctaatggactattcactcgaccctcgtttgttggattcggaaatgtacgaaaaggtctggtcgaatgagatggatcggggtctgcaggtactatttggatgttgccatcagtgttgggatggcgcggaaactggggtgctgtggtttcaatcctccggtggatccgatggtaaggttactcgagtatgatgtcatggccactcaagtccgaatgcctggagattctcgtgatcctaatcgggcgcatcctagagttttccactggggtgctcatgttgagctgctgataacttctggtgggtgaaacatggggacaacgaacgctggtgagccatttggcttggtggctttcatgggttcgaccaaggagggcttccaaaaaatgtgggggaaacaacacggtggtttgtgcggggggtacctatttaaaattgga

SEQ ID NO: 703012 - DNA, 667 bp, Homo sapiens
agcgggcttttgcaaggctgatgttcggtggtcatcagtgctcttgacccagtgtccagcgagccttatccctggtgttgcagctgttgtagtaccgccgccgtcgacagacgtcgccgacatgctctgcggggtcatggtgtgcatatacgactcttacccggatataccgggctcagaggctcgtatctggtctgactagatcctgggagctgtgcaggtcttatgcattggaacttaatttgacagattcagaaaatgccaattgccgtttatgcaaaatggcagatgacatttcacagtacgctatgaaactacaaataaaacttataaaagctgtaaccatttcagaccatggcactgtgacatatcactggaagcaatatgttggggatgatcagaatggtcccaaaataagcagtgacagttcggacctggcttattcctggattgcgaatttataccaaggcagcatctacttattcaattgacagcgtctacaatattttcctacaaaacctggtgataacacaaacatttacctgatgctgaagataaaggaatacttactagttgactgaaccttttgggccatcagaattccatttgaatgaccttttatagaatgcaaaaaggtataatccaacttttgggaaacagaactgaa

SEQ ID NO: 703013 - DNA, 367 bp, Homo sapiens
tgagcctggtcgacccaaccatagcggccttgtgaccttccaaccttcatcgacttcatgtccgggagaccaccgaacggacacggctgaccaggcatccttcttcaaggtctacaggacaaaacttcatcacactgaggactgcggaagactgcccccgacagccgagtactgcatcgcgatgggccataccagggcctgacgccgtgccggtgcctgactacaagtcttctccagccttgtatgcgagacgacctgtgagcccagagacctgaccaacacccccgacggctccaggagggctgggcagccccacagtcccattcctccactctgtatctatgcaaacactctctgcagtcctccg

SEQ ID NO: 703014 - DNA, 111 bp, Homo sapiens
atagaaggtcgacgtgtattcaccactgcgtgggcatgcctccctgtacaagttccagtcgacacagtgagcacctgtgctgacctccaaatatctgttaagctggagcct

SEQ ID NO: 703015 - DNA, 139 bp, Homo sapiens
ggtttttgggccccctttccccccccccccgggcgggggggggggttcccccccaaaatttttttggggggtccccccccccccccggggggggggggggccccccccccccccttttttggttttttttttcccccca

SEQ ID NO: 703016 - DNA, 804 bp, Homo sapiens
  misc_feature (518)..(518): n is a, c, g, or t
  misc_feature (604)..(604): n is a, c, g, or t
ggcagttactgagaactcataagaggaagctgaaatcccatcttcggatccgacagttcaagcggcctgaacacactccttgcagaaaagcccgagagaaatggagcgccatgtgattacttacaggaaccatgtatgcagatagtctgtctggtcacatttgtcgagatggtgttcatgcagtgattctccagttcctgcatcctgactgtgcaggaatctgcccagaatgtacgctgactggtaaagacccagtatctttcctcgccagggcggagggtgtcccaagtacattcaggtgcaatggggcttggcgtgcttcgtctagaagcatatccgcacgtccagcttaatcggtccatcgaaggactgattgtttggatcgctagaagacgaacaggtgatctctcagaggtcgcagttgcgtgctgtagacttaaagttcatattaatctagggtgcgaccagcttatatgggggggtttccaaaagggggttagaaatctaaacgggcgtgncgcgaatggctagtagctcgttatatttagtcatcggagagtgcttaaatgttttaaccatgctgtctagtacgagaatgaattgnatgatcgtcttggataggggaaaattaacgtggatcccagaagttgcatggctctgattgagataaaagctctgccttttcccttagcgataccactgtggacatgcgtcagggatgatctgcgcttgaaatgtctcctgccgatctagcagtacatcggcagtctagtctgtgcttggaatggtccgctagaatgtccg

SEQ ID NO: 703017 - DNA, 400 bp, Homo sapiens
gtaaactaggatctgtcgcacaggagtccaggcagagcaccgattatcaaaataactaccccgatccatgcacaaatgacaacatgatatcacaacacgaacatgcacacacaacatacaaccggcataaaagaacgaagataaaaagagaacaagaacaaacagacccacaacgaccgagaagcacatgaacaaaagcggacaaaaataaagagaagacagaacatacacatacattaggaaagaccaaacctagagacgagatccacaacaagacacattgacagccaaaaaagagcacaaaaagcataacagaaaaaacaaaaggaagataaaaagagcaaagaagaaagaaaacaaacagggagtaaccacaaaaaacaacacaaaagacaaggac

SEQ ID NO: 703018 - DNA, 1137 bp, Homo sapiens
tacgctgtctctgcctcgcgggaggacaacaagagaatatgaagaaggaggaagagggagaggagaagagaagagaagacgacaagcagtcagtgctgacggtgtgtctcgactcgttgtgtctgcgccgtctgatgtgatcgatcttcctcgtcgtgtgaaaaatactcctcgtctgcatgtctatcgttgtgtttcccaacactttggtctgggagtgtttttcggccacagtggttccgatcgaaagttgtgttcgtcactcttgttcgtcgaggtcgcgaaagttgtgttctcgtgcccgggggcgttgtgttgtttcttcccgctgtgtgctgttcgggcggagacggggtgtgccccccgtgtgcccgtgtgcttctgcccgggtggtgctccctgcccggggggttcttctctcttgtgcggccccccccgccgcgccccaagtgttcgcgtttcccgtggagctgttctcctggttgcctttgttcgcccccccggtggttagtatttgaattagtggcgccccttgtggttcggagcacccctggccactgagggctgttgtcaccgctagcgatgtgatttgccctcgactggggcgtgtgtactggccatctcattaatctcccccagcaaccccccggtggtagaaagatcaatcacgtctatggcacaactaataattgtttctttcaccaactgggtcacatcattgtgaaccgcctcctttcaagaggtgcgccccacttgtgcgtctaatgcccataagattccccgcccacccttggggaggcacgggtggatagtcgcctgatagcccacaggagacttttgagaccctattcctgcggcgcaacaccggtccaacaatcgccccttgcttcgttacccataaagatattgatgaaatacttaaggccacaggattgaggtgaacaccagtgtcccaagagagatttgcaaggctattctgtgggaggcgattaggggtggggaaatttgttgttgtaggcccccagagcagcgcgatggtctatccacgaacacacccatgagtctccaccccctggtcacttatacatgcgccgggagacacccacgagccacaagcacccgttattggtacaagaa

SEQ ID NO: 703019 - DNA, 125 bp, Homo sapiens
gtctgtctagaggatcccgaagcgcacgatggcgcgcctgccacgctgtgatctgtaaaacgccgaggtaagcttgaaagcagcacacatccgggtcaacctctttacggattttgacaagtata

SEQ ID NO: 703020 - DNA, 438 bp, Homo sapiens
  misc_feature (306)..(306): n is a, c, g, or t
  misc_feature (308)..(308): n is a, c, g, or t
  misc_feature (330)..(330): n is a, c, g, or t
  misc_feature (430)..(430): n is a, c, g, or t
tgttactgtaaattcagcttattccaattaggttggcacagatttaaactgatacacattccacagaaaccaattcagtgtataagtattgaagtataagcagtcattgcagcttgatgccagatcatgtatgtaataacaagtggaagttaatagggccttctaatactgtatgggtactcctaagaattatttcattttggatataaagaagttatgaggcctcctgtcacattcacagctggttctccaaaataatttggttgtttcaaaaacaaaggtaatcattggttggttttctcagtntncagaatgaatacagtggttttnaccaaattgccaatggtgggaggtagcatactgaaatgtagtgtgtgtttgttgttttttttcacttttgtgaacaaagcacatttatttaaaaattttnaattttcc

SEQ ID NO: 703021 - DNA, 834 bp, Homo sapiens
  misc_feature (180)..(180): n is a, c, g, or t
tgtggaaaacttaaaattaatttaaaccttgggggtttccacttttttccaaaaaaacccggtaaaaccaaataaaaaaaccccccaccctttaaaaaaggatgggaaagcctctatttccctgtcaccccccctttacctccccatcgtggttacacacaacatatcagccacgtgggncgtggggttccccacaatgttccctctcatttccccgatggtcaccgtggtgggtgcccctcagcccgtgatgtggacggcacgtggtggcgtggggactggtggccgccagggggtggctccgtgcgtgggtgccctcctcttcacaaagaagagctccctcgcgtcgtccccggcggacccaatagccacgtggcccatatcggagggtgcgccaagccctcggtatgaccgagtggccggataaaccactcccaaaaaagacccccgcgtgggccttatatccccgaaaacgcaccccccgtgaaaagacacgtgcgtgcgtggcccccggctttcaagaggaaaaactttctcagaggggccctaaatcccgcggggggaaacataattaccccggtgggcaccaatggtgtggtgccccgtgcacctctgcggaaaagtcgcctataaaaatttctaaccacttatacgaccacgaggagggttccaatcccctctttctgaaaccacagttaccccgggtccaacccccttaatttcctcagttgggccccctttctaatcggcaaggggcatccctatgaggcttacccagacgaaaacatcccggcttatcacactcgcaaaggcccccaggtttgtggccccagg

SEQ ID NO: 703022 - DNA, 206 bp, Homo sapiens
ggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctac

SEQ ID NO: 703023 - DNA, 442 bp, Homo sapiens
  misc_feature (16)..(17): n is a, c, g, or t
  misc_feature (442)..(442): n is a, c, g, or t
gacccttacggctgtnnctcattccgctgaccatcgtgccctggacggtctacctggccatccccatcagcatcagcccccttttgattctgttgccctgcgccgtgctgttgggtgtgtccgtttacatcaccgtttcaagcttcaaaaaatacctttaggagctgcccatgcagtggacacaagaacagcagcccatcatccattccacggctgacaagctactggttcaggcttttgccggtaccggcaaaaccaccacactggtgggctacgccacacaacacgcctcggtgaaaatgctctacctctgctacaacaaatccgtcgagctcgctgcacagggccgctttccacgcagaaacgtggtgtgtaagacggcgcatggcctcgcatatggtaaagaccgtcgagggatccgtagatcaccccagcaacaccn

SEQ ID NO: 703024 - DNA, 439 bp, Homo sapiens
  misc_feature (106)..(106): n is a, c, g, or t
  misc_feature (398)..(398): n is a, c, g, or t
  misc_feature (427)..(427): n is a, c, g, or t
cttaaggtaactgatatcccaaataccctgactactgtgggaagtcagggaccccaaatggagggaccggctgaagcatggcagaagaacgtggattgtgaagatntcatggacatttattagttccccaaattaatacttttataatttcttatgcctgtctttactgcaatctctaaacataaatcataaagattgcatggacacttatcacttccccaatcaatacccttgtgatttcctatgcctgtctttactttaatctcttaatcctgtcagctgaggaggatgtatgttgcctcaggaccatgtgataattggcgttaactgcacaaattgtacagcatgtgtgtttgaggcaatatgaaatctggggcaccttggaaaaaagaacagantaacagccattgtttcaggggattagggnggagataaccct

SEQ ID NO: 703025 - DNA, 266 bp, Homo sapiens
  misc_feature (161)..(161): n is a, c, g, or t
ctagcaggatcctctgggtgcatgcatgtgggtggggagaagctataggggaaatcttggtatgttctgcacaactttgctgtgaaactaaaactgctctaaaaaatgaagcctttttgtttttgtttggatatggggtctcaatctatcacccaggctgnagtgctgcagtgcgaccatagctcactgtagcctcaaactcctgggctcatgcaatcctcctgcctcggaataccgagcagctgggaccacatgcatgcaccagg

SEQ ID NO: 703026 - DNA, 361 bp, Homo sapiens
  misc_feature (1)..(1): n is a, c, g, or t
natccaggatatgtttcctaattctgatttccctgtaggattgttcagatttaaataaagcctgtaaagcagaagtatgtgaccaagcttgggtcctaaagttaaatatcacagagccagataaaataagtctgaggaaaattcatgcatttatttctatctatttcgcccacatagttatgctgatatttcattcacgtgaattcaccaccctaaaattggtacctataatgaagaatcttttttctgtatttgaacaaagcgctctgagccaattaatagtataaatatgatttcaaggatagctaagagaatatttctttctatgtatggttaatccacatgcccccttacacactcc

SEQ ID NO: 703027 - DNA, 242 bp, Homo sapiens
tgaatcatctaggactacagcgtgtgcaccaccatacccagtgtatttttaacttactgttccacagcccccggccatattacctacatagtctatacatactccaagtagtactgtctgcctcctgctctttctctttaaaacattttagattcttatggccgtgagaggtggatcatgccttttacctcagcactttgtgatgctgaggcacgttgatcacttcaagtcaggaagctgtt

SEQ ID NO: 703028 - DNA, 402 bp, Homo sapiens
gtgtagccctaggtgaagctaccaccgtaggattcccattcctaggccattctggaaaaggccaaaccacagggactgagaagcagtctgggtggccaggggctgacggatcggggagaggctgggtgcataggggccaccctggagacttggaggatgaaggagtcgccccaggaggggctggagcggtggccgggagactctgcacatcggtttggaaccgtggaggaactgtacacccacagactgaactggcgtgtgtgcaaactgaaaaaaaaaatcattcagagtgaaaaggatcaggcaagtcactgtacaactgggctattggcatgtcacagatgtggattttactgaaacatttcttcaagagtctcaggccctgaagagctcactgcttat

SEQ ID NO: 703029 - DNA, 274 bp, Homo sapiens
gggctgctggtcctgctggtcctgctggtcctcgggaaagccctggtgaccgtggtgaggtcggtcctgctggccccaatggatttactggtcctgctggtactgctggtcaacctggtgctaaaaggagaaagaggagccaaaggccctaagggtgaatacggtgttgttggtcccacaggccccgttggatctgctggcccagctggtcccaaatggtcccccccggtccctgcttggaagttcgtggtcatggaggcccccctggtataga

SEQ ID NO: 703030 - DNA, 590 bp, Homo sapiens
cgcgttcacacaactgggacccatatctaggagcacacaggtgtaacccatattccgttgaagggaaactgccagatatttgagcctgtgttggaagagatggtgaagggcctgagcgttctgttgttggtcttactgctgggtctgggtctgaccccaacgaccctgggtcaagataactgcaggtacacacacttcctgacccagcactatgatgccaaaccacagggcccagatgacagatactgcgaaagcatcatgaggagacagggcctgagcttaccctgctaagacatgaacacatttattcatggcatcaagcgcatgattaaggccatatgtgcatgaatgtgaacccttacagagataacctaagaataagccagtgtctttttcaggtgaccacttgcaagctacatggagggtacccctgggctccatgccagtaccgagcgcacatgagggttcagcgtcgttgtggcttgtgagggcccctgagcagagctgtctctgctgtgcttgcctatcatttacgctctgcacccagaacagaggtggcgcacatattgtcgggcccacagagagagctt

SEQ ID NO: 703031 - DNA, 340 bp, Homo sapiens
gcattataatatgtggtacgatatgcagtatgatatgcactatgatatatggtatgatatgcggggtgacatgcaatacgatatgtggtaccatatgcagtaggatatgcactatgatatatggtatgatatgcggtgtgacatgcagtacaatatgtggtacaatactgatatgatgctggcaacagcagcagtcacacctctcaagtagcctcgtgaccaataggctgaacaaccaatactctacagcgtgctgcacgtcataaattatatgagatattaaacaccttattacaaaaataggttttgtgtcaaatgattatgccaactgtaggataac

SEQ ID NO: 703032 - DNA, 155 bp, Homo sapiens
ctatacggagatagcgaaggctttgaaattcttctcttcctcagtgatgactctgagctttctccttcttatgtacgtttcggacgggcatgaccggtccggtcagctgggtggccagtttcatgttcttcagcagaactgtctcccttcttggg

SEQ ID NO: 703033 - DNA, 137 bp, Homo sapiens
tctagcaccacagtggctgatgacacttaaataatacacaaagctcagtccatgccaattaatgcagcaacaatttccataagattcaagtcaacaacactgttgagcaagtttcaatcaccggaggcagcaacagg

SEQ ID NO: 703034 - DNA, 335 bp, Homo sapiens
cggaagattggacctctcggagattggccctctaatgtctccaagattttctttgtagcttctgatgctcattatttagagttttttgatggtgatttcttgatctgtaaaagcctcatagatttttttttaaaacaggattagaaaaattgtggggaaaagagacaggatcagagaatttccattccatcctatgatggtgtctaaatgatgtgatgagtaaaacatgcaggaccaaccatgtacgtaacttcactgaagcagtgacaatagcaccagtgaaaatcaaagtgacgcatgtttgcattggaaatggtttctgggcaacaatgact

SEQ ID NO: 703035 - DNA, 822 bp, Homo sapiens
  misc_feature (17)..(17): n is a, c, g, or t
  misc_feature (125)..(125): n is a, c, g, or t
  misc_feature (202)..(202): n is a, c, g, or t
  misc_feature (221)..(221): n is a, c, g, or t
  misc_feature (233)..(233): n is a, c, g, or t
  misc_feature (253)..(253): n is a, c, g, or t
  misc_feature (259)..(259): n is a, c, g, or t
  misc_feature (277)..(277): n is a, c, g, or t
  misc_feature (287)..(287): n is a, c, g, or t
  misc_feature (297)..(298): n is a, c, g, or t
  misc_feature (315)..(315): n is a, c, g, or t
  misc_feature (344)..(344): n is a, c, g, or t
  misc_feature (361)..(361): n is a, c, g, or t
  misc_feature (379)..(380): n is a, c, g, or t
  misc_feature (388)..(389): n is a, c, g, or t
  misc_feature (396)..(396): n is a, c, g, or t
  misc_feature (405)..(405): n is a, c, g, or t
  misc_feature (410)..(410): n is a, c, g, or t
  misc_feature (413)..(413): n is a, c, g, or t
  misc_feature (431)..(431): n is a, c, g, or t
  misc_feature (449)..(449): n is a, c, g, or t
  misc_feature (459)..(459): n is a, c, g, or t
  misc_feature (466)..(466): n is a, c, g, or t
  misc_feature (495)..(497): n is a, c, g, or t
  misc_feature (518)..(518): n is a, c, g, or t
  misc_feature (629)..(629): n is a, c, g, or t
  misc_feature (633)..(633): n is a, c, g, or t
  misc_feature (746)..(746): n is a, c, g, or t
  misc_feature (756)..(756): n is a, c, g, or t
tttttataaatgctatnaaattgtttcctgtcaacattttcttatactgaaaacacaacacaatttataataccttgaaaaatatattcaattcacatcaattcttgaatctctcactggcaggnatgtttgtccctcaactaagattccggaacactgctgaagataccattattttacacagttcaccactacttctaanatagtaatgattggctaanacgggtcaatcncacagacgaatgtgcttgangttgtnggggtttgctcattttangccatctggnggctgagtgnnatgccattttgcttttncctcctatatagttgattttgcttaagtnacacgccaatgtatgcntacctgggccctgggaanncatctttnntttgtcntcattaagnctatnganccaatgaatgttcttgtntgtcaaacacagccatgngatattcacngctttcncacttgttgacatcggttcataatataannncatttaagctcgagggttgcntttgagttacttttctgaggcattagacagttcgaagtcattttgggtacattttatcatgtcctcaaataaggcaggcatattaattgttgcacacactttaaaaaaggntganaactattaaatttatgttctcatctattagaaacaatctttactaggtaattaaacttttcaagtaattaaaatataatgtgaaattttaagattttaatctaaaagtcagcnaaaccttaanatctcctgtatttcacagtgttggccacatcttagctggattaaaataattgttcaaactgtaggg

SEQ ID NO: 703036 - DNA, 260 bp, Homo sapiens
agcttccccccccccccaggccctttcctcaggcaaggtttggcctcaggtgggccccaggcgggaaaaacagcccttggccaaaagtcaagcccacccccgtggagcctaaagtgagggcctgaggtttggctgcttgcccccctgctggggcccccaacttttccatcctttttgcctctcaacatcccttgaatcctagggcctgggttttcatgttttttaaccagacccctaaagcatatgtgttggcttgttta

SEQ ID NO: 703037 - DNA, 239 bp, Homo sapiens
  misc_feature (44)..(44): n is a, c, g, or t
  misc_feature (46)..(46): n is a, c, g, or t
tagctctatcccataacctaccccgtccccccaacacacccaanancctagtgtgttactacacagcaccatcgctacatgaaacctggagaataacaaggcgcgttcaacggaaaagtttttggaacaccaaccatgactggaggcaaagttgtgaatcaagattcaacatacgctgagaactctccccttcttccctctctcatcccttccccttcccttccttcccatttacccat

SEQ ID NO: 703038 - DNA, 454 bp, Homo sapiens
tgacggggaatatatgaggctcttcgatgcagagaacggaggtagtgtttgcagagcatcagtctactcagataagttttctttctgaacttaggactcttttagcacttgggtgttctgtgggtcatgcggagagagtttagtgaaagcggtatttatttctaggcaatgtgcaatcggtttagacgccttcatatttgtaactctagccttagcactttctacacaggccctagtgtgtgttgtctttcaatctgtctctcatctgtggtcgggcttttgcagggctggcggtacaaggcgcgcccttggagaagggtgtcagcacagagactgctgccttatgctcttggctgaacgaaggcttggtgtagatggcgtttcccgctacattctcaggcccctgctgtgtgtgaggctgttccagctcccttggggctggactcccgagcct

SEQ ID NO: 703039 - DNA, 815 bp, Homo sapiens
cgccgtggtgcatgcctgtaatcccagcactttgcggggccgaggcaggaggatcacctgaggtcaggagttcaaggccctgcctgaccaacatggtgatactccatctctcctaaaaatagaaatatgagccaggtatgccggcaggcccctgtaatctcagctactcgggaggctgaggcaggagcaatgtgcttgactccaggaggcagaggttgaagtaagccaagatcatgccattgcactccagcctggccaacaagatgtgggagactccatctcaaaaaacaaaaatagccaggtgtggcctgggcacggggctcatgcctgacctccctagcactttggaggccacggtggtagatcacgaggccaggagtcgagaccagcctggccaaagagaaccccccatctctatcaaattacaaaaatcttcattgggcaggtaaccagatgcttgttaatcccagctatcagaaaggctgaggccaggaaaaatcacctttggaacccaaaaaggcggaggctgcagtgagccaagaatcgcaacacgtgcactccagcctggggcgaccaagaacgcgagagctcacgtcttggacacctacactactacctactacgtacttctacaggctgtgagttaggccagcagctatttcatttctccctgaccagtgctaagtggtatacgccttcctcacccataaaaggtacccaggccaggcattgaaggtcagctataatctagcattcagacccgaaggggtgaccacgaggccggacgagatcaccggcattgggaacccttctaa

SEQ ID NO: 703040 - DNA, 210 bp, Homo sapiens
  misc_feature (32)..(33): n is a, c, g, or t
ggggggaaaaaaaaacccaaaaacccaaaaannggggccccaaaaaggcggggggggcctgagcctgggaacaaagcttgttgggggggggggggggccccccccgggttttcccccccgggggggggcccccccctgggggtttcccccccccggcccccccgggggaaaaaagaggggccctttttaaccgaaagggttttccgaaga

SEQ ID NO: 703041 - DNA, 136 bp, Homo sapiens
cctagagtgccttctgatctgggtcaggcgccaaggtccccagcatatgcggaagctgagctcgcagagttaggacagatcatttggcacccggcgatcccttcccaggcccgcagcccagaatcccacgtttgcg

SEQ ID NO: 703042 - DNA, 251 bp, Homo sapiens
acacgcgtcggaactggtcacaggcgccccagcgcaggcaatgcaggcctcactgttgcttgtgccccagtggggtctgtggaccctgccaccacggcaggctagagagggagccacctgcccttcccacgtagggagtggggtgcgcccagaactgggggctgcttatttccctcttctacaatcagggcggcgagatctgagacttcctccagaaaacctttggttggtggggtgcttcagaaaaaaag

SEQ ID NO: 703043 - DNA, 272 bp, Homo sapiens
tcccaattttgtgcaaaaccggtggggggtgccctgaggcccagattcaaacccaattttgggaagacttttggcccccccgttaaaattttgaaagtaaaaaagggatattttccccccgctaaagcttgaaatggtccctttcccaggggaaaatggggggggccctgttttggccgatttaaaagggtttccttccctggggaaaaaaaaaaccccgttttgttcctaaattgcccagggccataaatttaaataggggtccctgttta

SEQ ID NO: 703044 - DNA, 647 bp, Homo sapiens
gcttctatgtgtgctatgatccatctttagtacatttttgttgtaatatgaggtaatggtaaatgttcatttttttgtttttgtagtgaaatgaattattcacttcttctagcaccagtttcttgaaaagacgggtcatttctccagtggaatgggcaactttatcagaagtcagttcactctatatttcatagtcatattataattctagggatcgtgtaatatttatccttaggccaatactataatggttattactggtgatagctttatgatcaggtagtgtaagccctccaagtctggtactttttcaaaattctttgggctatattggatcctttcatatccctatgcatttttaaattggcttgtcaaatttctaaaaaaagacctgggatttggatggagagtatattgaatctataaagtaactgggggaggttggacattttaacaactattaagtttggcaattcattgaacatggtatattggtcattttaattaaggtcttaaatttctctcacaagtggtgaaaccagttataaaattaaaagaataggttatatttacatgtgatagaagaatacttattgggagtggaatgattatattaccagtgaatatatgttactagggaacatctg

SEQ ID NO: 703045 - DNA, 298 bp, Homo sapiens
atccttactggaggtgaagtgcctgccgccttgttagtttggtcagtctgtgggctctgtggtatatgcctgcttcgaggctgccctagggagtgaggtacgaatctggtcccaccgctttcctgggagaatgtcactgtggacgtgaacagctcggagaagctgcagctgcaggagtgcttgtgagctgactccctggggcctctcaaagacgatgtgctactgtcggagacacgaggcccccaggacaacagatccctctgtgtctttggaacccagtggctgtacttcactaccc

SEQ ID NO: 703046 - DNA, 250 bp, Homo sapiens
  misc_feature (73)..(73): n is a, c, g, or t
  misc_feature (97)..(97): n is a, c, g, or t
  misc_feature (102)..(102): n is a, c, g, or t
  misc_feature (141)..(141): n is a, c, g, or t
  misc_feature (156)..(156): n is a, c, g, or t
  misc_feature (191)..(191): n is a, c, g, or t
  misc_feature (205)..(205): n is a, c, g, or t
  misc_feature (235)..(236): n is a, c, g, or t
aagcgcgatctctcctacaatttctaactgtaactcctttgtttgttaattatttcacgattctctgctgcgnttcataacctggctgaaatcttanaccantgccttatattcacctgcaaatgcactgttggaagaggntatccgacataacgnccataaccggagttcctgcagcccgggggctccantagttctagagcgnccaacaccgaggtggtgctccaagcttttnntccctatagtgagg

SEQ ID NO: 703047 - DNA, 535 bp, Homo sapiens
ccccacttcgaaagtataatgatttaagactacatgttttaaaaaaccttcatcctactgatttcaaaaagcgtttccccttcaataagaccaccaccaaggccgggtgctgtggctcaggtctgtaatcccagcacttcaggaggccaaggtgggtggatcacccgaggtcaggagttcaagaccagccaggccaaaatggtaaaaccccgacttcatgaaaaatacaaaaaattagccaggcgtggtggtgggcacccgcaatcccagccacctgggaagctgagacaggataatcccctgaacccaggaggtggaggttgcagtgagccgagatcgcgtcattgtactccagcctgggcaacaagagtgacactcccatctcagaaacaaaacaaaacaaacaaacaaaaaaaacaaacaaaaaaaactcttttggacgaatgagattattcgtaattgtgggggtctgcattcaagcattataaagtaacaaatggatgtggaatacattgggcttttcaagtcctacaga

SEQ ID NO: 703048 - DNA, 179 bp, Homo sapiens
tcgtgaaatcaccacgtagtcgttttttacaagcgatcaaagcctcgcagtctaatgtcagctcgagaaacgctctagccgtagccacacccccacgggaaacagcagtgattaacctttagacaataaacgacaagtttaactagaactatactaagccccagggattggtcaagttt

SEQ ID NO: 703049 - DNA, 964 bp, Homo sapiens
gctccaccttactaccagacaatcttagccaaggcattgacccaagtaaagtataggcgatagaagttgatagatcctggcgcatagagatatagtaccgcgagggaaagatgaagagagagttagtaaccgagagcactgagtaatagcacatggacataaaccgcctgatagcctctcgtgcgataatgaagttacctagacaataactattgcaaggagagccaaagcttaagacccccggaaaccgaggacagagcataccgtaatgaactagcataacaaggagtcaccactccggtgctagtgatacgcagaaagtagctgcggacagcattgtataggcgctacgaagcggtaggagagctctgacgcgatggcgctggggtgatatggtggttgtccaacgagtaggaatcttcagttcaacgtttaaatttgcccagagaaccctctaaagtccccttgtaacatgtgtaatctgtctaggtccaatggaggaacagctctttggacagctaggaaaaataccttgtagagagagtaaaaaactgtaagcatgccagtagtgaggcctaaagagcagccgagcaatgaagaaagcgttcaagctcaacatgcgcaggtacgctaaaaaatccctaaatcatatgactgaactcctcagaccaatggagcaatctatcaccctatagaagaactaaggtgtagtatagcgtaacatgacaaagattctcctccggataaggctgcgtcggattacaacactgaactgacaattaacaggccaagatctacatcagcaagaagtcatgattacctcactggtcaaccagacaggcatgttcataggaacggtgaacaagtacaggactcggaaacttaccggctgttaccacagaataccttagattcaaggtaaaggcgcggccgtgccaggtaaaggcgggactacgtgaagggc

SEQ ID NO: 703050 - DNA, 105 bp, Homo sapiens
  misc_feature (26)..(26): n is a, c, g, or t
  misc_feature (70)..(70): n is a, c, g, or t
  misc_feature (92)..(92): n is a, c, g, or t
ggacacgatgttttttatttattgtnagtaaggatggcgaccggccgatgtgtgtgctttgcctgttatnccgaaagcaagctttgagagcnacctacctataga

SEQ ID NO: 703051 - DNA, 884 bp, Homo sapiens
gcatggtccgtcgcgccgcttgtgagctgaatgtgccgccgccgccgggcagccacggggaatccgcccgcatctgccgccctcgccggctcgggcggccgtggggcccagatgcgccggaggccagggctggtggcggcaccgcgcagcggcacggggtcccgtatatgatgcatgcgcccggcggtctatgccgatgagcccggagcggccggaggagcagaggggccggcgggagggatggaaacctttctgcgagtacgagccaaccggcagacccgactgaatgctcggatagggaaaagtgaaacggaggaagcaagatgaatgggcacgagggaaggctcctgtcatgagctgaggagtgactgctgatggaacatcgagcagtgagaagcaagcaaggcgacatttgaggagtatgagatggatgtgagagagaagacggaatactaggacagactagttcgtccttctgaatggtggcataaccggaaggcgtctggcgtttcatcaatgtacaggcaggcaacaagagaaacccggaacagatgatgcatgacatatgggagtgatggaatggagagtgaacactactgagaaaataggcgacacagcccacacagcaacagacgaatgaatgctgctaaaaataaccaacatgacaacaaaggcacgcaaggaaagaacaaacagagaaaagcaccacaagggagacagcagcagacgcacaagaacacgaggacgacaacgaaacgtaaaaacggtagacgaacacacacaccaagagaaagaagaccaacaacaacaacaagagttgacagcaaacaactcaggcacaaggacgcagagactacaccaaacaacataagaaaatgccggaa

SEQ ID NO: 703052 - DNA, 174 bp, Homo sapiens
cctcgtcccgctcggcgacatggcggggaacgacgccacgctggagctcggcgacggatacgtcacgagcatgcgaacgctgtccaccgaggcgatggatgagggctcgctctacacctgctcgctcactctccgatcgctctacgctaacgatcctcgctcgatcgagctcca

SEQ ID NO: 703053 - DNA, 83 bp, Homo sapiens
atggaacgatttcaaaggcaggctgccctgaccaaaaatatctgccatgaataaaggtgcctgaaatcctgcaaaaaaaaaaa

SEQ ID NO: 703054 - DNA, 196 bp, Homo sapiens
ctctataggatccccagaatcatggatgctctacgcctcctatgttaaccgtgtccatgtctttactactttgatccgcgcatgatgtggttttgacgaacttgccatatactttcttcaccaatctcttgaagacgatggaacatgctgagaaactgacgaatgctgcagaactcaaacgagtaggctaatcttc

SEQ ID NO: 703055 - DNA, 217 bp, Homo sapiens
cggatcccttaggcgagactgtggcgtgggctgacgggtataagcatggtcctgaaagagctgcttaccagtgccggcgctggtcagtgtgcgccgcaggaggagtatggcaccttgtcatactctagctccccaagcacgtctcggcttctgtacggtcaaaggtgaagatgtccccctcgcacttggcactcttgggggtgttgagctccgagct

SEQ ID NO: 703056 - DNA, 542 bp, Homo sapiens
  misc_feature (464)..(464): n is a, c, g, or t
ttttttttgggtaaacctttttactttttggttaagggctttcattatttggaatagaatggggattttggcacaatagcatttttggggaccggttccttctttaccaggaataaactttggatggcccatttaaagataaagctcaaaatgccaatccttcccctgggagggggaaagccttaaccaatgggagggggaaaagccttaaccaagcatttacccagggctttacctattcaaaaatttaaactaatggctgggttattgacttgattttaagacatgggagttaataaaaaaagtctaagattgaaacaattttgcaaaaatatacatttggatatggggatatatggatggggatatatatatctactaggaaaatttatcgcttaagggtgttgtgccatttcttagtaccaattttacattctgcatcacagcattttgcatcccatctntacactaaggccaccatattactttaaattactttatacacattttcagccattatctgaataatcatttatagcccc

SEQ ID NO: 703057 - DNA, 263 bp, Homo sapiens
  misc_feature (41)..(41): n is a, c, g, or t
  misc_feature (128)..(128): n is a, c, g, or t
attattttatttatttgcttcagagatggtgtcactcttgntgccccagctggaatgcagtgtagtcctgaactccttggctcaggaaatccctcccgcctcagcctcctgagtagctgagactacangccatgtaccacgatgcccagctaatttatttctttattcatgtatttatgtatttatttatttatttattttttgagatggagcctgggcaacagagcaagactctgtctccaaaaaataaaataaaataaaat

SEQ ID NO: 703058 - DNA, 904 bp, Homo sapiens
ggggctgcaggagaatgatggcggtctccacaggagttaaagttcctcgtaattttcagcttgttggaaggaacctatgaatcgaatggtacataacaatggatgataggctgacggtacagttagctggggccttgaagattgatgaagatatgacacttacaaggtggacaggcattgattattgggctcagctcgaaggacagaacttatgaagatactagagatagtatagcctgaaagtagaatgtggacctaaatacccagaagctcctccgtcagtttagatttgtacatcacagataattaatatgaacggtaatacacataagttccagtgggatggtggatgcccggatgctataccagtgttgagcaagaatggcacaaattcatatagcattaggagttgtacttcaagagctaagacgtctaatgatgtccaaagaacatatgaagcttccacagccaccagaaggactaaatacaagtaattaatttctagtggatctcaaacttgtcttaaatcaacaaccttctactcatgtgaatgtcttgattaaatatcactagagtgcagaaatacgacattaagtccacaagaattccagctggtaaacatgacctggacatttgtaagaatatatctaatatattgtacacccatttatgttttcacgggtaacaggaggaaaaatgcagcacaattttttttgctcttgaaaggcactgtcattaaacataacctggagtactcgaaatagaattcaggttaccagatggaagcgtgtggagaagtgtcagatggaatggaagctgtgtgttcctaaacagtaaaatctcaagaaacagaatgggatggtttaccatcttatagtgaagagacctgattgaattgtttaag

SEQ ID NO: 703059 - DNA, 1229 bp, Homo sapiens
actgcgcgcgccatcgcgagacctgactgggtgctagtggcgaggcctcgggaccgcgggcagccgcgaagcccgactgcaccggccctcggctcgaggagccagatggacgccgatgggctgaggagaggcctgaggaaaaggtagccacccacccgcgggattgaggcggacgggccgccgcgggcctctgacgaccgctgaataggtcgcagcactgagcacagggcagggaggacagacatatagggcgggagccattcgagacgcaacagcgaccgcggacagcaaggtcgatgaggaggacgaggggtaagacggaaacgataaactacgagcacatggggattcgaagggcagcaaatcatcccccaaaaggagataccgggaccatgagagtgagaagacggcagggtcatgacataggggaaaacccatgaacccaagagaagagagaggaagatgatcataccatcaccatgagacgcggaaaccacacgggaaaacacgcagggaaaacccagaaaaagaggcagccgaggcacaatggatgggaaagagacgtaccgtggacggtggcgatataaccaacagagaagcacccggaatggaacagcgatacaacggacaccccacgaaaacgagcgacacagacacataaatgggaaaagcggaggcacacagcattaaaaaggtacaaggaggcggaacacacgcaaaagaaagcagatcacgaccaaaacgcgaaaaggaaccaacaataacaaggaggcaagctcaccaaaccgggacacccgagcagacaccctgagcacaagaaagaaaacacggaacaaccgggacccaccccgaacatgaaaaccacgtacgacaaaacaaggagagcccgaaagagcatgcaacagacgcaggaaccaaagaccagtacgccccacaaggagtgacgaccaggagagcagagtacggaaaacacacaaccatcaggaaccagggaagaaggcgcatggcatcacggaaaaccgcagaacggacaaacccaggacagccacccacgaaaaacgaaccaacccaaaagaaccacaagaaaccagcgacaacacacagaaccaacacagacacgaaaactaaccgcaagacaccaccagagcaccaatcaagaccacaaagacaacacacaacaaaaaacaccaaacaaagagaaacaaacacagaaaagaaaaagaacaaaa

SEQ ID NO: 703060 - DNA, 188 bp, Homo sapiens
gcgaactgggaggcccctgctgtctggagcccatcgtgataggcccgatgagcctgctttccctacctgcagcttgttctctgtggaattccctacttatgctcctcgcgctttcttcataacaccagtttgggatctccacgtgtagtgcccatcattactaggtacactagccaatactgcccaaa

SEQ ID NO: 703061 - DNA, 548 bp, Homo sapiens
tgaaacctatgagctccactgacctgccggtgcccgatgcgcgcgccgaaaccgctgcccgggcgcgccaactgcaactgacgaagccacccgggtcgctgggccgcctcgaagagctggcgtgttggttcgccgcccgcagcggcaatcccattcctgagatttcgcgcacggaagtcttcgtgtttgcggccgaccatggcgtcgcggcacagggcgtatccgctttcccaccttcagtgaccggccagatggtcgccaacttcgccgccggcggcgccgccatcaatgtgctcgcccgcctcgagagctgccccatgcaggtggtcgatgtcggtgtcgccggcgatgccgagccaccgcccgccgtgcgccgggaaaaagttcgggccggcacgcgggatctcctcgtcgaagccgccatgaccgaagacgagttgactgcagcactcggtgtcggagcgcgttgtgctcgcgaagccattcaacgcggtgcccaactgctcatcgccggagacatgggaatcgccaataccaccgcggccgca

SEQ ID NO: 703062 - DNA, 516 bp, Homo sapiens
  misc_feature (12)..(12): n is a, c, g, or t
  misc_feature (193)..(193): n is a, c, g, or t
  misc_feature (245)..(245): n is a, c, g, or t
cataacctgtgntaccaggtttcctgattcgagctctagtgatacccccagctagttcggtaacaatatattctcttctaatgtattcatcctattaaaggtattataggaacactttttaaatatcttccacattatagtagagcagtaaagacataggggagagggaaaacttggactcactgtggcctantagacttccctatctttataccctctggaaggcagtcattctagagtaccgnccatgcttgttgcaaagacaaagtccgtttatccctcaaatctttctgtggtggttatagtaaagattgtggcagtagggttggtaaggtaggttggccaggtgtctcctgggtcccacagagaattacaacacaggaaaggaaaacatagtatgccaagagacatttgatgatcttctgctttcatccttcccagcaatttattgcattcttctctttaaggaaatgggaaactatacttaagcaaatgcattctttttctatggatcat

SEQ ID NO: 703063 - DNA, 431 bp, Homo sapiens
ggggggcacttgtaatcccagatactcaggaggctgagacaggagaatcacttgaaccggggaggcggaggttgcagtgagccgagatcacgccattgcactccagcctgggcaacatagagaaaccctgtctctactaaaaatacaaagaacttagctgggcgtggtggtgcaggcctgctaatctgagctacgcgggaggctgacggcacggacacatgcttgaacctgggaggcacgaggtgcaactgactcgatgccagttgcacctccagcctgggcaaccagagccaaacacctgaagtctcaagaacagaacgaaacacgaaacaccaagaactaaaaccagaagcacgcccgcgaacacaaaaagaactgaaaaaccccggggacatctaaggcgggggtggggcaaaaacacaggaggacag

SEQ ID NO: 703064 - DNA, 396 bp, Homo sapiens
  misc_feature (44)..(44): n is a, c, g, or t
  misc_feature (56)..(56): n is a, c, g, or t
  misc_feature (63)..(63): n is a, c, g, or t
  misc_feature (137)..(137): n is a, c, g, or t
  misc_feature (183)..(183): n is a, c, g, or t
  misc_feature (264)..(264): n is a, c, g, or t
  misc_feature (328)..(328): n is a, c, g, or t
  misc_feature (342)..(342): n is a, c, g, or t
  misc_feature (350)..(350): n is a, c, g, or t
cagcagtctggttgccaaggtccaaagaccttaaaaaacctggngctagaaagcantagactngaggcttctacagactgtaggattcaagggcaggcactcgggaagggaagatggatgtaaagtgtgggagaccnaggacacagtggagcccacgagcacgagctggaacccacgaggatngcctggaacccatgtcagtctctcaccacctccagcttcgatgatgtgggtgtcctgcagaagaagctggtgcccttcctnacagagttaaatatgcatcttggcccaggaattagagaagctgaaaggatggatcctggggganggtggagcagcttncaggcctnggctgcaggcctgaacttacttggtccacaccaacgaggtgatttt

SEQ ID NO: 703065 - DNA, 971 bp, Homo sapiens
gactcgattgggagggggacccgggatggtccccaatttgccctacgcgccctcccccagcaggtttgcccgatgttatataatccaagcgggcaccgaaaggtttccgcactggggagtcggaccccctggcccacccgccaattaagtggtgttagcgtctactctttgggcccccccccgggcttttcacatttctaggctccgcgcccctgttgtgtggtgacaattgtgcccgggaacacatttccacccccggacaccgccatgaccgggattacggatttttattacatctcccaatgggaagtgggcccgtcggccgccgcagtgcgccagggggccaatctgccaggctaaagggcttggcctggattcccagacggagagctcagatgggaccacagcgggcgatttgccctgtgcctgcccttcttagcatgcaggataccccagagactcgcccgtcagggaatactagggactctcctctagcgccatatagttccgtgggattagctctgtggccaagcaggctgagctcgggtcccacctttcacctccatttcgtttgttagaggataagggacataaacgtacttgccatctttcagaagattaagtaggaggcgaggggtttcctgctctccagggccacaagggacaaatagggactttgtttaggccaaggaaggagcggaagtagggcaactcggtcctgcgattattaatcccactccccacttgttctagggcacccaaacactattttacgtctctaaaatcataaaacggcagaacagattcggttggtttggaagaaaagaaagctctataaatctaaatcgctattcctgtatgttgatttgatactttggaaataccaagttcatttgacttgtatttttgtgtaatatgtaatgatcgtattaaaaccaataaataaagccctggagtttaatgagaaaaaa

SEQ ID NO: 703066 - DNA, 812 bp, Homo sapiens
  misc_feature (812)..(812): n is a, c, g, or t
tttcttaaacttgaggtgggcagggagagggaggaaagcacattcgggaacgagttctcaaattaatgctcataactgttgtcttagtgacgtagaatccactttcccaaatggcggaggccttgtgcttccgcgtggaggaatagatggacaagcagaggtagtgagcagccgagctgctatgaatgctcatgtgtggcacatcacactcgtctagttccagaggtatgctcaatttatctaattcttttctctatatcgacgatggccaattcttggcacatcgagggaattgatcactgatcgaccgttagtacagttcatctgatcaaagttgcattagtttacaactcattcttaaaaggtacacccaggtagttcactctagggtgatagccttgcttcactacttgatgggggcgacagcgtatagatatgcgaattatgtagagtgcctgtcataaaacattaatacccgattggtaaggttaatcacaagttcccttgtttcccaccaaaattaaatttcttcttcacgagtaatggtcagtgcgagtaagaccgtttgccatctaaagggcgtgcgatagacagcctattagaattgcagattagcgcattgacacgatagagggacctatgatagtggcctaagaaaaaacctggggaaccaaaggaagaaggggcacccaccaatgcagggtggtgggttctcccttttgataccaattttcattctctccgttcccttcatttttaagccgttccccaatatgtcccttgaatcccgcccattttattcaaaaggcttn

SEQ ID NO: 703067 - DNA, 413 bp, Homo sapiens
cacagattgaacctccagccgtactctctggaacaagaaagatgactggggaggaaacacaggtcagcatgggaacaggcgtcacagtggacacaagggtgggctgtctctccacctcctcacattatgctaacagggacgcagacacattcaggtgcttttgcagaaagagatgccagaggctcttgaagtcacaaaggggaggagtgaagaaatcctgcatctcagtccctcacaagacagctgtctcaggcttttcgagctgtgagagacacatcagagccctgggcactgtcgctggacgcagcctgagagtagctccctccttttccacctgagctcttcctcctacacatcacagtagcgaccacagctccgatgaccacaactgctaggacagccaggccagcaac

SEQ ID NO: 703068 - DNA, 112 bp, Homo sapiens
cgagagaagtcttcgctttacgatttttggaccgcttgggcttcatggacgtctggggcaaggggaccacggtcatcgtctcctcagcctccaccaaggggggtaccgagct

SEQ ID NO: 703069 - DNA, 537 bp, Homo sapiens
agttcgacggagactctccacaaccgatccatcaggatgtggagagatctggacaaatggcaaataatttggggttgaataattggtaatacaatgaaacaatggagagaatagtgtatgtacaatgactctggaaagatgtagtatacttctaatatggtatgtcttcaaggaagcatactaaggattgacttgcggacagggatatgagacataaatgtcactgaccgtgtgacttacttctcttagcaagtctatgcaatacttagagactattagaaggagcctagcacagggacagtctgtgggggtatgggggtgggataagctctatggtccataagagagtaaagaggtcatgcaccggggctggctgccgggcacagagagtctccgtcgaagctgcacaactacagctcggccgtgagtagatggtcagcaaatgtaacaacctaggctggatgagtgacccgaaggcgtgaccgagtgcatccaggatcgatctggcaagccaccaggggtcagacctcgtgcgct

SEQ ID NO: 703070 - DNA, 264 bp, Homo sapiens
caaagaggtccaaatatccacttgcagactttacaaatagagtgtttccgaactgctctatgaaaagaaaggttaaactctgtgagttgaaggcacacatcacaaactggtttctacgaatgactctgtgtacttttaatatgaagatatttccatgtctaagattggcgtcaaatcgtttgaaatctccacttgcaaattccacaaaaagtgtttttcaaaactgctctgaataaaggaaggttccactctgtgagttgaata

SEQ ID NO: 703071 - DNA, 297 bp, Homo sapiens
tcacaatgcaaaccttactcctatgccacacacccagacactctgtagcacatggcctggaagctcctgaggaccgctgcagtgatagcacacaggactattgcatcagcatcgtgcctcacagggaataagagctcagccaggagaggtcccaagaatgacagaaccatgagcactcctaccaaaactcagctctgcacagcacaaatcaaccattcacccacaacaggccaactcctaacacatcccatccagacagcacataagagtgcgcccagcagattgcacctactactt

SEQ ID NO: 703072 - DNA, 409 bp, Homo sapiens
  misc_feature (267)..(267): n is a, c, g, or t
  misc_feature (289)..(289): n is a, c, g, or t
gctcagctagatccgagttattgtctcatgaccaggaaaaattaggcacgggaacatcaaagagtgagtggaatagaatttattaagcgaaaaggaatgatctcagcaaaaagagcggtcctgaaagcaggttgctggttgtcttccttcatagttgaacacaagggcttctatatccgctgatggggctgggttccctatttgcatagggcatcaattcttggttggctccaccccatctttccagtgcgcgtgcggcgtccttangtctgagccactccacattgantttatttccttactgcgcatgtgttaagggacggaatttttcattgcgggcatgtttgggcaagccttctgtgcacaatgagcttggcgagtcgggggttctccagggaccctcccctat

SEQ ID NO: 703073 - DNA, 101 bp, Homo sapiens
tagagtctcgccccttctctatgagattaaatcaaaacacttccctccatctcctcctgctcctgcgtggcgggggaatgtgtgctggctagggtggagga

SEQ ID NO: 703074 - DNA, 570 bp, Homo sapiens
cgtttacctggcacgaggaagtctggagcagggcttggtctcgccaatattccaggaaagcatgctgacactctcctaggtattcactcatgtctggtctccttcaaagacgctaaaaggccagaagggtagctggccccccaagtaccggggtcataaggacataaataaaagaactggccggcgtatgaaaaactaatagaaaattgcccaagaaataacactctctcatctctttgacatatagtaccttttccccacactggctagtatgaaagcaggattagaaaaaaaaaaaacaaaacagtaaaagaaagggcccaagagagcaaagatactttggaatagagttcagacagagaatagaaaaccacaatagtgccaaagggtttggtttaacaaagacgggtgcctaaggaccaccacagggatgcagcttcccgggtggggtggcaagggtgcctaagatgctctgaaaaagtgctatgactagagcttacaatgacgggtctagccaagacaatcaactcaatctccaggatcagtctctggaaggctgccggaggggag

SEQ ID NO: 703075 - DNA, 1040 bp, Homo sapiens
  misc_feature (444)..(444): n is a, c, g, or t
ccgcagtgctgtaggcagccatggtgcccagccggaatggcatggtcttgaagccccacttccacaaggactggcagatgtgctgcgtgtgcacgtgtgttcaacccattactggccctgtaatgatccatgcagactgtaatgtgccctgtgctaatgccaatggctgctgcctgacatctgacccctgacgcccctgacgtctggtgtcaccatcctggcccgatctgttgctgcttgcaccgagctgtgttcgtgtgtaccaacacagaaggtgttgctgctgcctgtgcactgctgtgctttccagcccattgtgatgtgatgcatcatgtggttgtgcctggccattccacaaggcaagggtaggacccagtgacacattctggacaattatcttgtgggatcgcagatgagcatggcggtgaaagccaatgttcccancggggatgatcacccgtgcaaggggaccaaaccagtgcaacgacggggctcgaacgggacagtaacccagggatacacaacgagcggtcgattccctcttttaccacacatgggaacggccccttcgggagcgccccacaaaggcgaacggggggcaggcacccacggttccttggccttggcaacgcaccactggcacccacgtggcgacccaacacccaagaccatcgaacccggggcacccgggtccacatggcccccggtccccgggggcacaccggatcacctcatcagacgccaacgggccagcacaaaggctccgacagatacgatccaacctagaagcggaagatgcacgacacaggcaactttatcccacgaagcgccccgtcatcgggccgtaagggaccttcccagggacaattggggcccccctggatgcgcccaaactggcacccggcgacgtccatcccaccggcacacttcaccgcgcggccacacaacagggacagccctacgtcggacccgccccgcgccaggcaacccaccgcgggactggtttcggccacccacgccaacagacaactcacaagccc

SEQ ID NO: 703076 - DNA, 379 bp, Homo sapiens
  misc_feature (12)..(12): n is a, c, g, or t
  misc_feature (62)..(62): n is a, c, g, or t
  misc_feature (80)..(80): n is a, c, g, or t
  misc_feature (95)..(95): n is a, c, g, or t
  misc_feature (105)..(105): n is a, c, g, or t
  misc_feature (119)..(119): n is a, c, g, or t
  misc_feature (197)..(197): n is a, c, g, or t
  misc_feature (221)..(221): n is a, c, g, or t
  misc_feature (229)..(229): n is a, c, g, or t
  misc_feature (233)..(233): n is a, c, g, or t
  misc_feature (239)..(239): n is a, c, g, or t
  misc_feature (245)..(245): n is a, c, g, or t
  misc_feature (248)..(248): n is a, c, g, or t
  misc_feature (257)..(257): n is a, c, g, or t
  misc_feature (290)..(290): n is a, c, g, or t
  misc_feature (293)..(293): n is a, c, g, or t
  misc_feature (295)..(295): n is a, c, g, or t
  misc_feature (298)..(299): n is a, c, g, or t
  misc_feature (304)..(304): n is a, c, g, or t
  misc_feature (306)..(307): n is a, c, g, or t
  misc_feature (309)..(309): n is a, c, g, or t
  misc_feature (360)..(360): n is a, c, g, or t
caggaaaaaagntagttggagttctgctgcatacttattcaagtactaaaattatgcagggnaatcgttcttgtattaanacttagataattaanaataattatnaatgccttttaacntgaacctctttaataatctgttttagatggcctaacttatagcatagtgggtttttttttaacttgttttattttganattattatcaattcccaggacgtnacccaganggtnccgccncgcccnggnttcccttcncccagttttccccaatggtgccatcttacatgnttntnctnnaatgncnnancccggcaattgcccttggtaccatgtgtgtatctcgttctgtgtcattttntcccttgtgtaggtttgta

SEQ ID NO: 703077 - DNA, 845 bp, Homo sapiens
ggtctggaggatggtggccctcttctcacagctccactaggtggcgctgcagtaaggactctatgtgggggctccgaacccacatttcccttctgcagtgccctagtggaggttctccatgagtgccctgcccctgcagcaaactcctgactggatatctaggcatttccatacaccttctgaaatctaggcagcagttcccaaacctcaatttttgacttctgtgcacccacaggctcaacacttaattggtgggaagctggttagggttgggggttggaaccttctgaagcaaaagcccacgtggtccctgggctccttttcagtcgtgcagcgtggagtggctaggactcaggcaccctaggctgctcacaacaggggtccctgggtccagcccaaaaaaacatcttttcttcctaggcctctggacgtttgataggagaagctgccaaagaagacctgtgacatgccctggagacattctccccattgtcttggggattcacattttgactccttgttacttaaacaaacttctgcagccagatcgaattttccttgagaaaatgggattttcttttctatgcatgtcaggctgcagattttccaaactttcatgctcgtgcttcccttattaaaactgaaggcctttaacagcacccaagtcatctctgtgaatgttgtgtgttgaaatttcttctatcagataccctaaatctcaagttcaaataccttatcagatacctaaatctctccaagttccaaaattccacaaattctctacagcaggggaaaatggcaccagtctctttggttaaaacataacaggagggtcccattgtgcc

SEQ ID NO: 703078 - DNA, 1134 bp, Homo sapiens
acaattctggtcccaagcacgttgcataaaaataagactaattagaggaaaaagtttttgttgaataagttttaagcattagaaaaaagccgacaaaagatactacaacgaaacaccagtagttacatcaatgggtcaccagtcgttcataatatgctacatggtcgtttatcatttagttctcctcttgtctgtctctttttctccctcccgtccctctacacacacacacacagcagcacagcacacacacacacatacacacacacacacagtcacactcactcatacagatgtatacacatattatttctctgaaccatgtggggtctatcaagtgtgtgagtgagcaagttacctgtgcctctccagtgcctgggactttctctctctctaaacactaagatacgtgaagagaactcttattgagacgcacttagtgagaactcaagaggactctatattacatattacaacccttagaaagttgtgtgtgagggtacacagtagaaaccctgcagataatatacttaagactataagttgtaagaaatatgggtggatcgtgactgtgatggtctccaagaacaatgggaacgagtagcccagtagccccacgtgactacgcaacgagtgagggacacactcagatacacatgacgcatcatagcgacaccatgtctgacaataataatcataagtaagagatatctaaaacatcggcgctgcatacatcacgaagtaggagtgagcacggttgagcaccaatactaccacaattagaaaacccacaatcttccaggagaaattaaaaccataggaaaagggaaagaggcaccggagacatccggactgacaaataacaaggcagcacaagcggagacataaaaacacacccaagtctggggcacccactgggacacaaacggacaatacaaaacagcaatcaacagtagtactccaaaagaacaaacagccaaaataaaggaaaagagcaacaagacatacaacttatgaaacatgacaaacagtagatcacggacaaaagtaccaaaacacggagaccctacagtgccaacagacaccccagcccggagcaaaaagcggacccagatttaggcaaacagagaaaaa

SEQ ID NO: 703079 - DNA, 222 bp, Homo sapiens
tcatccccttcctcatcactcttgtagtactggcggagtaaagacagtgaggcccagggctagggggccacgagcttctcgaacaagccatgttactccacttccccacccccaggagggctccctcctcccctgctacatcccttgtctcagctctcatccccaccacagattccctggatttgctgggaactggaagccaggcgagggtcgtggcacaat

SEQ ID NO: 703080 - DNA, 895 bp, Homo sapiens
ggaagaggagcggcggatgttcaactcggccgttgtcaccatgccggtcgtccggaatattttccgtcgccgtcggggtgattcggattcaaagtgaagataagggccaggagaacttgcgtctgaactccataggggtcggatggattgatgtgtgatgcctgagacttgctaccttttggtacatccatgccatgggctcacgagttgccataaaaaactctctgttcgtcaatagaaatatacctattggttgactgaatgagggaatacgtgggcctatctcagagtaccgttcactattactcggataaggcatgcactgcgtcacgtcgccggaacacaaagaagccctggatccttacctgtgcaatgttatcctgggggatttttgaggacggcctgataattccatatactttttggagattacgatgacatgtgttcaaccttgccagtcttggaggcgtgcaatacatgctgtgttacgtatgctgaaggcattcatgcagagagtactgcgctgtggttcactatagtcgattggcttcttaatatgagcactgggtcacaatagaacctgtatgcgttgtaatctgactttttcagagtctgccgctgtaccagttcatgctcagtatgcatcactgttcttctgcttccactgctttctggtatgcccggctcacatcctggatcttgcatgtgtcaagagacagccggggtggggatcgaaaaggatacaggtgtttcccgggactgtaccaaatgtccttgcgtcgttgtccttgtcactgaaatgctaactattgtggcgtggttacgtattgcattctcacatttccaatgtttccctgagtacaatacacaacattgcgggggctgcccaaaaaat

SEQ ID NO: 703081 - DNA, 214 bp, Homo sapiens
  misc_feature (114)..(114): n is a, c, g, or t
  misc_feature (120)..(120): n is a, c, g, or t
gaaatactgggaaaggtcctgtcctttcaggaataaggttttggggctgagaacataattcaaagcacaagttaacttttgtcaactccaattttgtattgttctccattgagnttttantttatagacagcagccctggtggatttaaccaatttgcctataattcaattatataaatatttttatgtgaaaataattgtataagagctcttg

SEQ ID NO: 703082 - DNA, 294 bp, Homo sapiens
cgaattttcatcaggcttccaagaatcaggccaactgaattgagtcaacttctgaagataaaacctgaagcagttactgggagctgctattttatatcatcactgctttttaagaaattcttgtttatggatctgatacaatctagatctctaatatttttaagcccaagccccttggccaccgcagctcttttcagtttttgctcataccccattcattctttgcagctaactaagccgaagaagcctggcaatcaagcctgaaacaaagattaataaagctctctgcctagt

SEQ ID NO: 703083 - DNA, 2490 bp, Homo sapiens
ggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcaggctgaccgtgctgaagtgagtcgctttgccaagaactttctgccgatcctcttcaacctgtatgggcagcccgtggcagccggggacactccagcccctcgccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggcccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattggggagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggagatctgtgctgttctggctgctgtcactgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgc

SEQ ID NO: 703084 - DNA, 189 bp, Homo sapiens
acctttgagtgatggtcacatctgtatctacacgccttgtgaggctctgaggcgggtagatcacctgaggtcaggagtttgatgacagcctgggcaacgtggtgaaacccgtctccactaaaaatacaaaaattagccaggtgcagtggcacacacctgtggtcccagctactccgaaggctgaggcag

SEQ ID NO: 703085 - DNA, 237 bp, Homo sapiens
cccccccagggtggggtttttcccggggggggggggggggccccccctttttttttcccccctttttttccccccccccccccccccaagggggtttttttgccccaaaagggaaagggggggttttttccccgggtttttcccccaaatttttttggggcttttttgggggttttttcccccccccccccaagggggggggttccccttttttaaaaaccgggggggtttttttta

SEQ ID NO: 703086 - DNA, 177 bp, Homo sapiens
ggataaggaggtatcacatatgtaagcacattgttgagtctcaaaacataatatgcgtcactgtataatccatcacattttttcagcctctacatactagtggggtgtttcatatactcactagtcgagctgtataggtgactgccgtgttcgcccgccagcgtttttgttttttgg

SEQ ID NO: 703087 - DNA, 266 bp, Homo sapiens
  misc_feature (261)..(261): n is a, c, g, or t
ccgttagcgaggctgtagaagtcatcaaaaagctatggtgggagtagagtttgaagtccttgagagaggattatgatgctgaccttcattgctccatttgtagatttttgctcttctcagtttactcattgtcccctggcaacaaatcactgtacatctacaaccagttaccatctacactaagataacgactttctactccaactaatgtattgcatacgctcaaagtgtaagaatgcgtcgatactcaagcatttcatncgtcc

SEQ ID NO: 703088 - DNA, 551 bp, Homo sapiens
  misc_feature (66)..(66): n is a, c, g, or t
tttagcctaatatcccacttatccggggagtacttcccatggggtgtcttctgtgactgggctccntcgctcggatggatattttcaagttccttccattggtctataaatttcatgaagtcattgtttttaatagcccagtagtactccattgtgtaaatgtaccacattttctctatccattcctctgttgagggacatctgggttgttttcagcttctggctattgtaaataagactgcttttcacaacatacccaaacttatgggacataatgaaagcagtgctaaaagggaaactcatagttctgagtgcctccataaataaactggagagagcataaactagaagcttaacaacacaactgaaagttctataacaaaaagaagaaaatacacccaagagtagatggcaggaaataatcaaactcaaggctgaaatcaaccaagtagaaacaaagagaactatacaaaaaatcaacaaaataaggagctggtactttgagaaaatcaacaagatagataaatccttagccagactaactagaggcc

SEQ ID NO: 703089 - DNA, 362 bp, Homo sapiens
  misc_feature (25)..(25): n is a, c, g, or t
tcctgagagctggagatgatgtgtntccaataaagttaatgctgtcgtgcctgcattcagctataacggagattcaggccagtcatgcctgtgattggggttctcttcagagctctttctcgttttctgagaatctaatctactgttggttgagcttcttggctggacatcactaccaactagaagtggttcatagttttatccttcttgttgatagcagtggtgtctaggcaggataggtctttactggtcctgactgctgttaataattggcagcagcgctccccagatcccagaaggtccctgctggagtgtatccagtgcacctgtatggaaccaactagacttctctcctggttagt

SEQ ID NO: 703090 - DNA, 449 bp, Homo sapiens
aatgtgttggttgagagcggtgaaaaaagtcttggagagggggagaaagctgatgtgaatgtatttacgaaagcgaaatggcggtgaaaatgaaaacggatattgtcggagttcgggtgtagacggtgtagggcgaagaatacgtgcggcgtaattcgaaggcgtattaagatttcgcgagtgcggaatatttcggatataacaaagtacgatgtaatcgcgtgcgtaggcgatgataacgggaattttaattgattattcggattcgacgtttattcatttgagttattttaattatcttttcgtattgtttattgtttttaaagtatgttattggataatttataaaagaataaaattggagttttaaagcgtgtgttgtagcgttaaaatgtaaaagaaaaatgtaatgatgataagtgtaaataaatgaagtatttgtgagtgga

SEQ ID NO: 703091 - DNA, 819 bp, Homo sapiens
  misc_feature (448)..(448): n is a, c, g, or t
  misc_feature (566)..(566): n is a, c, g, or t
  misc_feature (621)..(621): n is a, c, g, or t
  misc_feature (627)..(627): n is a, c, g, or t
  misc_feature (632)..(632): n is a, c, g, or t
  misc_feature (656)..(656): n is a, c, g, or t
  misc_feature (666)..(666): n is a, c, g, or t
  misc_feature (693)..(693): n is a, c, g, or t
ggctcaataccccaagcaatacctgcaactgaggattcttcccgggagaccgcagcccatcggcatggctcaagagtttgtgaactgcaaaatccagcctgggaaggtggttgtgttcatcaagcccacctgcccgtactgcaggagggcccaagagatcctcagtcaatgtgcccatcaaacaagggcttctggaattggtcgatatcacagccaccaaccacactaacgagattcaagattatttgcaacagctcacgggagcaagaacggtgcctcgagtctttatgggtaaagatggtataggcggatgcagtgatctagtctctttgcaacagagtggggaactgctgacgcggtaaagcagatgtggagctctgcagttaaccacagatctcataggacaatgttcaacaatttctgtgacaggtcacaggacccaatgtgngagaaatcatatgaaaagcatagtgtggtctgtggtgtcatatggatcagaggcacaagtgcagaggctgtggtcatgcggaacatctgttatttaagatgggtatccagataaatcntgaacactggtgtattaatttatttagactaccagcaaagatttaagcatgcaantgtaanacatnttgataaaattacagcccctaaancaagagtgtntctgtgaagagctctacatttgaaaanttaagatccttatatgaagtgccgttctaaattggagatggtaattcctcatctctatgacccttaatttttataaactattaaaaaaaagaaaaaaatttggcgcccccagaagttaacactggg

SEQ ID NO: 703092 - DNA, 485 bp, Homo sapiens
ggatgctgtatagtaatgagctcaggaatcctcttacatacagtagctggggaaaaatgccaagaatgtagttgaagtcagaattggagttgtgaacaaaggacatggactggagaaaataatggaaaaggatgttataactcatttttatctaccgagacgattgaattgagagtaaaattgtacacagatgcatgttgctcatattataatagttatgggacacgaaatggtgcgtgtgtaaagcacattaaggatgtaaccatttaagtagtctggtaagcaaatcgaagactccagtactgtacaggtacgaatattgacatgactgcaaaaatgtgtatagcagtgggataccagcaatacaaagatgatagatgaaggtatatctaaaggaacaatagtagaaaaagaaaaatgagtaaaataactacaagatacatttacatagtgaattaggaaatgatataagtagtagataggaa

SEQ ID NO: 703093 - DNA, 359 bp, Homo sapiens
tgttgcaatggctgtacggtattggtacattgctatgaaaaggtcacaggccagccacagtggctcacgcctgtaatctcagcactttgggaggccgaggtgggtcgggaatttggaaaaccagccagaccaacatggagaaaccctgtctctactaaaaatataaaattagctgggcgtagtggcgcatgcctgtaatcccagctactcaggaggctgaggcagaagaatcgcttgaacccgggaggtggaagttgctgtgagccaagatggagccattgcactccggcctaggcgacagagcgagactccatctcaaaataataataaacagttagttaccagccattacactccgg

SEQ ID NO: 703094 - DNA, 880 bp, Homo sapiens
  misc_feature (4)..(4): n is a, c, g, or t
  misc_feature (88)..(88): n is a, c, g, or t
  misc_feature (97)..(97): n is a, c, g, or t
  misc_feature (126)..(126): n is a, c, g, or t
  misc_feature (135)..(135): n is a, c, g, or t
  misc_feature (151)..(153): n is a, c, g, or t
  misc_feature (159)..(159): n is a, c, g, or t
  misc_feature (163)..(163): n is a, c, g, or t
  misc_feature (165)..(165): n is a, c, g, or t
  misc_feature (176)..(176): n is a, c, g, or t
  misc_feature (182)..(182): n is a, c, g, or t
  misc_feature (184)..(184): n is a, c, g, or t
  misc_feature (188)..(188): n is a, c, g, or t
  misc_feature (194)..(195): n is a, c, g, or t
  misc_feature (201)..(201): n is a, c, g, or t
  misc_feature (205)..(208): n is a, c, g, or t
  misc_feature (225)..(226): n is a, c, g, or t
  misc_feature (232)..(232): n is a, c, g, or t
  misc_feature (247)..(247): n is a, c, g, or t
  misc_feature (259)..(259): n is a, c, g, or t
  misc_feature (274)..(274): n is a, c, g, or t
  misc_feature (277)..(277): n is a, c, g, or t
  misc_feature (281)..(282): n is a, c, g, or t
  misc_feature (285)..(286): n is a, c, g, or t
  misc_feature (289)..(293): n is a, c, g, or t
  misc_feature (297)..(297): n is a, c, g, or t
  misc_feature (309)..(309): n is a, c, g, or t
  misc_feature (312)..(312): n is a, c, g, or t
  misc_feature (343)..(343): n is a, c, g, or t
  misc_feature (413)..(413): n is a, c, g, or t
  misc_feature (455)..(457): n is a, c, g, or t
  misc_feature (480)..(480): n is a, c, g, or t
  misc_feature (482)..(483): n is a, c, g, or t
  misc_feature (499)..(499): n is a, c, g, or t
catntggcttcttcctgagcagggaatttgatgcttgtttctgcagaagtgccacttctagttgtagacttggacaattagtcttttngatcctggnattccccattggaatatgctgtattaaancccacttanagcttacctagaacannncctggnacangnaagcacaaatncaattncnttangaaganncctttntttnnnnacttaactctgtcaccnngctggngggcggtgggagggngtcagctcagtncaacctccatctccnggnttcnnggnnttnnnnntcancgtcccacaggngcncaccaccatgcccagttattttgtatttttngtacagacagggtttcaccgcgttggccaggatctctagatgttgtgatccgcctgccttagcctaagtnctgggattacgggtgtgagccaccaagcctggctgcattttnnntgttctcttaaacactgcctcantnntcttagcttgtaaganaaatcaagctgtgttcccccacaatcatagctagtaactagcttccattctcaaaccaaccctgacctcaacaccttggcaagcaagctctacagtccaccaaactccaatctcacccacctccctcaaacctgtctccatcaagttccaaatggcttaacggctgtcccacctcccctatgccagtaggtaactttaccttctagatgatcccccttcagtcccatccttcagggtactgaacatttatgttggcagccagtgcagggggcttgacaaagtttccattgtgactcacgtcatgaggcaagcaattctggcaatcttcaggcggaggtgcgccaggtagtagaggctcatacaactcatcagctagggata

SEQ ID NO: 703095 - DNA, 661 bp, Homo sapiens
gcggcccccgcgctcccgggtggcaagatggtggcgcgcaggaggaagtgcgccgcgcgggacccggaggaccgtatccccagcccactgggctacgcagcttattccaatcaagttctctgaaaggcaacaggcttctcactacctctatgtgagagcacacggcgttcgacaaggcaccaagtccacctggcctcagaaagaggactcttttgggtcctcaaatgtgccccccatactgcacagaggagagcctgtcccgccttcctgtccacctgtggcctcgtccagtcgtgtagagttgcaggagaaaggccggacctggttgagagccccaaaaggagtcaaggtcgaagttttttcatcccaaagccagttccgggtttccaggtagcctatgttggtgttccagaaagccaaagtgggggtgtcagcggctttggcccttggaagagggcccccttgcttgggtggtccaccagagaagccacctctgggtgaaggagttgcattcacaaggtggatcagtgactacgcagactctgtggcccgacccctgaaggccccctgagggtggaacgtgggacacgttcattggaggccttatgacccagaaagatcgctgaaggaagaaagctaaggggcaagggagaaggagggg

SEQ ID NO: 703096 - DNA, 343 bp, Homo sapiens
ggttacccaagcgggcacccgggcctcagggaccccttccccgagagacggaaccatgacccagggaaagctctccgtggctaacaaggcccctggcaccgaggggcagcagcaggtgcatggcgacgaagaaggaggctccagcagagccctaagccccaccctcctatgaggaagccacctctggggaggagatgaaggcaggggccttcctcccagccaccacagcgtggccatctccaccctagctggtcctatgtggaccccagaagcagcatcagctgtgacaacggttattccaccggagaccatgagctcttcaccactttaagctgtgatgacc

SEQ ID NO: 703097 - DNA, 245 bp, Homo sapiens
  misc_feature (156)..(156): n is a, c, g, or t
ccgtttggctgtcgatctggccgtggcctgacttcggaaaacccaaggggttgcgtgaaaatggcattgatctcttcagccttcgcatgcacggtggcataccagcgttgttcgtccgcatgcgcatggacggctccgtatgcccaacggagcagngtatcgaatagctggtgatttctgcccttgtagaccgtgttaccgggaacagcgatgcgagcgctttgcagatcgatccattcgagaaa

SEQ ID NO: 703098 - DNA, 710 bp, Homo sapiens
gggggagtctgggtgttgagtgcggggaccggagttcccgggccttttggcttctgtagtctgtacctttttaagcagtggaagtgcctgggtggattctccaatgctttattgttttcttgttacaattatttattttacttcccgtgatgtttcagcctcatcccttcaccatttgttgttgtggttgtttttgagacggagtctcgcactgttgtccaggctggagtgcagtggcgtgatctcggcccaccgaaacctccgtctcccgggttaaagcgattgtcgtgcctaagcctcccgactgccttcactgttttttgaaactttgtgttttgctttctaattggagtaactggccttggaacctgtagtcagtcatttgcctcaggtttacctgccagtcccaccagtctaaagcaagggaattgggacccccttgtcttgaatgggcctaagaggagccatcagttctccttttcccttcttggtggacagtcgtttaaaacttggagtttggactgtatgttcttaaatgttttcgttcggtggacaaagtgatctgggacatttaaattggaagtttggctttttccttgggtgactcccgcagggaatcagggcattctgacttaacatggcgagactgggaggcgatacctgctccgccacggccgaaaaggcacgacccgtccttggggacattttcc

SEQ ID NO: 703099 - DNA, 109 bp, Homo sapiens
gagtgagccccatggtgtggtggtaaatatgtagaggcagaatagtaatgaggatgtaagtccgtggtgcgattatgagaaatgactggcgccggtgaaagcttcaggg

SEQ ID NO: 703100 - DNA, 119 bp, Homo sapiens
caggttccaaagtacaaaatcaaccaggtctgaagggattgggtgataagagcacacagatcagtctttctttagggaaacagttccctccctgatgccctctggggtcacaatcagat

SEQ ID NO: 703101 - DNA, 374 bp, Homo sapiens
ggactcttccagttacaactaaggagataaagacatgcgtgaccaaaaagcaagatgagccctggatgacagcccatggggacaaagaaattggaggcagctctgagcagcagaaatcccatttctcacccgtgtcccagaagaaaacgcgtcagactgtggaagctgagcagaggccagttctgtgcctagtgtcagctctttgaatcagacacgagacgcttctgctaatggctgcaaggaagactggcctttcagtgcatctcagcactctcctcctgcctaacttttcttttttttcttttttttgaaacagggtctggctctgttgcccaggctggagtgcagtgggcaacagagtaagagtccgtctc

SEQ ID NO: 703102 - DNA, 471 bp, Homo sapiens
cgctaactactaacccccttccgctctcagggctcgttatctctggtagagaatatcaaggtgtcttctaatttccaatcattctccaggagccccagttatcattatcattgggtcactccctctgaaaaaaaaaaaaaaacaaaactgggtttggtttccccacaacttacgggatgaggccaaaaattcttacaagcttggcttatttaagcgggtaagcttatatcacgtgtctccacttccaggaaaatatccccaaatgcacgggtatgtgcttccagatctatacacaagagttgtccttctgccaagagcacccttcaggttcttctcaaaggggaaggcaacaatttttccttcacgagtcacacatctgtcatctcggcttcacaaagagacacaaattactatgtccccccagcattggtcatttagaataataatcggggtgggtgtattggtgtgtct

SEQ ID NO: 703103 - DNA, 135 bp, Homo sapiens
cccgtagcgtcatggtagctagtgggacgctgtatgattcctcactacggcctgaggttgtaggagctgtcaggcaagtgtgttgttagcagtatgagcccgggctgctgtggtagctaggtatgcttcctggga

SEQ ID NO: 703104 - DNA, 266 bp, Homo sapiens
cgactgtcagaatcagcagggatgccgagtcaaactcaggacacttgagcttgtggagacagaccagcaggagatagaactcccagaagtgtgcagctgtggtggtgcttctggagaagagcagagattacacatgccgtgtacagcatgaggggctggcgaagcccctaaccctgagatgggagccgtcttcccagtccaccgtccccatcgtgggcattggtgctggcctggctgtcctagcagttgtggtcatcggagctgtg

SEQ ID NO: 703105 - DNA, 576 bp, Homo sapiens
atcactcgtatctacacgacaacgctaccttacggctgttagccgcactctcccacctattgttcctactcaactacggatgcatgtattttgcccagtcactagtgaggtccttcatttcaacgtgactttcccctaattctccatggactacatcactctagacctaagacctacgccaaatatccattgtcactatcaatactgtcattccaggcagttaatattcttaacatgtgtctttccacacatacactttctcggcactatccggaatgccccgtacgatgtactcggacgtatcctccgatgcatacaccacatgaaacaatccttatcatctgtaggttcattcatttctctaacagcagtaatattaataatttttcatgatttgagaagccttcgcttcgaagcgaaaagtcctaatagtcgtagaaccctccataacctggagtgagcgtatatggatgccccccaccctacacacattcgaagaacccagtatacataaatctagacgctaaaggacggattcgacccctcaaatatcgcttcagccaaccactgctctgc

SEQ ID NO: 703106 - DNA, 714 bp, Homo sapiens
  misc_feature (55)..(55): n is a, c, g, or t
ctttcccactaattctgcccttttaaacgtccccttgtgacgtctaaactaagangtttttacaccatgcgccggtgtataacctcccttctctggggatcaacaatcgttttatacgcgcctgttaacacaacgttccccatgaccccccttttatacccctataaggccccacctctttatcaatataatcaacagtcactttacacccttaaacattttacgtttttaaaggtacttagtgactaaaatcaattattcacgcgcatctctatttaacaacaggatattatcaccccaagcgacgtcctaatgaaagccctgtcaatcccccaccccccatcaaggaaattgtcggcctccttttaagtccctttcgttaccccactgtcatacctatctcccacactcccttcaatagtaaaacatacttaattattgagattgtgctagtagtaaccacctctttgaggacataattcgaagttttcaatagtggtgcaatctgcgctaataccaccagtaattccggtagaggtcgaatggtataaagtctcgacgactagttcgggggaagttatataaagcgttaatcaaccacactcttctcttcagaggctacagcaaaagacgcatctgttctaccccacgaacctaggggctagccccgagcagtcaatacgtacccccgtttcgccatcaattgtacgcgca

SEQ ID NO: 703107 - DNA, 314 bp, Homo sapiens
gtttcaagagtgaaactccgagtcaaaacagacggacgaacaaacaaacaaactccatcttgcccgggcgtgttggctcatgcctgtaattccagcactttgtgaggccaaggggggcagatcacgaggtcaggagtttgagaccagcctggccaacatagagaaaccctgtctctactaaaaatgcaaaattagccaggcatggtggtgcatgcctgtagtcccagctacttgggaggatgaggcaggagaattgcctgaacccaggaggaggaggctgcagtgagctgagatcacaccattgcactccaggg

SEQ ID NO: 703108 - DNA, 817 bp, Homo sapiens
tacagtagggactaaaggcatgtaccaccatgcctggcttatatatacataagtacatatatagatatatatgtaaggagagcccatcatatatatatacatatatatatacacatatatacatatatatacacacacacacagtacaagatatccctatgtcgcccaggttggtcttgaactcctggcctcaaaccatcctcccacctcggcctctcaaaatgctgggattacaggtgtgagccaccatgcctggccttaagttagtattgatggagagattaaatgcacttgtatacctgagacttttacaatcgatatgagtttatactaagtattctatattacttataatataagacattaaggaagatttcatttcaaaatatcagagggggaagtatatatttcataaacctattagataaaataacaaatacacttctacactctgcattaacttagcatctataatttctaagagctggcgacagggcatggagagtattacactgcaagcactgccatgcttcaatacttggcaccattcacaacggtgtcctacacttgaacataatttcatttcaccgacgccaccgcgaagcacgtacgcctaccaattcatccccacatcaagagacggacgaacaagactggtagaagcctacccgacgccaatccggccgggggtgggacctgctcacaactcttacacgcaacggcccggacccagtcggaaccagcaggaattgcccgacaataccacaggcacacaccccgcagaccacactaaaaagccaacccacaccaccccccc

SEQ ID NO: 703109 - DNA, 114 bp, Homo sapiens
gcactgcaatccagcttgggcacacagagtaacacctatgtcactccaaaaaaattacttaattaaaataaaatacaataggatacgtatcatctatagtacataacgttactc

SEQ ID NO: 703110 - DNA, 304 bp, Homo sapiens
aaaaaaaagaaaagaaatatggagccctcgtagtagagaaggtaagccatacacagaaacacctctcatgtgagataaataagagaagtactgagtatgtttgggaaatggagtagtccatcaagtttggtagagcacagagtatactggggaaatagtgggagattaaaatggaaacattgtcctgaggtctggctattatggaccttgatttaaggactctgcatttgaactttactcagtggatgatgggaagtcactaaaagtttttttttttactttttaacagtggaatgacaatcag

SEQ ID NO: 703111 - DNA, 174 bp, Homo sapiens
tgtgtagctaattcgaaagggaagcaagggtgtcacaattaacaagggtgcccaattatattgttcccatacatcattccaccactccaataggacatgggcttatagagaacagagtcaagccttgtggttcctgttgtgcccagcacacacagcattgtgcttggtatatag

SEQ ID NO: 703112 - DNA, 318 bp, Homo sapiens
  misc_feature (89)..(89): n is a, c, g, or t
  misc_feature (101)..(101): n is a, c, g, or t
  misc_feature (107)..(107): n is a, c, g, or t
  misc_feature (113)..(113): n is a, c, g, or t
  misc_feature (119)..(119): n is a, c, g, or t
attgttatattaaggaagatcttgatccttgtgctcgtccaaaaagacgtcagccttacaacgcaatattttctccaaaagggaggggncgggagacatanacattnaaacanaaacanaaggatgaaggacagttttttccttcttagttatttatagtgaaagtgtggtactaaacattgatttttttgatcttctgtgaatggatttataaatcagttttctattgaaaatgtgttgggatagttggcgttttgcacctttaaaacaataagggcgctttcattttgcactctaacttaagagtttttactttat

SEQ ID NO: 703113 - DNA, 1222 bp, Homo sapiens
acttgctggtctgatccatgcacatggccaggctgctaggcctctgtgcctgggcacggaagtcggtgcggttggccagctccaggatgacccgcctgggaccctgctcacaaataatggtggccctggtaactggcctccacctgacgggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggcaaggcggcaggaccgggagcggctggtggccactggctgtgaagcttcatggcaggtatcgatatcctagtctccaatgctgctgtcaacccttactttggaagcctaatggatgtcaccgaggaggtgtgggacaagactctggacctcccctcgctgcaggccccagccctgatgacccacggcctggtgccagaccctggccacacgcagggaggcggctcacgctggtgactcgctgtcttccctagcagccttcagtccatctcctggcttcagtccttacaatgtcagtcacacagccttgcttgcgcctcaacaataccctggacatagagctggcccccaggaacattagggtgaactgcctgcacctggacttatcagactagcttccgccggatgctccggccttcgcctcggcccagcggacacgctgcaagcaaccctgcggatcagcaggttacggcgaccccgaggcctgtcgctgccctcgcggccttcctgcgcccgccgctcccgcttcctctctgcgcgcacccgctggcctgcctggctccgaaaccccgaaccggcacataagaccgcgcacacaacccacaagcaccagcagatcggccctcaaccccagagaacgcccccagcgcttaccgccgtgtccctaccagaccacttgaacaaccattaggcgtacccccacacacgccacgcccacgaaaaagacccgccactcgccacacgagccccacacgccaacactgagacaccgcccatacggcccccaacaaagtacgccgtacacacagccagtacgacacactcaggaccggacgacgagcgcaccacgaaccgcactacaaccgagagcagtcctatcagccagccggagcccacgcacgcaaccccacacaaccaccaccaccccc

SEQ ID NO: 703114 - DNA, 172 bp, Homo sapiens
cggaggttgcggtgagccgagatcgcgccactgcactccagcctcgtcgacagagtgagactccgtctcaaaaaaccaaaaaaacaaaaaacagtcaatggcattaaatataaatacatttacagtgttgtgtaaccatcaccactatggatcccccagagcgccggaattc

SEQ ID NO: 703115 - DNA, 233 bp, Homo sapiens
  misc_feature (165)..(165): n is a, c, g, or t
ctctagtcatatcatagcaaaagtgctaacaaccaaaggcaagactgcattttttttttcaactttcaagttcaggagcacatgtgcaggattgttacataaggcaaggcgtaccatgagagcctattgtacagatcatttcatcacccaggtattaagcctggnacctattagccatttttcctgggcctctccctcataccaccctgcatcacttattaggccagagtgtg

SEQ ID NO: 703116 - DNA, 266 bp, Homo sapiens
tcgatctatagcaggatccccccctcaaacccagtcaagactaacggttttgttaaccacctatatatttgcctctctcatactgaaattttctaggttaagtattttatggaatacacatactgccagatatttttctttggttatctgtcatatactgcatacattacttgatacaaatataaaaatgttttaattatcctgtctggcataatttccgtcagtctcactgggttttcgaggtggggtacccgagctcaaatttc

SEQ ID NO: 703117 - DNA, 117 bp, Homo sapiens
  misc_feature (3)..(3): n is a, c, g, or t
  misc_feature (39)..(39): n is a, c, g, or t
  misc_feature (109)..(109): n is a, c, g, or t
gangtgacccatcatcgtatttaaacctcttctattccntgccataacatcgccacgtatagctggaattaagtgttgtcttggagctgttgtacatttaagaataaanttttgtac

SEQ ID NO: 703118 - DNA, 599 bp, Homo sapiens
  misc_feature (84)..(84): n is a, c, g, or t
  misc_feature (253)..(253): n is a, c, g, or t
atctaatttggaaatttgacttgttagtttctgtgtttgaaatcatggttctagaaatgtagaaattgtgtatatcagatactnatctaggctgtgtgaaccagcccaagatgaccaacatccccacacctctacatctctgtcccctgtatctcttcctttctaccactaaagtgttccctgctaccatcctggcttgtccacatggtgctctccatcttcctccacatcatggaccacaggtgtgcctgtntaggcctggccaccactcccaacttgacctagccacattcatctagagatggttcctgatgctgggcacagactgtgctcatggcacccattagaaatgcctctagcatctttgtatgcatcttgatttttaaaccaagtcattgtacagagcattcagttttggctgtggtaccaggggaaaattatcaggatataaccacattcaggtgtggtttttttccatctacaggcacattttaatgggatttttcaaactggaatcatctggtatttcaatcagggtcagcttttagggggagtcctaagggcaaatattttatccggtggtatatgtcagatgccgt

SEQ ID NO: 703119 - DNA, 193 bp, Homo sapiens
agtgactctacaggatcttaagaagacgacagaagggagagggcaggatggagctgccctgaatcccatgtggctgctcgggcagaggtctatctccggaagtcacctttgacatgttcacttcctggcctccccagcaccgggtgctccctgagggggccaccttgtgattgaggaagaaggatgaggtgca

SEQ ID NO: 703120 - DNA, 379 bp, Homo sapiens
  misc_feature (365)..(365): n is a, c, g, or t
  misc_feature (367)..(367): n is a, c, g, or t
acatctatcatattagttctgtctctctaggaaccctaatacagatggtatcacccatgaaaatttccccaacttcactagagaggacacaatattcaaattcagaaaatgcagagaacccttgtgagatactacataagatgaccatccccaagactcatagtcatcagattctctaagatcgaaatgaaagaagaaaggttaaatgcagctggagagaaggtcacttgcaatgtgaacaccatcaggctaccagcagactttttgacagaaaccctataagccagaaaatattgggggcctatattcagcattctttttttttttttttttttttgagacagagtcttgctctgttgcccggntngagtgcagtggc

SEQ ID NO: 703121 - DNA, 400 bp, Homo sapiens
  misc_feature (1)..(1): n is a, c, g, or t
  misc_feature (175)..(175): n is a, c, g, or t
ngctgtgaagccctagctgtgaaattgatgtgaagaatccaagtgaagataagaggggtgggggaatgccttgcaggggctcccacaagaccaagccaatgatgctggccctagagacccaccctcccacggagaaaggggagcaagattaacacaaagaaggcccagcgtgggngcacgcctgtcatcccagcactttgggaagccaaggtgggaagattccttgagcaggagttcaggatcagcctgagcaacacagtgagatgtcatctctaccaacaataataataatttttacattagcccagtcaagtgcacgtgcctgtagtcctagatacttgggtggctgaggcgggaggatctcttgaacccaggaattcaaggtcgcagtgacctgtga

SEQ ID NO: 703122 - DNA, 144 bp, Homo sapiens
tgctgactctagacggactcccggccgttgtcagtgggtttgactgtggtgactgctggctcgggaagtctgcgcatgtgtgcaccatttcccgtgaacacccagtggagggtcatgcctgatctgtacttctacagagatcct

SEQ ID NO: 703123 - DNA, 142 bp, Homo sapiens
gtcctctgacaatattaggggggtcctcttctcatcagagctgcatggtacacagctggcattgtggtaggctctccactgtggccatgtgtgcgcccagtggaaaggtttctgaacagggtgcaccctggagtggcctggg

SEQ ID NO: 703124 - DNA, 458 bp, Homo sapiens
ggcgaatcaaggtggacattctattcccacagagcggaaacccagaccccaactgcgtcactgtgactggggctcccagagaatgtggaggaagccatctgaccacatcctcaatctggagtgaggaatacctatgctgatgtgatggacagtgaggctgctgctgtgtatacatggaacccccagcacacgaagaggccaatggcaccttccagaggctttgtggtgcgggacgcaccctggaccgccagcagcagtgagaaggatcctgacatgagcatgctctgaggaatttcccagctttgtggctcaggtgtgatcccaagatcctcccttggggccccaaactgataattgatcaaaaagaacagaaccctctccagcctgctgacccaaacccaaccacacaatggttcgtctcaattctgaccgcgagagggtacctgagatctaattcg

SEQ ID NO: 703125 - DNA, 568 bp, Homo sapiens
  misc_feature (541)..(541): n is a, c, g, or t
  misc_feature (550)..(550): n is a, c, g, or t
tgagatctcggagctccggcgcaccatgcagaacctggagattgagcggcagtcccagcatcagcatgaaagcatcctggagaacagcctggaggagaccaaaggtcgctacggcatgcagctggcccagatccaggagatgattggcagcgtggaggagcagctggcccagctccgctgcgagagtggagcagcagaaccaggagtacaagatcctgctggagcgagaagaccgcggctggagcaggagatcgccacctaccgccgcctgtggaggggaggacgcccacttcctctcccagttctctctggatcgcagtcatccagagatgtgacctcctccagccgccaaatccgcacaaggtatggagtggcacgatggaaggtggtgtccacccacgagcaggtcttcgcaccaagaactgaggctggcccagcccgctcaggctaggagccccggtgtggaaacagatcccatggaagatcccctctctgcccagcaatcacagctgactgcttaccccgtcaactaacctccgcnggcaagtanatcagtattccctgggtt

SEQ ID NO: 703126 - DNA, 212 bp, Homo sapiens
tcatcgactcctgtccaacatctcatccctcgttccagcatctcattcctccttccatcatctcatgccccttccaacaactcatacctccttccaacattcatccctccttccaacatctcatagctccttccaacatctcatgcccccttccaacatctcatcacacctcccaacatctcatgccatgagatgttgggaggtgtactgag

SEQ ID NO: 703127 - DNA, 122 bp, Homo sapiens
tcgcaggaaacggtgcgggagcgcacggcgccctctcacttttgacttgcgtctcatactcagcctgcagccaccgctcccgccgcagcttaccgtgagcggccatggcggccttgcggccg

SEQ ID NO: 703128 - DNA, 157 bp, Homo sapiens
ctgtcactgtgtcaggtagagccatgctcggacgcacacagactgtacgcacctggacacagcacatctctagcaaatttagcctattcctattctgtaggctattccttaccacctgtaatctatgaccatataccttggcagttgaactattgtt

SEQ ID NO: 703129 - DNA, 529 bp, Homo sapiens
attcagtgtaaacgacggcagtgaatccgatatgtcatagtcataactgtttctagatgtttatagcatgctcagacttcccacctcttatctttctactgagacgagatatttatatacccaagttatttccatcattgattttttatagagtttctgtgacatgaagctggttctcaccataaaagataagactggaagtggctaggtggggtagcaggggtttggcgcatgttgagacagagaaaaacaatcaaagaagactcttggattatattgggtggtggtctgattcactgcagaaataatacacaaaaggaaaaaccagcttcagaagcagaagagaattgacatagttttggaaatttcaaggtagagggagctgcaggacattaaggagtgggagtcttagagtcaggctggatatatgtgttagatgctataacgaaatattaaggaaggagataccggtttggccataactatcatgtgtgtgatctgtaaggctactgaagtgaactacattacc

SEQ ID NO: 703130 - DNA, 157 bp, Homo sapiens
cttatggcgtagtaacatcttccgtgataagcccaggaggagccccctcgtaaaaggacggcaggtgcttgagctgctgcagctgctgcgcgtcgtgtcgccgccgcttatgctcccgacgtcgctgcagctcctgctccggcggctcacgcggccg

SEQ ID NO: 703131 - DNA, 152 bp, Homo sapiens
catctttatcaatccagcctatgttatttaagtgttaattttctccctttcttgaacttatagaacctctgggccatactttgaagttaattcttgccgggtaaagaccaagatagctccttcccagggatctctgtaatctattacttcta

SEQ ID NO: 703132 - DNA, 163 bp, Homo sapiens
ttgctctagaggatgccgagtgtcttaagagcccgcctatagaagctagatcccccagtcacccacgaccttcgagtctcccttgaagagatctactgtggctgtaccgactgaagatgaaaatctcccacaagcggctaaagcccctacgaggccaaggtac

SEQ ID NO: 703133 - DNA, 941 bp, Homo sapiens
aacgcaggcgccatacttcctatgctacaccctagttaggctcgcttcccctagtcatcgcgctgaacttacactcacaacgctccgtaggcgtctctaaacatgctagtagtcgactctcatgccgcagaagaactatactagaactgcgctgagaccaaacaacttgagatagtgacttagcttgacagccgaatcagcgttcattgagtaagagataccatcataggtagggacgtcgcaacgttagggacgtccgctaaagcccatggtcggaagccacccgatccgcttgtggtcgaatagtacattgcccggcagtacgtcttaagaataggccgggtatgtgtgtagatacagccctccattatcgattctcaacgcccgggaatcaaaagacgaatagccgtaactcattcctatgtgctatccctatgaggcataactgataatcaggctccagctgtgctatcgaggaagacggacctagaaagtcgcgtcatagcatgctctgtcaatcagccacgatggccctcgtagtaacagcatgctcgatccaaagcccgctgaagcgttcaggggcgcagtcattctcataagtcgccgagggcttacatcctcgttactatctggctagcgaatctgaaactacgagacgcacgcacacgacgcatcataatcctctgctcaggacttcatagatctaggtcccacggaatagcttgttgatgacttctagacaggctcggtaagactggccttgacgccccagtattaactatgggaaaactctctgggtgaataacccagtcgcctgatcaagtatcactctcctactaaggaccccacactactggtgacagccttatccctaaattcaaaaccagggggctccccattaaataactctctgaaaacccctgttaaaaccctttctaaag

SEQ ID NO: 703134 - DNA, 116 bp, Homo sapiens
tgggttactaggtatgctggttgctgcctgtatacgacgccctggccggggagttcatatgcctctggtgtggaggcccgccaggccctcttgaaagcaggtgcaagcggccgcaa

SEQ ID NO: 703135 - DNA, 167 bp, Homo sapiens
gggaggtggaggttgcagtgagccaagatcgcgccactgcactcaagcttaggctcagttctgttgatgcccgtcaggaacaggatggtgggccaggaagaggcagagggagagctctagatcgagggaggtgccggtgttctggatgggccggcacaggaggaagg

SEQ ID NO: 703136 - DNA, 100 bp, Homo sapiens
atagcgtaaaacagccttagggtccgacatcatggggaccctcacggtcctgtcttcatccagaaagacttccctcgaggatttctacttggatgaagag

SEQ ID NO: 703137 - DNA, 995 bp, Homo sapiens
gttctataatctcagagcgtggctctatttatactaggcctactaatctaaaaatctaactcatataccatttgatgggtacgagtgaactcttcgacataagtccataacacaggagtacatacagcacttggcctgatggtcttcgaatcgggatatatcctatataatacctcagaagtgggggctgcgcaggatttttctgagccgtggaccactccagcctagcccctatccctcgaattaggagggcccctggtcgctgagtcaggctatataacccgatgaatcgcctagaggtcccactcctagagactatgcgaattagtcgcatcgggagtatcgatgcagcggagagctcactcatgggctgttagaaaataggcgaaactacctaattgcaagtctacatgggtattacggtaaaaactggtctctatagttgaacctctccgtagctaaagcctcaggaggtaattttcgagtctcccttgcaccatttcggacggcaatctacggttcaacaattttttgtagccacgggcttcctgggaaacttcaccgtcataatggtcaactttcctcactatctgttcatccgcaactaatatttcactttacatccaaaacaccactttggcttcgaagccgccgctgatactggcatttgtagatgtggtttgactatttctgtatgtttccctctattgatgagggcctaacaccacacaaaccaagcacgacacgaaaacacacaaaaagaggggggggcgtcaaatacccgggggccagttcagctgccccgtttggcaagggcccaaggggcgaaaagcgagcggggcggcaaacagcggtgggaacgcctgggtttggaagccacttgggggttatgcaccccggaagccgggaaaaaggatggaacggcggggaatgtggttacttgcgaagaaaaggagagaaagtaggactataacaacaaagaaggataataatga

SEQ ID NO: 703138 - DNA, 128 bp, Homo sapiens
gccccccccccccccccaggggggcccggtaaatgtttgggggaaagggggcaaaaaggtttttcccccttgtttttcctcccccccccgggggccccttttgatttaataatttggggttttcccca

SEQ ID NO: 703139 - DNA, 245 bp, Homo sapiens
cgctcggagatcgagccccgggctcgcaaccgttgtcgcttccggcgccgcggccagaggccggaccacggcttcccgcgcccgcccgcccgccctcgcccgagaaagggcccgcgccggaccttcgaagccgcggcgggccccccggcccggcaaggggatggggaaaagcgggccgggaggggagggagccaacccgggagcccacccacccgcccgcccgtcttcccacggtccgccggggg

SEQ ID NO: 703140 - DNA, 130 bp, Homo sapiens
tctgtgggcaaatttatttttgattttgaagaatctcttatcaggagctttaaaaaacaggattttagttctaagtttttttctcaaatgcttgagaccatttctttttgaagtaatcctttagaaagag

SEQ ID NO: 703141 - DNA, 862 bp, Homo sapiens
agatcttcccttccagacgcttcggggttaagctgccgtccgcgagcactccaggaatttccagatccgctgttagccccatgacgcggctgcgtgctaagagcggaccccgacaatttctactctaattcttctacgacggactgcaccgccgtctaggaccccgtggaggaagccctcccttgctcctacaccaacaaagatggcaaataatacatgaagcctacggttttccagtgtgggtgactggcactaatgggagcgcattaaagcggagagactctgtgctgcaacacgtctctagcagctgtcatcgcctcccgtgcaagaaagacagtgtccagagaatggccgttggcggaggaggggcagggtcctcgcctcgacccaggcgcttaggcccaaacgtctgcgccgttaatggaagaccggggtgcaagggccacgcaagcgacggaaacagccagaagatgtccctgggacgagctcccgccttcgctggtgggtccgtaaatccacgaacaatgggcccgctcggtttccgtctaatacgacgcgcagggcggaagctccgactccgcacatgacgtatattttctgcgcttgcagcactccggaagtgagaagtttagcgccagtggtgatgccttggttggttacttgctatccgtcacgctgggcgatctgaaggcgttaagcattaaaacaatgttgcaaaagcgccttcttggtggagtaacgggcttatgtgaaaggttgagaaagggtctcacgctgtcgccaatactgggagtccagtgggcattcttagctcacttcagcctggaacatcctggtgaccgagctccagccaactttccag

SEQ ID NO: 703142 - DNA, 219 bp, Homo sapiens
acaattctcatcgttcctcgtcattcctcatcattctccttcttcgtcctcctccatcattcatccacagccatccacctcgtgcatcttgagtcaggtgcttcctggtcctcgcggtcacttgcctttctgctgttattaaaatgtggcatgagcttgaagacactctctcggtagtcattcaggtgggtgacctcacagattaagaggtccaggctt

SEQ ID NO: 703143 - DNA, 683 bp, Homo sapiens
atagagctaggtactgaggcctgggtggttaacacaacatggcggatgacgccgcgtgcagctaagggggcccggaggccctggatggccctgggataggggaaccgcggtggcttccgaggaggtttcgagcatgtggcattcgagggccggggtcgcggccgtggacggggccaggggacacagaggcctgcgagagctcgacggagtgcaatggccgaggataatggcagtggattgccctgtcacacaaagtttgggacctgcattggtcaaggacatgaagatcaagtccctggatggagatctatctcttctcccatgcccattaacggaatcagagatcatttgatttcttcctgggggcctctcatcaaggatgaggttattagaagattatgccagtgcagaagcagacccgtgcctggccagcgcaccaggttcaaggcatcatgtatgctatcggggactacaatggccacgatcggctcatggagtgttaaagtgcatccacaggaggatggccaccggccatcacgtggtgagccaatcataccatggaccaagcatctaccactcgtccccgtgaccgcaggcaggctactagggaggaaaccacgatcggccaagcacccacacatgtccccttgccaagggtgacatgggccgactgcaggcatctg

SEQ ID NO: 703144 - DNA, 124 bp, Homo sapiens
ctccttaggggtatatactgccccgaagggtccgtcagtgaagaatggctttgtggcaggaatagcaccccatgggggccaaagtccgtcagcatctgcactgagccccgtgtactcgtccaga

SEQ ID NO: 703145 - DNA, 446 bp, Homo sapiens
tctgatcttttaagcattcttgcactggtggcttgttagcggtgaattctctgtttgtctgaaaaagctgtatcttgccttcgtatatgaagcttagttttgctgaatacaaaattctcagctgataattgttttgtttgaggaggctgaagatagggttccaatcccttctggcttgcagggtttctgctgagaaatgtgctgttaatctggtaagttttccttttcaggttacctggtgcttttgtttcacagctctttctttcatcttaactttagataacctgacgacaatgtgcctagatgatgatctttttgcgatgaatttcccagatgttctttgtgcttcttgtatttggatctaggtctctagcaaagctggggaagttttcctcaattattcccccaaatatgtttaacaaacgtttagatttctcttcttcctc

SEQ ID NO: 703146 - DNA, 583 bp, Homo sapiens
tccgcgtcggtccccgcgcgtggcgccaacgaaggcctatactgtggggggaaacacacgagatctgggcacagcggcccacacacactggtcccccttgcaaaaggttgaacacaggccgcctgcgggctcttgttgctgggtaacgccctctaatccctgcgacacaccacaggggcacacatggcgacatctgtttctcgcacacctggtgcgctatagaaagctgtctcactgaatggcctggtatatcgagatgagctgcgtaacacacctcaagcccgcgggcgtgcacacatgccacacccctgggcaaacttctgccaaaggccacccctttgagatgccacatttttaagagcctatcacgctaacctgagacccccgagaccttctggagaaggaggagactgtagattcacccaaagtttccctatatcacaggaggttcacctgagccacacctcgtcaaagagacccacacacccacagaggtttccgtgcacgcggactcagggtccagctgggggtacaaaaaagggtttttaaacaagaaaaataaagtgaaataagcgtgaaacca

SEQ ID NO: 703147 - DNA, 301 bp, Homo sapiens
tctaccaattatttagagagtggtgttgaaatctccaactatgctatcctcccacctcagcaccccgagtagctgagactacaggcacatgccaccatgcctggctaaatttttttcttttttttttttgagggagtctcgctctgtcacccagactggaatgcagtggtgcaatctcggctcactgcaacctccagtctcgctctgtcacccagactggaatgcagtggtgcaatctcggctcactgcaacctccacctcctgggttcaagtaattctcctgcctcagcctcccgagtag

SEQ ID NO: 703148 - DNA, 175 bp, Homo sapiens
gcctggcttttcagctggttcttggattggaggagggcagacaaggggtgttccatggtgatctccgtgcagctgtccttgcccctttcacccttgacagcgattagcccttacagttcgccttccaccttaatgcctccctttggcttgagaaaaggagcccatacctcctttt

SEQ ID NO: 703149 - DNA, 178 bp, Homo sapiens
acttcggactttccctgcctcaatgcagctggtggcctacgtgcatgctcatcatgccgggctcagacctgagagcgccgtgcccaccttcatccatggcccagctggagcactcggaacccattgaggcagagcctgtggctctgtcaccagtgccagatctaaaatcaactccagt

SEQ ID NO: 703150 - DNA, 1089 bp, Homo sapiens
tgaaacggactcttgtactgtcacccaggctgaagtgcagtggcgcaatcttggctcactacaaccatccgccctccgtgggttcaagctgattctttgtgcctcagtccttcccaagtagcagggaacttacaggcatgtgccaccacacccggctatatctggatatattaagtaaagacagggctctcgccatgttgaccaggctggtctaaactcctctgggaatccgcctgtctgggccttccagggatgctaggaatatacaggcgtgacccagttggaacctggccttgtttcggcttaattttatctcttacatgacgtaaagcgctttggtcaaacacccaaaacatactggccttgtacctgggtggcgttgggttccactcaggggatcacacacagtgtccaactgggcttgtacaacatgggtcgccttcgagatagggtagagttggcgataagttatgtctgctcgtgtactgcagcttatacgccacacacttacagtcgcatgtgcacatcacgttccagtgcccacacgccaatcaacaacagttctaacaatctccccaacatgcctgccccaacaagattacaacacctctcaactaaaaacccaggttaaaaacttctcctggccctaagcggctccactattgaacaacaaacactgacattgatacacctaaacctatgtgaccaagatcttatcaccagcgggaacttatctcaccctcactcccgtggacaacctacttgttgaacaacgtgatacattcacagcgacttcacaatatctgaacacatcgccacatcgtcacacgcattatgtaccacaccacactgtgccccgtgttgctccacatttccctggcggcatctaccacctacttgttttctacagcttactaaccaaacaaaagaccacaaaagtcacagggtgtcaaatatcaggcgcgccattaccgttgtaaccgcccacactcgttaacaaccttcatctgcccaaggctaacacaacgagtacatatgcgtgagaatccaacaattcattcaacacaaacgattccctcttccaaccac

SEQ ID NO: 703151 - DNA, 293 bp, Homo sapiens
gattaccggagcttacgtgcaaagtcatgatgacggtgacttctaaacacagattttcaatgtagatgaaatggccttctattggaagcagatgccatctaggactttcatagctgaagaggagaagtcaatgtctggtgtcaaaggacaggctgactcttgtgttacgggctcatgctgctagcaagtttaagttaaagccaatgctcatttaccatcctagggcccttaagaatcatgctaaacctactctgcctgtgctctacaaatggaacaacaaagcctggatggta

SEQ ID NO: 703152 - DNA, 208 bp, Homo sapiens
gtgtattctgtacccctgtgaatggagggggcatgtaggaacaggcttggggatctcagagaatgggacagcccctccgactgcttgttcttgcggaccctggaggccagccctgagtggccatctccaaacacctccctgcactcccgtccttggccgttggcttgagcactcgaagtgtagccaaatggcacttgatcctggttct

SEQ ID NO: 703153 - DNA, 1348 bp, Homo sapiens
  misc_feature (67)..(67): n is a, c, g, or t
  misc_feature (104)..(104): n is a, c, g, or t
  misc_feature (140)..(140): n is a, c, g, or t
  misc_feature (228)..(228): n is a, c, g, or t
  misc_feature (306)..(306): n is a, c, g, or t
  misc_feature (472)..(472): n is a, c, g, or t
  misc_feature (901)..(901): n is a, c, g, or t
  misc_feature (1058)..(1058): n is a, c, g, or t
  misc_feature (1116)..(1116): n is a, c, g, or t
  misc_feature (1201)..(1201): n is a, c, g, or t
  misc_feature (1213)..(1213): n is a, c, g, or t
cgctacgaatcgagtcgtattgcatatttattatgtcgacgacgcacagaacacagagccttcggangcgcaaaacggtgaggttctatcttcctcaagagatngcagtataagacatcataatactagtcccacacatntatatcatatagcaatacctagttaatcataatgcggcctgcgctagtcgatagcctaatgtgtctcgtagaatcctgacgtagtcantgatatgcatcatgtactatgttgtatcaatttccactcgtacgatgaagtagagacatcatgatcgccggatctaanatatatatcgcagatacctactcgtgtgtgcgcagtcgttgaccgaccatcgcaaacatagccatcaacagttgtattcagtagagaactcaatacctagtggattgcatcacaccatggtcctttatttattgaattcgagcaacatcattcatagagcagaaangtcgttgagtagcgtcgtgaccatatgcggtaacgtactagttgatatcaacgctactctctccacgtacgtgcgcagtgtgttagctgacaaccagtcttaacgaattctacacacacgcgatggtcatgcgcgcctaacattatcgcctttgtgtgtcggctattatatactattatcctccgtagaatcgagcactgttctacatcgccgaatgataatctctaccgaatcaagcccatatctataccgacattattaccacctcagcaatatattaaatgcacgcgctatcatgatacccgatgtctcgttctgcagtagccgtattcaccaacgcacgagcgtttacatactccgtccctccaccaatacgagtagccttcctccgtgtcatcacgttatggtcaacaactacagctagtgcantatagtcgtgtgcagatagtgtctattgcactccaccgcataactactcaacaccctacatcagagcaccgacaattctgtacatatgcatccgtgttgcaatatacacgcgttgacccatgtgcgagtatgatctagggcagtaatgagttcaccntagcaacgaacgcgcatctacccatccgcacgactccgcgcgcgcagacatttacganctactacataaatagtcttgcccgtgatatcgcagtttgctgctgtcggacccaccgagatctactgttaccacgctactcactngctcgctcttanaccgcaattcctccgcgcattagtggtgtaatgagcatatcgtaatgagattgcctgacttataaggcgtagattctgggagacatgaaaaacgtgacagtagtggagagactgaatagaggaaccacaaccacg

SEQ ID NO: 703154 - DNA, 1133 bp, Homo sapiens
ggcacagaagaatgttctgtcgtctctcgcagtttacgcggcaagattcagagcccgagctctgatggcgaggctggaatcgaggcggctgggcagcgcggctgaggcagaaaggcggattggtactctgatgcctatggggaggactgactctttcatcatcctaggggcgtgactgaacgcactggcttactgcacacgaacgacagcacagactgcagacacacgtagcacacgctcgcgccaacgcactgcaccgatctccacgagcacctgacaaaccccctgcagcgcctgactgaccccacaaaggactaactaccacgcacacgccaggacaaaaggcgacacgaccccaccagcgcaaccctcgctggcccctcacctctcttcctcgaacacgcacgctctccggcaaccacctgctccgacctgcactgcaacactcacacgcactacccggcccaggaaccccccccctggccaacgcaatgcatctcacagacgtccacttgtgacaaaggaagcacaggaactcgcacgcaccggcgtactctactgcacaccgcacacccgccactacaacgggcacgcgcgcacacctgcgcacctcactgcacacccatacccacctctcagtcccgacacacgggaacacgcacaaacggcagcactcctatccagcgaacaccggcccgctcaagccccgactccctaagccgcaagcccaacacgccctcgccactcccccaccgcactctcccatgggtgacccccactcttgggacccggcacgcgccttgttgcagccaaccgctaaaccccttaaccgccaagacgagcggcaacttgacgttgacttaccgtcgccaactaccacaccccaaacttggggcaccctaggcggactcccttagcaacgccggaaaccattcccccgcttaaaccattaacgctggcaacgcgcggccagacttacagagcccgccaacaccgcgcgggcccgcccccagagccaatcaacccacgtacccggacccgcacaccctggcggcaagcccaaaaaaaccgtatacggggaacacaaacccagccgcgcccacaacgacaacacgaaccgcgacaaacgcccg

SEQ ID NO: 703155 - DNA, 883 bp, Homo sapiens
  misc_feature (391)..(391): n is a, c, g, or t
  misc_feature (414)..(414): n is a, c, g, or t
cttaacttcacaaacattggtcacttggagggccccttccacactcctacgcaataatattatctggggttcgtggttcaacatcttcttcacttgacagggcatcagacaccccattacccaaacgcctaaaaggctcccctagggcacattttctccatctggaaaattttggctttctctcctggtttggccacattcctaatctccgggtcggacattggtctctctccttaatggatagggatgggacaccaaacttggggtccattggtccaggtttccaggtcccctttgagttagcactatatacacttttacatccttgttaacgttccctggttgggcacaaaggaatatggtctctccacaagaaaccaagcaaggtaantaggggtatcacgacattccaanaaggtttactaattaccatctggaactttactcacgaaggaagttactttccacattttcgtcgggctcccactcaacactttacaggattttcggtaagttttcctacttcttacgatttccattggtttcctggatgggtctggttatctggagagtagacaccatttgaccgtgggaagttccccagaataggctaaagggccacggtcccagtaattcacttatgttcaccattagggtttctcccattttagacaatgggcaaaaccgggtggaaaaaggagaacaggccaacaaaattcttaaggggtaccggaacccccatggtgaccggtaaattaaccgaaaagcctcgagtcagatgccgggatcggtggttggagtggccccttaaatacgccacgtgtgtgcccaccatggggagaaccccaggtatggggggaacccccgtagactaagcgtcggt

SEQ ID NO: 703156 - DNA, 484 bp, Homo sapiens
agaatccataggttcctccacattgccctggaacctgtgggtagaggtgaccctgacgatgaaagtggccagtggtagcacaggcgcacagaaggttcagatttcatactacgggaccaagactccctacagtacaaagctctactctacctataccggggtcggtacatctccttgttgcgcagacatcaaccgcaccgggccacagtgaagccaacaccagagctgtgaaaagatcagaggacctggaacctggggccctctgttgcccagggtgaccatcctgctgtgtgaaactgtgacaagatgacaatctcgaatctatcttgccattggaactgcgaggatgatgaggtgcttgacagagaagacctgcaggacatgtcgctgatagacctgagcacgaaaaaccccaaggccttcttcacaaaccatacactggtgctccacgtggccaggtctgcgatggacaaagtgagggtgt

SEQ ID NO: 703157 - DNA, 789 bp, Homo sapiens
  misc_feature (43)..(43): n is a, c, g, or t
  misc_feature (83)..(83): n is a, c, g, or t
  misc_feature (94)..(95): n is a, c, g, or t
  misc_feature (105)..(105): n is a, c, g, or t
  misc_feature (149)..(149): n is a, c, g, or t
  misc_feature (172)..(172): n is a, c, g, or t
  misc_feature (180)..(180): n is a, c, g, or t
  misc_feature (200)..(200): n is a, c, g, or t
  misc_feature (203)..(203): n is a, c, g, or t
  misc_feature (213)..(213): n is a, c, g, or t
  misc_feature (226)..(226): n is a, c, g, or t
  misc_feature (231)..(231): n is a, c, g, or t
  misc_feature (244)..(244): n is a, c, g, or t
  misc_feature (254)..(254): n is a, c, g, or t
  misc_feature (257)..(257): n is a, c, g, or t
  misc_feature (272)..(272): n is a, c, g, or t
  misc_feature (274)..(274): n is a, c, g, or t
  misc_feature (279)..(279): n is a, c, g, or t
  misc_feature (281)..(283): n is a, c, g, or t
  misc_feature (289)..(289): n is a, c, g, or t
  misc_feature (291)..(291): n is a, c, g, or t
  misc_feature (293)..(293): n is a, c, g, or t
  misc_feature (296)..(296): n is a, c, g, or t
  misc_feature (300)..(302): n is a, c, g, or t
  misc_feature (304)..(304): n is a, c, g, or t
  misc_feature (306)..(307): n is a, c, g, or t
  misc_feature (312)..(312): n is a, c, g, or t
  misc_feature (315)..(315): n is a, c, g, or t
  misc_feature (317)..(317): n is a, c, g, or t
  misc_feature (319)..(319): n is a, c, g, or t
  misc_feature (321)..(322): n is a, c, g, or t
  misc_feature (324)..(324): n is a, c, g, or t
  misc_feature (335)..(336): n is a, c, g, or t
  misc_feature (338)..(344): n is a, c, g, or t
  misc_feature (349)..(351): n is a, c, g, or t
  misc_feature (355)..(355): n is a, c, g, or t
  misc_feature (357)..(357): n is a, c, g, or t
  misc_feature (360)..(361): n is a, c, g, or t
  misc_feature (363)..(364): n is a, c, g, or t
  misc_feature (378)..(378): n is a, c, g, or t
  misc_feature (382)..(382): n is a, c, g, or t
  misc_feature (392)..(392): n is a, c, g, or t
  misc_feature (395)..(398): n is a, c, g, or t
  misc_feature (405)..(405): n is a, c, g, or t
  misc_feature (409)..(412): n is a, c, g, or t
  misc_feature (418)..(419): n is a, c, g, or t
  misc_feature (427)..(427): n is a, c, g, or t
  misc_feature (432)..(432): n is a, c, g, or t
  misc_feature (434)..(434): n is a, c, g, or t
  misc_feature (436)..(436): n is a, c, g, or t
  misc_feature (438)..(438): n is a, c, g, or t
  misc_feature (448)..(448): n is a, c, g, or t
  misc_feature (470)..(470): n is a, c, g, or t
  misc_feature (472)..(472): n is a, c, g, or t
  misc_feature (514)..(514): n is a, c, g, or t
  misc_feature (528)..(528): n is a, c, g, or t
  misc_feature (548)..(548): n is a, c, g, or t
  misc_feature (604)..(604): n is a, c, g, or t
  misc_feature (607)..(607): n is a, c, g, or t
  misc_feature (618)..(618): n is a, c, g, or t
  misc_feature (631)..(631): n is a, c, g, or t
  misc_feature (634)..(635): n is a, c, g, or t
  misc_feature (639)..(639): n is a, c, g, or t
  misc_feature (682)..(682): n is a, c, g, or t
  misc_feature (760)..(760): n is a, c, g, or t
tagttaacatatgccacccaatgacgggacacaatctggtcanacgctgcctctcctgcctgttgctgttctttacaaaggtncgtgtgttggnntggcaaagtngcatcctgctggcatctctgtggtggccccggaatggtggagtncccaggtcagcatctactctggntcccattntcaactgctctggccttganatnagattttctngtttcctgctggntcttntgcacactggatntatgctaatntangttcaaattaggtananacctnannnacattnanancanaatnnncncnntcctnatntnancnntnctcacacacannannnnnnnaagcnnnagangngannannacaccatacacaanctcnatttttacanatnnnncctctcncacnnnnatatcnntcctctcncacananancncccctatctncacccctccaccccacacttcntnccacaccacacaccccaccccacctctccccatctccctacntctcacaccacacntatcaccctccatccccaanctctcccacatcctcctacattcttcacaactcaacactacacacacctccccacnatnccctctcccanttcattcacacgntgnnttanatacagctagagagaagtggagatatgcttttttgagggaggnctttcctggtgtttggataacagtgagacagactctgggttcggcatgctctggggaggacatgcgacggtgagagantccctactgctacactctgtacagggtgg

SEQ ID NO: 703158 - DNA, 191 bp, Homo sapiens
gacatcatacagtcgctacccttaggcccgaatgcgaagagccgggcgtaggacacgggccatacggagactagctgaagggctttgagaattcttactactatcctacagtgatagactcgagctttctcctatacttatagacgttccggacgggcatataccgagtccggtcaagcttgggtaggcca

SEQ ID NO: 703159 - DNA, 795 bp, Homo sapiens
cgcggtggctcacgcctgtaatcccagcactttgggaggccgaggcgggcggatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcatgaacccaggaggcggagcttgcagtgagccgagatcgcgccactgcactccagcctgggcgacagagcgagactccgtctcaaaaaacaaaaaaaaactctcacggggcagtatgggtgctccctcagactttcaaaattaaaaaccagatgcagcatcatttatcgaggatggcttcccacaaaactcattttctaaagtagcaacggccaacagaaacctcaacacttttacagggagaaacgagcttctggaatttataccatagaccaccgagcccaacggtcatagaagaacatttcttttgccaacttgcgaactctggcacaacttccatcttcgggaggggcactaccggacctaagctcccatatatctgcatccgtatcctgggaatttccaccctctgaaaaaaggcctacagaacacactaccttttggtcctacccattaagcttggtcccggaaattcatggggactacacatttctggggaatttcctttggtcattggggacatgatagatatcgccaatctgcgcttgaatcatccgtcctgatcaatgacacgggcattctggctcaaaggcagtcaaagtcg

SEQ ID NO: 703160 - DNA, 823 bp, Homo sapiens
aaaagagaaagagtattctgaagataaaccttatcagtctgagtcctgtcagaatcagagtatagtgaggaggtgcgagcaaaaaagaagaaaagcaggaagaacgagagaaagcaacagaaaaagacaaagaaagaaaaagaagcataagaaacagcagtcacagaagaagaaaaagaaggctgctagttcaagtccggactcgaccataacattaagaaaaatcaggattgcccttataaacgagaagtcgcaatgtcggaggaaattgcagactgtggaaaactacagagcatatgttactaagaatgcatgaatttgtcttgtgtataggaatgattgcctggactattcagtaggccacgtcacgatgccacgtgtgtgaaagggccataaatgttgcctgctgcttgaagcatctatttctgttctcttccagtgcttgataactctgggagataatacagctgcagtacgtactagtggttgaagatatctgggaataaaattaatacttttgactagaagcgtctaaggataaaccaacagaaatggaatcgggatacatctttaagatgtaatcagaaatgaccagatgactctagttagacatttcgaaggagggattaacattaatatttcaaaaaccttactctgtagataagtgtatacgaatgtctgcccctcgtatactctcatttacctggggaaggagctttgacgggctggggggtggaaagctagctcttagctagcagaaaagtgtgcctttgatcctcacagatcctgttatcatggacacagtagccatgctatcacgggg

SEQ ID NO: 703161 - DNA, 308 bp, Homo sapiens
tatctgtatcactgagcgcagtgggcatgatcatgtcagaggtgtgtgacaccagacactccatcttaaataggagccgggaaaaatgaggctgaaactactgggctgcattccctgatggttaaggcattctaagtcacaggatgacatagaaggtcagcacaaaataccagtcataaagaccttgcttgataaaacaggttgcagtgaaggagctggccaaaacccaccaaaaccaaaatagagacaagaccagcctagccgtaaatggtcgcaaccccacctctactagaaatataaaaattatg

SEQ ID NO: 703162 - DNA, 252 bp, Homo sapiens
ccgcgttactcgcatgcggaagcatgcacaggtgttgttcagtgcgaataggggatcgtccgccccctgcttgagctcgccgccgcccgtgttcgagcccttccggctaaggaattgaacgtgattcgctttgggaaagtgtctcttcacaatggccgcgtaagccggatgcgagtccgagcggatctgcgcctcttcgtgcacgagatccctaagagtatgaaacaggcggtttcttccttcttgtctcgt

SEQ ID NO: 703163 - DNA, 397 bp, Homo sapiens
tcttttccaagcccggcgtctctttcgtctgcacgactgtctagcatgctctgcagtcgctattgttagccttcagccattctctctgcggcgtcacctcgcttgtggtcttagttgcatttccccagtggtgggtgattccgaatctctttccaggtgcgtgtgtccatttgcatgttgtcgtgtgtgaaatgtctcttgagatctcttgcccgtttttaaattgttctctactgctgagttttgtttttttttttattgtgggaaaacatgcataacatgaaacttaccattttagccattttaaagtatgaagtgatacttagtacggtcacggaattatacaaccagcaccgctgtttagttccagaactttttactcccttgtggaaaatta

SEQ ID NO: 703164 - DNA, 416 bp, Homo sapiens
  misc_feature (27)..(27): n is a, c, g, or t
ctttttccaaggtgcccacgccacccntatgtcacgcctgaagtagttattgagaaagtcgtccctttccccttttctataaccaaatagacaggaatggaagattctcctcggggcctgaaagcttgcgggatgaataactcctcctcctcaggcccagtcccaaggtacaaacttgcaccagcagcaagatagcagaggcaggaagagagctggctggaagacacgtaccccctgaagatcaagagggaggtcgccctggtactacatagcagtcacgttaggctgggacaattcctgtttacagaggactataaaacccctgccccatcctcacttggggctgatgccattttaggcctcagcctgtctgcatgcaggcgctcattaaaacagcatgttgctccacaaaaaaa

SEQ ID NO: 703165 - DNA, 172 bp, Homo sapiens
aggaacgacggcaagcctctaacccgattgggagcagcatgggccccgcctcactggatcagaagtgcagcagataccctgctgcatccggaggggtgtaagtcagtggtggtgtctgcaacaacagcaatcatcaatggtcagatggacgcagcgaaagcatcagtacgaa

SEQ ID NO: 703166 - DNA, 752 bp, Homo sapiens
gtctgtttggagaagccgaaataccgttgcccgacttgccgcgtgccctactgttcggtcccctgttttcagaagcacaaagagcagtgcagctctgaagcccgacctgttgagaagagaagagcagggcctcctgtgaggtctgaggagagcaaagatgatgactcctccgtagctgatttcctcaacagtgatgaggaagaagacagagtgtctctgcagaatttaaagaatctaggtgaatcggaaactttaagaagcttgctgctgaacccacacctgaggcagttgatgattagcctcgatcagggtgacaacaaagcaaagctgatgcgagcctgtatgcaggagccccttttcgtggagtttgcagactgctgtttaggaatcgtggaaccatcccagaagagggattcctaagactggatgtgttctctgctcaagttacctgctgctgctccaagaggtggctgttttcaaggccaccatacgcagcatgcacacgtgggtcttcctctaccacatggctcgctgcagcaacttcatgaagaggaaacttgtagccctggagtgatggctcagcagttaggagcattgactgcttttccagaggaccccagttttcagcacctatttgactacttacaactgtaattggttgcagaggatctgacagtctttactgtatgcatgtgcatagccaatatgtacaggggaaaactcctacatacattaaatacttaaaacaaaag

SEQ ID NO: 703167 - DNA, 123 bp, Homo sapiens
gaatcacaagcccagcaacaccaaggtggacaaaagagttgagctcaaaaccccacttggtgacacaactcacacatgccactgcactccagcctggatgacagagccagactccatctcata

SEQ ID NO: 703168 - DNA, 534 bp, Homo sapiens
tgcaactcttgagtaccagacagaagcaatcgaatggctgggaaggtgtgaacgtgagggtgaaagtcatggagcccatcccacattcctgttgccaagcaggcctcctggctctccctcatggttgcctcacagggctgtggtcgctggtagctgttctctatcccagtgcttgtgttttatttccttgagtattaagtgtaaggatttcctattggaacgaagtttgtggtactcaatagagtcgtgtgcggactcccgtgtgcgcaggcgccgttccactctgcgcctgcctgggctgtctgagtagggatgggccctccctccgcggactcgcaccctccccggtgtggcctctcttctttcctggctgtgtcctttcctgggagagctctcgtacctcactgtggagtcctgactctcctcctctcgggcggcctctcatctctcctggctgtgtcccttcctgggagcacctgtgtgcccggccgtcccatgtgggaggtggagtcctgactcagcctctccctggga

SEQ ID NO: 703169 - DNA, 177 bp, Homo sapiens
ggcctgatatgggcacagaaattatatctcaatttggcgggtggggtgagtgtaacagctttattgagatataattcctgtaccatacaattcacttaaagtgtacaagtcagtggtttttagtttattcacaaaattgtgcaactatcacctgataaattttagaactttctcttt

SEQ ID NO: 703170 - DNA, 94 bp, Homo sapiens
  misc_feature (3)..(3): n is a, c, g, or t
  misc_feature (66)..(66): n is a, c, g, or t
ganaaaaactgggcttgtcattttttcccttgtagctttaagcagagacataagtgccttgcattnggttttggagatttagtacaaaaaaaaa

SEQ ID NO: 703171 - DNA, 201 bp, Homo sapiens
tcagtcgcgtatcgtgcgatacgggtgtccgcactatgtatcggcatacaatatagctagacctacccgggagcgggggaccaccatggttgcctacaggaggggtagaaccggcccatggtctggaacacggagcatggtcaaaacctccctgtgccgatacagtaagtagggactcgcgcctagtaatagatgcacatc

SEQ ID NO: 703172 - DNA, 235 bp, Homo sapiens
tcgagcggcgccctcgcgagccctggctggccggcggcgtcgcctggtgtgcgcgtctggatccgctggtggcccggcttttcgaccccttctccaagggcctcgccatgtaagctgtaactcttcgctcccctcgccgtgccaggagctcccgcccccaagggacgcccctccaccatcccgcgcaccgatgactggggctggaggggcggcggggcgggaatattttcctccc

SEQ ID NO: 703173 - DNA, 629 bp, Homo sapiens
agaactggaatacttgctccatgcatagtcatggacctgtacatttgtcttaaaggaaatccatcaagaaacaatcttggaatcttccgcagtgtcaatagcacgtccagccattccaccatcaccacgaactccagggttgtctgaatcatagccactatgtgtcgccagatcaaagtcatctgataatccctgctgaccagcgcttaatgttgtcataatagaacttagtgctttcttcctcagtactagagccagcatactgacggatggtccagggcctaaaggtatacatggtaggatatggtccacgtgtgaatggcttcactcctgtaagttcttcaggtaagtccatagtatctctcttgcaatacaagggatttatagagatcctagccagggcagaccattctgggtcaatggtctgttgcgggtgtataagtagttgctgtatgagcctggagcctgatgattcttcaacctgcctcaggtaatcaggtgaaagtaaagaaagctgattcttagctcttaacatggtggagcatgcacacacccaatagaaataagaaccggctggtaggcctgttttggactccgctgtgggagagggcggctgcaattctgcgtcc

SEQ ID NO: 703174 - DNA, 288 bp, Homo sapiens
tcatggcgtcactagcagccttccactcctggtctcaatcaaatcctcctactttaacctcccaagtagatggggactacaggcatgcaccactatagccagctaatttttgtattttttgtatttttgtaatgtcgtatttttctgtctccgaaaaaattggaatagtttatgctgtacagcataaactattgccaagcatgataatgatttactttatacttcctttcattctcccagaattgctcttagagctagggtgtcgtctttagcatgttgtcgctaatg

SEQ ID NO: 703175 - DNA, 666 bp, Homo sapiens
tgttagaatgctgctggaggattccgggatctcacaggctggatttcagagtcctgaattttagacttttcaaggacatgtgcccatctggggttcaggcataatagtctatattaactgatggtgactgtgtgcatgtcaccataacatgttacattattaactcacttaagggactccatgaggcaggtactgctatcttcactttacagaggacattgagcacaggcaagtaacttgcccatggtcacaaacctggaaatagcagagcagctgggatatgcacccagagtctgtgtacttagccacagtgcagtcctgcttaactgcagaacaaaattatgtgtgtgagctctgatggcaaggcaagctggctgggtttagatcctggctcctctactctggggcagaatggttgatcaagttacctactgtgcttcattttcctcctctgtaaaaggggcataataactgtgcctcctaggtttggagctgtctttgagcctagcctttctttgttcccctgtacccttgacattctgtgcaccatccaggcctgcttttaatgagcttctcccattccccaccatgactctggtaaattaatatctgtgcagcatgtgaatgactgatagcaactaactcaatttccttgcatcctaaccc

SEQ ID NO: 703176 - DNA, 550 bp, Homo sapiens
  misc_feature (508)..(508): n is a, c, g, or t
acatattctaattttgttttttcatttgttgttttttgagacggtgtctcgctcagtcgcccaggctggcgggcagtggcacgatctcggctcgctgtaacctccacctcccgggttcaaacgattctcgtgcctcagtctcccaagtggttgggattacgggcgcatgctaccacgcccagctaatttttgtatttttagtggagatggggttttgccatgttggccaggctagtatttgtcagtccaagcagttcattaaaaaaaaaaaaaacaaaaagagcaagaatataaatactggcatcttccagcctacttttacaaggggttcactctggggtccttaaagcttaaggggttacccttaggatttaattttaaattttattttttaactttatgtttttttagagacggggtctggccctggtcacctagtctagagtgcaggggtacgatagctcacggcagcctcaactcctgggtcaagcgatcctcccacctcagnctcctgagtaggcaggattataggcacgtgccaccaatgccg

SEQ ID NO: 703177 - DNA, 221 bp, Homo sapiens
tctaaatgggcacagaaatccttgttcgagagccttctggttatactttaaaaagaagggagcctagcatcttgggaggccgaggcaggtggattgcctgagctcaggagttcaagaccagcctgggcaacatagaccttatctctatagaattaaaaaaaaaaaggaaatcagcagcccagccaaagactacttatttgtaatttctgtgcccatttcag

SEQ ID NO: 703178 - DNA, 133 bp, Homo sapiens
ctgaggtgatctagaggatccctgcctcagaagactgtctttcatcgtgttcctcgtgagctggtcccagatatcagtttagagctgcctctcctgggcagctgctcccctcctctgctaggaatccacgcgt

SEQ ID NO: 703179 - DNA, 295 bp, Homo sapiens
gctaagggatacattggtgtagatgtccagaatttctacaattcatgatattcttcatagtcaaggaactaactctgcagtacgagaaactgcaacagaagttggaagaggatgtgatttccataatttcacagtcattcacaagacagatgagtcatcaccacgtgttatcagccaaggcaagccttcatcaccccagtcatggcattttttcacgttcaccatcttttacgctgactcttacctcaccagacaacaacattctagatcatacacgatgaccatgaacgcagag

SEQ ID NO: 703180 - DNA, 776 bp, Homo sapiens
  misc_feature (11)..(11): n is a, c, g, or t
  misc_feature (98)..(98): n is a, c, g, or t
  misc_feature (102)..(102): n is a, c, g, or t
  misc_feature (136)..(136): n is a, c, g, or t
  misc_feature (183)..(183): n is a, c, g, or t
  misc_feature (203)..(204): n is a, c, g, or t
  misc_feature (232)..(232): n is a, c, g, or t
  misc_feature (242)..(242): n is a, c, g, or t
  misc_feature (304)..(304): n is a, c, g, or t
  misc_feature (328)..(328): n is a, c, g, or t
  misc_feature (333)..(333): n is a, c, g, or t
  misc_feature (403)..(403): n is a, c, g, or t
  misc_feature (412)..(412): n is a, c, g, or t
  misc_feature (414)..(414): n is a, c, g, or t
  misc_feature (422)..(422): n is a, c, g, or t
  misc_feature (454)..(454): n is a, c, g, or t
  misc_feature (476)..(476): n is a, c, g, or t
  misc_feature (491)..(491): n is a, c, g, or t
  misc_feature (508)..(508): n is a, c, g, or t
  misc_feature (510)..(512): n is a, c, g, or t
  misc_feature (525)..(525): n is a, c, g, or t
  misc_feature (538)..(539): n is a, c, g, or t
  misc_feature (548)..(549): n is a, c, g, or t
  misc_feature (556)..(556): n is a, c, g, or t
  misc_feature (573)..(573): n is a, c, g, or t
  misc_feature (575)..(575): n is a, c, g, or t
  misc_feature (615)..(615): n is a, c, g, or t
  misc_feature (619)..(620): n is a, c, g, or t
  misc_feature (636)..(636): n is a, c, g, or t
  misc_feature (657)..(657): n is a, c, g, or t
  misc_feature (682)..(682): n is a, c, g, or t
  misc_feature (699)..(699): n is a, c, g, or t
  misc_feature (752)..(752): n is a, c, g, or t
atttcccaagngttctgctgcatcagccagtgaggacaagagttcttcagggcggttcagctcaaggacacctaggcttccccagcggggggcttgcntgcnggtctgacaaaccacagagcgttgagcagatggnctgggactcccagacctggcagagggttttattagggcccgcctggnctgcaccgtttcatccaagnnccctgacccagcactcatcttccctggnattctctgtnatccaccagctcctctgcacacctcagcgtctacttccacgaacttctaaacatcaaaaggnacaatggccagggggggggcaggngagtngggggcagggcagccttcaaatccaaactattgaatccacacgatggaaagaagagaaagaaggggaaantctccaganancatgagangcatccaggcagtgttctcatgggagagggtngggaggccaaaaactaaaattnctatcagcccccgcngctgtctggtacgcgangnnnctttccgagggcnttacaagcatagnngcaaaaggnnagtaggnctgggactcttcaactntntcttctagggccaagtagactcggtgtaacttattttgtnaganntgggtatgggtgagangaggggcaccttccacccctncagcagagtggtaagactccagcgngggccctgtgcaagggntcagcccagaggccatgagccacagaaactcacagcacctggtggccacaccntgaaatgcacactttgctccaagc

SEQ ID NO: 703181 - DNA, 943 bp, Homo sapiens
ctctgctgccagggcgagtgccagtgcttgtctctggacctcatcaaggagatgcggcagttctgccagtccctgtgccccgtgtgtgctatgcctactgaaacctccatccctcgactctatcccagtctggcacagtatcaggcttcatgcttgtgcagctaggtaacccgagcacggaacttccaggtagtcctggtgcacgccgagtgacacgagctagaaaggtgcctgcatgaattcgcgtctgaatgttctacaattctcagaacgttgcgagacgggcggccctttggtccatggcctgagttttgcccgacaacggtccttaatgatgttgaggcgtgcatcccgaggctgccaacctacttgaattgcccacccccatgtgtacacttcgctagcctttgcgccagcactgtggggcctgcggtcggccccctcgcagacccgggctgggtatctttcttgctagtgtctcggcactagcaacccaatgtgtttatcattctccccagaaattgctgcccctggacttgcccggtgttggcttgtcctggcctgtggtgtctgtctcttctggagttcaggctccagggcgtgtaccaagtcgtgtaccggggtcacatgcatctctggcaatgcattgttgcctctctatatccccaatacgccgtggttattttatcgccatcctaccgttagcaaaccctaaacataaccattccttttttgacctattgcgctcttagtcagtagtactaccgacatcctagtgcgcgctgcccctccaggaccaggaacctggtactatgtgccccgaaaagagtggatgaatagagcttgattcatcaccaaacaccaggagcagcccgcttaagcatgccgagtgtcggtctagaggccaacaggcccagcatttacccccggtagagaacactca

SEQ ID NO: 703182 - DNA, 112 bp, Homo sapiens
gtgctctcagtgcaggagcccggggacaattctcaaaaagccaagtgaacttgtggacagaacccgcggggatggacccagcgataacccgggggtcctgctcttcgggtac

SEQ ID NO: 703183 - DNA, 1018 bp, Homo sapiens
tagccccaaacccactccactcttactaccagactaaccttagcgtaaaccattttactccaagattcatagtataggcgagtagaaatcgaaacctgtgcgcataatagatatagtaccgcacagggaaagatgaaaacttatgaccatagcataattgatagctagaggactgaaccccatataccgttctgcgataatgaagttaggctagagaagtagacctctgtgcgatggtaggaagccaaagactagagacaccccgaagaccagtagcgagctagcctataggaatcagcggtaaagagagcagcacccgtgctatgtaggcagaacattagtgggcaaggagtattatacggtaagaggtcgactgagactaccgagtccttggatgaatagtctcgtgttgtgcctaatgcatagaactcttgagtgtacaggactgttaaatgtgtgcccatcagcaatccctctaatactcgcccttgtgatagagttctaagcgtagttaggtccgaagaagaggtagacaggctctatgtgggaccagctagggaaatagaatccgatgtaagacgaggatgtgaagatgattctgatcgagcccatgagtagggcctaaaagaagcagccgacgcaatctaagaaaacgcggtaccaagggctcaactacccgatttacgctgaaataaatcccaataacatgataagctggaatcgtccttcacgaacccaagtgggatccaaatcggatgcagcccttattgagagactgaaccggaaagtggtgtcaaagtaattaaaggttaacccatggaaggaaaccatttctcccttccgggacattatagacccttggcggtcccgattttagacccatcatttgaaacctggtcaatgtgaaacaaggccccaattgaatcttatcaagtccaaccccaaatcaaggttcatttaatttagcccctcatatgggcaaaccccaacaacagggcgatgctcataaaggagaagg

SEQ ID NO: 703184 - DNA, 114 bp, Homo sapiens
ggggtgggggggattgttttttgtaaaaatgtcattaccagggcccataaatctgcctttatggtgcataagtgaaaatttagaaaattaaaagccattatctttccggggcca

SEQ ID NO: 703185 - DNA, 811 bp, Homo sapiens
gtcgctatgaaaagactgggctatgtcctatgctggtgcatgcgtcgtcggcctctgggcagcaggtttacaaaggaggaaaacgacttcttctagatttttttttcagtttcttctagtaaatcaaaacatctcaaaatggagacctaaaatccttaacgggacttagtctaatctcgggaggtagtatttgctgcatggcgtcaaacaaacttaagtattacactggtgtaataactatccacaagcaatgctaattttactaaacatgatcgcagttcatataaggtataccataatgagtttgcaatttgaatttgcactaatgtggcaaataacaggaaaagctgattctagactggggcactatggtcaacagccatttctcttcacgcagctcggccacggcagctctcctactggcacattctcccattatgtagaagtagaaatagtaccatgtgatcacgggcaaagattctaacaatgagtgacagactatcatggaacaaagagctcaataatcaatccacgtgcaaaatcacaacgcaaccctgcacgcatgaacagctcacgacacatcaccaatactcatacagtgaccacgaacacatcaagaacccaagcctccagcatatgtgccacaacataacgcacgaaagtaacacacgatacactgtgaatcgatcgcgtcaagcacactcatcccagacacataccaagggccccgagcatactcaaacacgtccacaaaggctcgcacaccatggcgaagaaaccgcaacacatgatagagcatacaaatgataga

SEQ ID NO: 703186 - DNA, 130 bp, Homo sapiens
atcagagtccccagcatgagagaatctgctctgtagaccacatccagtgtgatttgtgtctgagatcacaccccagtagcaggttacgccatgtcaccgagcccatttgatccagaggtcttagtcctgg

SEQ ID NO: 703187 - DNA, 86 bp, Homo sapiens
  misc_feature (39)..(40): n is a, c, g, or t
gaaggtcattactatggttcggggagttattataagaannctactttgactactggggccagggaaccctggtcaccgtctcctca

SEQ ID NO: 703188 - DNA, 299 bp, Homo sapiens
gcaaaataattttgcgatgtaaagaaattcatacgcaatccaagagtcaagagagtgattaccagcccaattaagacaaaatgtggaccaagcagattgcagagtacaataaaaccatcgtggagtgcccttacatagcaccacgcggaaacgtgagtttaagtccactggaagtctctaaggaagtatcctcttgctgctaaaacattgggacaaggttgactaccagaaaaaaaataaagcttacttttggagtttacctaaaatttctgaatgttataattcttgggggcctcttt

SEQ ID NO: 703189 - DNA, 160 bp, Homo sapiens
  misc_feature (147)..(147): n is a, c, g, or t
gaggtcatctagaggatcccggtggttcttgcagaatctgtgaccttacccccaaccctgtgctctctgaaacatgtgctgtgtccactcaggttaaatggattaaaaacgggggggcaggtggccaaagaatggttggcctttttnttttttcccccca

SEQ ID NO: 703190 - DNA, 105 bp, Homo sapiens
acggccgtgtattactgtgccagaggctactatgatagtagtggttattttgcggggtactactttgactactggggccagggaaccctggtcaccgtctcctca

SEQ ID NO: 703191 - DNA, 175 bp, Homo sapiens
tttggggggggccccccccccccccttttttcccccccggggggggcccccccattttttggggggggtccccccgggttttttggcccccccttttttaaaaatggggttttttggggggtttttttttttaaagtgtgggggaaaaaagggttttaaaaaggagggcccatta

SEQ ID NO: 703192 - DNA, 102 bp, Homo sapiens
acggccgtgtattactgtgcgagaggggggagttattactatgatagtagtggcccctactttgactactggggccagggaaccctggtcaccgtctcctca

SEQ ID NO: 703193 - DNA, 149 bp, Homo sapiens
cttattatatcctgagacagaactcctgatctactaggctgtggaagagtcctataactgtggccccctgttagggccccccctttttcagttctccaatgacccagacacctttggcttaagacataaccatgcagaatccccaatcc

SEQ ID NO: 703194 - DNA, 270 bp, Homo sapiens
ccccccccttttggtataattgtgtagccccctttctttgggcttgacacccgtcttgaataagagtgattagagctgcaaaatgtccctcttttggctattgaccatgtgggtcccggacaaaactctgtataagttgaaggaaaatgttcatgttcaaaaggacctgtttgccaagaccaccttttgagggtttggaaaactggtatttttttttttttcccaatgtgaaactgaagggccataaattattaaagattttctcttcca

SEQ ID NO: 703195 - DNA, 93 bp, Homo sapiens
acggccgtgtattactgtgcgagagaaggggacggtggtaacttgagctactttgactactggggccagggaaccctggtcaccgtctcctca

SEQ ID NO: 703196 - DNA, 90 bp, Homo sapiens
acggcggtgtattactgtgcgagggggtgccaacacctggtgaactactttgactactggggccagggaaccctggtcaccgtctcctca

SEQ ID NO: 703197 - DNA, 895 bp, Homo sapiens
acttcctcctgtaattccagcaacgcctccgctcttctatatagccccaattgtcctacccgcccttgcctaatttaacacaacaccccggatccccgctcctgttgaaccgccaccgaccaccaaataagttttggggagcaccctgtgcgcaccctttttcttttaacggccccccctctcaatactatcaaactgtttactactcggagcccaccaagcatctagagataccatcattctctattctcggggcgggaaaaataaataccccacccaattatctatatgggaagaacacatctttttggtaatgaaacaaggagcacacccactctgtcgcagggtcattaatttcactcctggcgcgaaacttacatccgccgcgagatttagatgccctcccccgatgacctctcgtgtgcggttatttcacccccccctctctccaagagagtgggcccccacttttgtcttgatggaccgccagcacaggtgtgtcttcacttcaataaacagattcacacttcttgagagggagaagaacacacacgttcagacagtaataattagtagaaaaaaaggagggcagttggtagacccgtctctacataagggaccccacatttatctcagcagtatgtttgattgatcaggggagaatatgttgtataaaacatgaaggaacgccctttagtgacaaaccatttgttgtcacttgcaccacccgcactcatacattcgctttcacgcctaactgtttttaccatgttgtgtttctcccttcttaatctctatcattttggcaggctttccactcacaaaacttgtttttataaaaaatgacatcccaaagctcccccccccacataacaaaaaaaacagaacataaaaa

SEQ ID NO: 703198 - DNA, 81 bp, Homo sapiens
ggggtttatactatggttcggggacttatccctcgctactttgactactggggccagggaaccctggtcaccgtctcctca

SEQ ID NO: 703199 - DNA, 127 bp, Homo sapiens
gaagcgcacgatgtgcgcgccaagaaccagttctccctaacctgaggtctgtgccagccgcgacacggccgtctacgtactgtgcgagagatcgtaaaatgggagatactgatggctggttcgaccc

SEQ ID NO: 703200 - DNA, 158 bp, Homo sapiens
gtatattgtgaatagggtgtctttcgtactgtgtgtttgtttgctttgtcaagatcagttggctttaaatatttggctttatttctgggttctctattctgttccattggtctttgtgcctatttttataccagtaccatgctgttttaatgactacg

SEQ ID NO: 703201 - DNA, 132 bp, Homo sapiens
gcaaacttcacgggtgcatacgtacttacaagcataagcaaaacttaacttggatcatttctggtaaatgcttatgttagaaataagacaaccccagaccaatcacaagcaagccaaacaacaacaacaaca

SEQ ID NO: 703202 - DNA, 268 bp, Homo sapiens
tcagtcgtctgcatcactcatggtagaatgtgcactggagtgagctgccagatgtgactcccagagtcatgcgaccctgaaaaaaattactcgacctctcagttttcattttcctttggttttttttttttttggaaagggagtctcgttttgtcacccaggtgggattgcaggggcccattttggcttcagggaaagctccgctttccaggttacaggccattctcgtgcctcagcctcgggaggggtgggaatggcaggcacccgg

SEQ ID NO: 703203 - DNA, 265 bp, Homo sapiens
agagaaccgactcttaagttgtagcgagtctttcgtcaggagcctgaactgcgcctgcagaaggtgtgtgtggcagccaagtgcaggatgtcaggctggcaaagagtcccggaactggctggcatcaatccggtactgctccaggtagggcaggctggggtcccgactggactggccattgtgctggctgcacccccagtactggatagccaggtgcttggcattaaaaccaaccatgtacaggtcctccagctcttccctggag

SEQ ID NO: 703204 - DNA, 402 bp, Homo sapiens
agaatgtcctatatctcatgataattttattgcacattgaaatcttaatattttggatatattgggttaaataaaatacattcatcaaattgattttatcccgatgtttaaaaactcccaggctgggtatggtggctcatgcttgtaatcccagcactttgggaggccaaggcaggcagatcacttgaggtcaggagttcgagaccagactgaccaacatggtgaaaccccgtctctactaaaattacaaaaattagccgggcttagtggtgcatgcctgtagtcccagctactccggagggtgaggcaggagaaatgcttgatcccggcaggtagaggttgcagtgagctgagattgccccactgcactccagcttgggcaatagagcaagactccatcac

SEQ ID NO: 703205 - DNA, 145 bp, Homo sapiens
gggggtgggggagaaaaccccgggcttttcccccgggtttcccccccatgtaaatgaacccctatgttggtttttacccccctccgggaaacagaacccaagttttggcccaaatgggagggaaaaaaagtgttttgcattttta

SEQ ID NO: 703206 - DNA, 1040 bp, Homo sapiens
  misc_feature (5)..(5): n is a, c, g, or t
  misc_feature (63)..(64): n is a, c, g, or t
  misc_feature (85)..(85): n is a, c, g, or t
  misc_feature (99)..(99): n is a, c, g, or t
  misc_feature (109)..(109): n is a, c, g, or t
  misc_feature (111)..(111): n is a, c, g, or t
  misc_feature (113)..(113): n is a, c, g, or t
  misc_feature (118)..(118): n is a, c, g, or t
  misc_feature (127)..(127): n is a, c, g, or t
  misc_feature (131)..(131): n is a, c, g, or t
  misc_feature (141)..(141): n is a, c, g, or t
  misc_feature (162)..(162): n is a, c, g, or t
  misc_feature (165)..(165): n is a, c, g, or t
  misc_feature (171)..(171): n is a, c, g, or t
  misc_feature (183)..(183): n is a, c, g, or t
  misc_feature (185)..(185): n is a, c, g, or t
  misc_feature (198)..(198): n is a, c, g, or t
  misc_feature (335)..(336): n is a, c, g, or t
  misc_feature (339)..(339): n is a, c, g, or t
  misc_feature (342)..(342): n is a, c, g, or t
  misc_feature (350)..(350): n is a, c, g, or t
  misc_feature (359)..(359): n is a, c, g, or t
  misc_feature (373)..(373): n is a, c, g, or t
  misc_feature (378)..(378): n is a, c, g, or t
agaantcaaacagaagcacaaagcataatttataatgaacagattgaagaaaaataaagagcnncagaaagttcaggatatcaanagaagtcaagcaanacatcaatcntntnagagnaaatcatgnaggnaaagggaaanagttggaagagaaaatggtanagnagttanaagaggatgtgnanatggaagatgatnattaaaaatatatgtaaaaatttattttatgtaaatttgaaaatgaaatttggataattggaaatgataaattattttattttttaaataaggtaaattaaatgaaaagagattaaaagaaatatttaatgaattgnnatntanataatatnagatattanggatgttagattgnatctnagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagta

SEQ ID NO: 703207 - DNA, 335 bp, Homo sapiens
ttcattacgcaaatctttgtgaatgttgcactcttactgtatgatcttgaatatgttttacgataatgaatctacaaagttcatatgcagtgcattcattgtaaactataaatgacatttgtattacaaagaaagctgggtgatacacaaataggagagactctgacgagcaggcaatctgttgaggctcagtatatcttatttgctttgtagtctgctgtcattcctttcaaagagcacacagcacatgaggcatagtactcatctgtcttgttaacctctctaatttagaaatctgtagttcgtaatactggaccatttatcacaatctatca

SEQ ID NO: 703208 - DNA, 578 bp, Homo sapiens
gcataatgatgatgttggaaatgaaggccataagttatgcgtggagtgttttgaactggttaaccaaaacaggaaatactaaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagta

SEQ ID NO: 703209 - DNA, 1317 bp, Homo sapiens
gtgtttccttatttgaaagagtgagaatcatgtttccattgatagcagtttaatagacctctagtccattatatgtatattgatctccatcttagcccattggtgttggtctcttaagattggtggtttataaatcttgcgatgaattggtggtcttgattggtgaatccgtcatccaaattggtcgtgtattgcgccctaagatacgattcatgtactgctcttaagtgatgtctagagtaccggttgaggcggatttggataaatcgggagtgggggcgaatgcacctagtttgcttccgtcgcgctcgggtagtcgacacaacctatatatataagctagtggtgacagagtacaatttgaaaaccccggatactcacttgggttggctcgtaaataatactcgggggctaattgtaagtctttaaagagtacggacgcaaatagcacaggaggcgtccgaggcgcttccttaacattcacttgtaaactcaaaggtgattcttggacttgccagaaaatggagcgaaggtttgtaatcgggaattacgtggttatgcacactaaacacgctgtgttcaacttctcaacgcaccttgataccacaatctagctcggaactctttcacgtaccccgtgatttctccaataccaatttgcgacgaagccttatttttcccaattctattgtgagggttctagcacaatcccagggtgggcttccgaccaatatacccgtaattggcttactcggtaggaccctataaatttccgcgcggcaatcggtacacacggaacctccaccagtttcccttcagagctgtggtgaccctgtgcttcccagttggttattgacccccaagtaacccgttgtcactcctaggtatgcgccttataaaagttattggccgcaccgtgggtgtccctatggagggctctctaaagcccctgtccctacgtgttttggaatttccacacctgtgggtcgtggcgctaccgctaaggtggtgggaattctctcagtctatggcttgtggcgcccacgcggttttcaccatgtccatttgtccgtagttgtgcttccacgcaaccacggacgtctggctttgtgtggtttacccccgtgggcgttctaatatacttctgggagccacacctggtgctgtttcgcaacagaggttctcgttgccattgtccattgaatagggcgctcgctctgtgcaacgggcggttgtgacctccgcatggtcgcatatggtgcggcggttaacgccgcgtgttcaccactttagactatatatacgggtttctgtgcc

SEQ ID NO: 703210 - DNA, 333 bp, Homo sapiens
  misc_feature (233)..(233): n is a, c, g, or t
  misc_feature (247)..(247): n is a, c, g, or t
  misc_feature (262)..(262): n is a, c, g, or t
  misc_feature (284)..(284): n is a, c, g, or t
tggaagcaactcatggtgagtctatttattccggattcttacagtacctgtttattcatttgttcttctctgtcagtcatctgtgcagtacttccagagcccattcattccctgcccactgtggtccagctgagcctggggctgcagaataccaaacaccagtctcctttgctctcccatcagtttaagggaaagctggggtgacccccgcagcctgagtaagcatatgccanaggaaatgcctganggggccatgggaaanaaaaggccagcccacccccttnatggggatgcggcctttccctaatactgactgcctcatcttacattcag

SEQ ID NO: 703211 - DNA, 134 bp, Homo sapiens
atattgcccgctaagctgcgcaactctatcaccatccacacttctccatgatcattttctgatggacgtagggttcaccatgttagcggcaggtatatattgcggtgtgcggtagggactgccttgttcagcgc

SEQ ID NO: 703212 - DNA, 823 bp, Homo sapiens
aacccagcccatgacccctaacaggggccctctcagccctcctaatgacctccggcctagccatgctgatttcacttccactccataacgctcctcatactaggcctactaaccaacacactaaccatataccaatgatggcgcgatgtaacacgagaaagcacataccaaggccaccacacaccacctgtccaaaaaggccttcgattccggggaattaatccctaatttattaactctacgaaagagttttactctcgcgacgagtatttctgtgactcttactaacacctcgcagtagtagccctacataccccccaactgtaggagggagactggaccacaccaagcagtgccactcagcccgcctaacctccccatagcaagtcccacatcctaaacacatccgtacttactcgcatcaggagtatcactcaccttgagctcaccatagtctaatagaaaacaaccgaacccaaactaattcaagcactgcttattacaatgttcactggggtctctatattaccctcctacaagcctcagagtacttcgagtctcccttcaccattatccgacggcatctacggctcaaccatttcggtagccacaggcttccacggacttcacgtcacttattggctcactttcctcactatctgctacattcgccaactaatatttcaatttacatccaagcatcactttggattcgaagacgccggctgatactggcatacagtagatgtggtctagactattcctgaatgtctcatctatgatgacggtctacaacacagtataccacaacaaactacgacca

SEQ ID NO: 703213 - DNA, 965 bp, Homo sapiens
gatgacgaggatggtcaccatggtgtgccggatctgggattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgacgagtgcccaggatgttagaatttgaccct

SEQ ID NO: 703214 - DNA, 421 bp, Homo sapiens
gaggggctccacgctgttcaattacacagagtttatagggtttatgggcaacttctgtgtgaactggtttccattgtggtcatcccgaattcaccagatcgagtatgttagtcaccccccactatatgtcttcgtacagctttgccacatagaacagtgtgctcatccagttgctcataggtagctcgtctggtttagctgttctaagatgtgcctgtcgttgccaaggcatcttcagttaaatcattatgcagaagcatatgcgggcaagctcttgacatttgaatgttgattacaatatttgggctcatcctggaggtacgactccaacagccacaggtttctactgctcatgcataggccgcatctcagaatcccataggtttaagattgtctggcagtaagatagagaagatttcgg

SEQ ID NO: 703215 - DNA, 460 bp, Homo sapiens
aaacagatggggattgtgaagaggatgaggaagaggaaaatgatgggagaaacacctaaatcttcacatgaaaaatcataatctgactaattttgggactgaatgaataagtacaagaggttggattttctatgttggctgattaccatattgaacacatggcatttgtagcattctctaaatctatctactgacatgtatttgacattcaggcagttatattcggtcctccattttatagatattggcactattattggtacagtttaagccattaatatgtttgatccattggataattcacagtaagtaggctcattcatttgacagttatcaaggtgtactctcacagttaattcacattatggcatttgtgatagttattggctctactgtagctaatcaaaatacttaaggcaggactcacatccatatgagttgcgcacagttcttaggtgaa

SEQ ID NO: 703216 - DNA, 1044 bp, Homo sapiens
taggctagtacgagccgggtgtgaatcggcaccgagggcgcaggagggttctcgttccccactgggcatctgaattctagctgtcctttcctgacagggcctggcagttgagcctcagcaggtttccttctctgctggctccctgcagatggcctcctggggtgaggttgggggtgggaggcacagagcagggactgttaaaaccttctttggacacttaagaagggttcctggcattttgtggtcactgataaacactgtggcaggtagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgacgagtgcccaggatgttagaatttgaccct

SEQ ID NO: 703217 - DNA, 917 bp, Homo sapiens
cagtgttgggctggaggtttggggaaggactgggcagctgctgatgagaacctctgtttccttcccgggtaccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgacgagtgcccaggatgttagaatttgaccct

SEQ ID NO: 703218 - DNA, 849 bp, Homo sapiens
  misc_feature (434)..(434): n is a, c, g, or t
gctcctcagaattgaagaggagctgggaagacaaggctaagtgttgccggcaggaacttcagaaagcccttggccaagtaagctgtgggcaggcaagcccttcggtcagcctgtatggctagcacagagccctcccctcgtgtcagtgtaccaggcagctcgaggcccccgaccaaacacttgcaggggtccctgacttagttaggcagccgccgcaccggccgtggagtgcgatgacacgcgtatctccattaggaacttctaccagaagccaaggggactacccgtggagccctgtgggcagtctctagactttgcaggtcgtgtaacttggccgcacagtgcatggttaattactcgtcctgccaactttccactctaatgtgtcattacgatgtcgaattagtgaggcactcgatgtcaatctcgcgggngtggacacaggctaaatcccccggatggattgtcttgttgctacaaagacataaataagcgctcgagatgatcgctcaatgacgaaaacaagaaacagaaaaagaaaagatagagacccaacacacataaaaatatagaaagtacatcccaaaaccaaaagacataacagatatagggcgcccgagtggaggcgcacgcggtagagaccatgacttgaacccccaaagggagggggtcccggacaaggcaggttggcccccaaatgcttgttgtgtcgctgctttaccgatggcagacgtcaccaccaaaggcgcgcagtgctcatgaatagtaagctcacacaatacatgggcttagcctagtcgtccacgattgcacgcgggcccgggctggacaaccattcgcggcaccagc

SEQ ID NO: 703219 - DNA, 341 bp, Homo sapiens
ttataccgggtgtcccatacttaatatggcgtcactctggtgagaatgcctctgacagtagtatggcatcaatgtgagttccgggtattagtacttgtagtatggttaagtacaggaaagctgaggtaaggatatatggaaactgtactatattcacaatttaactgtaagtctaaaattattacaaagtaagaagttttataaaatacaaaatagactagacagcagattagactcagctgaaaagagagtaagtgaacggaaagagaaaacagaaaaaataatcttgaattatctggagataacaaagagatgcagacataaggacaccggaaataagg

SEQ ID NO: 703220 - DNA, 154 bp, Homo sapiens
ccggaccgtacgtaacacctcatcttctcagctttacatctaacttcgcacaccagaaattaaatgatgggcttttaaaataaagtggttaccaataatttcctcattttttcagtgctattttatccaattttgggctttatatttttctatc

SEQ ID NO: 703221 - DNA, 1067 bp, Homo sapiens
cggtgttctgtttccaggcaaaggaaaataagtcaaagactcagaaggcagtcctgaatccaggtcccgggatgcaggggttcgcgtgggaacgccagccggtgcgatcgcgcccctgggattccgcattagcccgggcgtccatttccctgcaatggtggactcagtaacagccaggatctgtccaacagcctgcgagcggtgggatgtggaggcgtgactaatcaactagtgctctgtgtattatgttctaaccgcatccgcttgtatgctcgcatggctaatttaggttgagaaggtttaacagttgaactggagagcaaatagtcctgttctgtataattatcactccttgaggcattatgttactgttctttgccctaacaaggtgacggcatatgtttataagtaacaatgacgcaactcagtctactactatcttccaaattgtgtacattgaagggtaaaatgtgggaaaaggctaaatttgaatgctaaatgtgaagatttcacacaataataattgaaatgcgtgctttgcaatattatggcgtttcggaacagataaaaatacttcattgtcagacattgggtcaacagatacttcttggacgtggatatgcaaagcaaggcatgtaacatttccattactttgcaagtgtggttatcagtaaaagaatgtcgtttcacattctagccttcgtgtaactgtatggagttaccagattgggaagagaattagatagtactatgtacgggaaaagcatggaaactgggagttaagactatgtgagggaagggagagaacatggtcacgaagaggaacgcgaggaaacaaaccacgaaggtacgacgcgccccaaaaacacagccctccaaaacagaacgacaacggcggagcaaagaagaaccacctagggcagaacaccaacaaggatcacatagtggcgcaaacaaaaaaagaacaagagaggaagaacccccagaaaagagaaagacacagcaacaaacacacggaacagaccaacgagggacaacaccaaagcgccacgggcggcgcacaagag

SEQ ID NO: 703222 - DNA, 357 bp, Homo sapiens
ctaagtctacagggataccaggctctcctcaaccacccaatttgatttagaacctcaagcagcacctcactttcatgaaaacctaacacataaacacaacacttggttgtaagtgagccaacagcttcttgtctctttctctgctcaaggcttaaggccgtgtctccccaactacgttcagtggaagaaaagatcccctggacaaataagtttgaggactgtcattgcaggacttctcagaacctttaaaacacaaatcctcatccgcagggatcttcaggagggagacggctgatgcagcacaactttcttccacccgagcatcttgcagaatgcagtaagaaatcccaaaaaaaa

SEQ ID NO: 703223 - DNA, 538 bp, Homo sapiens
cgagggtatgtggacgcaatgatgcggaggcccgggagaagtgcagccaaggagttcggagtgtcccctgtacaatgatcatgtctccagcaatgatgagtgatgtatttggatacctggttctcgctctggacctacttccccattatccatttttgggctggcccaaccagtcagaagacctgagtgtgttctacaccctgtggacacatgcttgagagacctgtgtcaatgacgatcctcttcttcttggtgtgtgccctggatggtcatgcttgtggcctgaatgctcactgggcaggctgccctattagagatgtgtctacctccatgccatctgttgcgagatgctcactggcctggaaggatgagcaagtctctaggcaatgtcatcgatcccctggacgtcatctatgtgaatctccctgcagggcctccacaccagcttgctgaacagcaacctggatcccagcgaggtggagaaggcccaagaagggcagaaagctgattcccagcgtggattcctgatgtgtcaccg

SEQ ID NO: 703224 - DNA, 801 bp, Homo sapiens
atccaggccactgcagggtaaagaaaatgcatgaatgcagattatcccctcactgggggatatccgggagcgaagtccctgagctgctgaggaagctttacgcctaaggagaagaggaaactggttcagaactgtgggcagccagcccaagagcacgctgtctgtcccaggggcagagtcctacagtcgtggcttcgtttgtctggagttgaaagccagatcacacaccttctggcatccgcagagcgcatcctgtgcgaaaggaaggagctagtgcttgtgcgccctgggcgtcatgatccttctgcgggcctccgtaagtgcgagctagactgcttcacaataagttcgtggtcatcctgggggactctgtgcatagggcagtatacaaaggactctgtgtgcttctgcgtgcagtaagggaccgctctgactcagtcccgggcagcttagagcaaggggggcgctgaacttcgaacaagatgacgctggtggacggaggccagcggtggccaacatgcacaaatggccttgagctaccgtgaggtccgcgagtgccgctccgagcagcatctggtacgttttacttcctcagcccgcgtgtactccgattacctccagacgcatcttgaaagagctgcagatcgggcgagacacgccccccgacttgtgtcatcatgaacttcctgcctctgggacatctccaggtatggtccgaaagtcctggagaagctatctggagaacctggagaaacctgtccagtgcctgggccaggatgctggccgagtctagcctcctgg

SEQ ID NO: 703225 - DNA, 708 bp, Homo sapiens
  misc_feature (522)..(522): n is a, c, g, or t
taattgtggtttctattaagaatacatgggctgcgtggggtggctcacacctgtaattccagcactttgggaggctgaggtgggtggatcacctgaggttgggagaacgagaccagcctgaccaacacggagaaactgtctctactaaaaatacaaaattcgctaggcatggtggtgcatgcctataatcccagctactcgggacactgaggcaggagaatcgcttgaacccgggaggcggaggttgtggtgagctgagattgcaccattggacaccagcctgggcaacaagaaggaaacttcatctcaaacaaacacacaaacaaacaaaacaaaaaacaaaaaacaaaaaccaaaagaaaagaaagaaagaaagaaaaaagagtacattaataggctgggtgtgatggctcatgcctgtaattccagcactttgagaggcccagagaggtgaatcacctgaggtcaggagttcaagaccagcctggctaacatagcgaaaccccatctctactaatacanttagcctggcatggtggctggtgcctgtaatccagcttactcggaaggtgaagcaggagaatcatttgaccccagagcagatgttgagtgagccgagattgcgcactgcactcagatatctgcagtatctcagatctcatatctgctggatggtcatgctctgcatatcagtgctctaggtatagg

SEQ ID NO: 703226 - DNA, 188 bp, Homo sapiens
  misc_feature (75)..(75): n is a, c, g, or t
  misc_feature (78)..(78): n is a, c, g, or t
aaaagggcccccccccctttttttttttccccccggggggggggggggggggggaaaaaccccttttaccccccnctnagggggggccccccccccggcccccccctttgggggggggggaacatctcccccccccccctgggggtttttttttttcccccctttggggggggtttttttttttttta

SEQ ID NO: 703227 - DNA, 399 bp, Homo sapiens
gagctcggcccgtgttcagcttcggcagtctgaaaggtgcagagtcagtgggactgaagaagatgtgacaactggatggattttggatgatgtcctggagcagaggaaggattgggtaaaaagctaaggaatctgattagaatgtgcgtcctagttaacaatgtgtctaatgttcttgagacaactgtaccacacaaaggcaggatgttaatgatgggggacactggtgtagggcatgtattctaaagtaaaaaggtggttcttcagagtcatcggagcggtttaacaaaacattagaaacttcagaagaaaagattcctgaactaaaagcaatggaaactgtccacagtgatgtacagggagaaaaaggactgcaaaaactttgccgaagcttgatca

SEQ ID NO: 703228 - DNA, 203 bp, Homo sapiens
caatttttcccccaagtggctctgatttctagactgctttgaaaatgctgtattcattttgctaacttagtgattgggtaccctgctctttggcggtacttattatggagcccttctcagtcaagtctgccggatgtctttctattaccctaccccgtcagttgtccttaaaacgcgcatattactctagagagtgttaagaa

SEQ ID NO: 703229 - DNA, 438 bp, Homo sapiens
accccttttgaggcgctgtgcttataaacatcctttaacggcatagacagtggatactgagaatgatcaactaaatcgaattgagaacaggtgaagaggaaacaaagaattaaggtatccctgtggaatagtgcaagaaaggagtgccccacccatagtgttatctacaataggtactccggggaaaggaccccaaggagtcagaccacaaatgtatgaccagcacaattctatgatcaaactctacctctagcaaggcgtctcaacaatcaagttctatttaatcattcgctcgtgtcttctttcagtcatgatgaaataatgagaatatcataaggaacagaaggtaatgcattggtcaccacccttggtgaggctggtgggatgtatctggattagtcctcacggggggtgctattttcctgcatagtcttcatt

SEQ ID NO: 703230 - DNA, 687 bp, Homo sapiens
  misc_feature (25)..(25): n is a, c, g, or t
aaaaaaaagaagaaggtggatctcnggccgggcgtggtggctcatgcctgtaatcccaccactttttttttaaggcaggcggatcacctgaggtcaggagtttaagaccagcctgaccaacatggagaaacctcgtctctactaaaaatacaaaaattagccgggcatggtggcacacgcctgtagtcccagctactcggggggctgaggcaggagaatcacttgaacccgggaggcagaggttgcagtgagctgagatcacgtcattgcactccatcctgagccacaagagcaaaactccgtctcaaaaaaaaaaaagaagaaggtggatctccaaccaggccagagaagattctcacagaaggtttggaactctacgaaataaatgggttgggtaataaagggcttcgggtcagataaacaaaaaaaaaaaaaaaaaaaaaaaaaacaaaacgacgagcaccaaacagagaacagagaaaccacagcgcaaaaagcaacaaaaaacaaaagaggggggcgcacccaagaaaatgcacagaggagaggcaacgaaaagagaaaacacaaggaacgaaaagaacaacaaaagaaagaaaaaacaaaaaaaagagcaggacaataaaaaaaaaggagggaaagaaaagacagaagaggacaagagaagacgcaaaacaagagagagac

SEQ ID NO: 703231 - DNA, 139 bp, Homo sapiens
gatcacgctcggtacctacctgggttaggtctagcctgggattaggtcactgggattaggtctacctgggttagtctacctgggttaggtctacgttaggtctacctgggttaggtctacctgggttaggtctacctgg

SEQ ID NO: 703232 - DNA, 461 bp, Homo sapiens
tacacgagaaacagcttatcatatcaagtaaggtgtaaatctgtatattaatttgcatgatgataacttactcatgatacagtatagcagacaccctgttacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgcgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactg

SEQ ID NO: 703233 - DNA, 248 bp, Homo sapiens
  misc_feature (32)..(32): n is a, c, g, or t
  misc_feature (61)..(61): n is a, c, g, or t
ggtaccctctactcacacggggaatggagcanaacagtcttgaatatcgaacacgcaaggnggtgagactacctatgtagatatgcaccctatgacatggtggtcctgatcaagaatgtgggtggacgttggccctggttgctttttataaaccgaactctatctgaaatcccaacaaaaaaaaatttaactccatatgtgttcctctggttctaatctggtcaaccagtgtgccagtgtggagagag

SEQ ID NO: 703234 - DNA, 576 bp, Homo sapiens
gacgagactttctctgatgcctctgtggcatattgccacttgagctggtctcagaactctagagatgactgtaaaggagcatggacatttcacactgttttagctcagcatctcctgtcctccctcacctaccactaacagttgctagctctgctttgttttattgttttgaacactcttttcatgtcatgctttcaactgctttctgtatgttcatatttctttttttctctttataaagtctccaaatacctaatctattagcccctaaaatttctacttcctatactacttttatctctggtggctaaatacacatttttgaacacaacaaaatgtgaatatagttgcagactcaaagtagataggcttgcatactaaacttaagtgtggacacagtatcatgttcatcttgtagcccacataacagaagatggaatcagatttttctctatgaatctgaaatagttctctagttatatcacttagtaacttgcatgctgacaacatgtctctaacttcttcatttaaagtaaaatataaatgggaagtgtggttatttcaaaacacaaaagt

SEQ ID NO: 703235 - DNA, 170 bp, Homo sapiens
tttttttcccccccccccaggttgggccgggggggtttcccgccccggggggggaaaaaggctttttgggggcccttaaaaaaagccccatttccaaggggaaagggggtttattcccggggccaatttttccggggggggggggtccaaaaaaggtttttttccccgga

SEQ ID NO: 703236 - DNA, 529 bp, Homo sapiens
  misc_feature (5)..(5): n is a, c, g, or t
  misc_feature (64)..(64): n is a, c, g, or t
  misc_feature (66)..(66): n is a, c, g, or t
  misc_feature (528)..(528): n is a, c, g, or t
aaaancttaaggaaaatcttaaggcaattaatttggcagaaaacatatggcagaggaataatangncatgcctccaaaactgataagaaaggaattacaaagccaaatatgaagaaacagaaagtttcatagaacccacagcacagcaccctggttccagctaaggtaaacagactgcataaggctggcggcctggctctggtaacacttgggaaacagtacaaagtcctggcagttaaagggttctacagcagggcaacctcagatttttcaagattgtggcatgctcaaattctcctttttttggtaataaaaatatacctacagtatataataaaaatatacatacagcacaggcattgaggaagatgaaagagataccatgaaatcaagttaatgtcataatttccagaaagaggaaaccagttcctgaattttgagaaataagatccttcggccactatgtgaagtttcttctataggaaactgtagtctctacccttttgtatatggtagaaaatcagagant

SEQ ID NO: 703237 - DNA, 199 bp, Homo sapiens
agcggagctgatgctggggggaaccaacacactggtgctgcacaacacgtgtacggactcgctgctggccgacccatccatgctggacctagcgctgctgaccgagctgtgccagcggtgactatctgcctgaccatggaccccgagccgaagaccttccaaccccgtgcttgtccctgctacagcttacctcttcaag

SEQ ID NO: 703238 - DNA, 475 bp, Homo sapiens
gctaccgagggcagaaagccgttgtctacaaagttaacatgtcaaacacaagaccccctcttcctggtctcctgctagcattgtggtgatgagagccagctgtcttgaacatttactaggggacaggcagtgttctaattaggcacttgatttaactcattcagccctcccggcaaagaacaacgttatgggccaggtgcggtggctcacacgtaatcccaagcactttggagggcctaggcgggcagatcacgaggccgggagttcaagaccagcctgactaacatggtgaaaccccatctctactaaatatacaaaaattagccaggcattgtggcgtgtgcctgtaatcccagctattcaggagactgaggcaggagaatcacttgaactgggaggtgcaggttgcagtgagctgacatcacaccactgcactccaccctgggcaacagagcgagactctatctcaaaaaaa

SEQ ID NO: 703239 - DNA, 390 bp, Homo sapiens
atcgacattcttttaaggaagtctgcctgatccccagcatgggagaggttggagagttgctaggctagttggcctttccctggcaccaggcctgtgttagacccctggttctcatcaagaaacacctttgttgagcagttgttattctggcctcacagcttgggtagtacacatatggcctggggatgggcaacaggctacaggaacccacctgtcttcctggtcaggggcactggcccctagcagcaggccatcctggtggggcacaggttctgtggcctttggtttgctacctctgaatatcctgggcagcaaggcatgccttccccgcccctgtggccctgagagcccttcagctcctgtccccataatgggtcctgggcctaggat

SEQ ID NO: 703240 - DNA, 576 bp, Homo sapiens
  misc_feature (238)..(239): n is a, c, g, or t
tttgggtgttagaattcttaaactctaaagccggcctccaatttgtccctaattctttctttttgcagggggccaagattcccccccctgttaagccttcgttttgtcccccccccctttttcttgggggccctgggcttggaaaaaggccccatgtcttttttgggcccccccagggtttaagggcccccggttcctttggttggatcccccaaaaaatttcccccctccttttttnngccccaaattttcccctaggttaaggggggggggtttttccccctttaaaccccccccttcccgaaagggttggccttggttgcccttaaaaaccccccccttttttcccccccttttttttaaaaaaaaagggggggtagttttaccccaagcccccctttccaaaaatttttccccgggtttttccgaaaacccccacccaaaaagccctttttaaaaaggggggttttttttttttaaaagttagcccccccaaaaccggggccatttttttttttttttttttttggcccaggcccccgttaaagccccattaattttttttttggggggcca

SEQ ID NO: 703241 - DNA, 481 bp, Homo sapiens
gagagaactgaatataagcctgaatatgagctataaaaatgagaacgaatgttctatcaaatatttatataaatagttaatcttatgagaacctatatatcttcgtacagagccatggtataaattaacaggttaatgtcagtcatcagatcttccttctcttcctaaggatgcttgtgttgcctccatctatcactctatctttcttgtaaagggttagaatactctctctctctctctctctctactttcttcttagagacatggactaacccatgttgtctaggatatagggcagtggctattcacagatgtaatgatagcacattgtagcctcacactcttaggctcaggcgatccttcaagcctccggggagctgtgaccaccaggacgtgcaacaaacccagctctctattcttggcattacatcatttcatgtatctatcaaagcccagcactctctctcctgcagggataccc

SEQ ID NO: 703242 - DNA, 1698 bp, Homo sapiens
  misc_feature (1)..(1): n is a, c, g, or t
ntggtctgtctgtgtctggctatacgtgcttgtacttcgtacttagctttgtctctctgttcgttctctttcttagctcttcttgtatctcgtgctgtgtgctttgtttgattgtgttgtgtgtgtagatttactgttgcttgtgtgtctcgtctgtcgcttctccttttgctcacgagcgctgtcgtgtgacttgtgtgggttggaaagcactacaagttgttgtgggccccttgctctcttgccctgggggagcacccacatatccccaccgtggttttgtcccctccctatgagagaaccccgcgggggcctcgaatccctactcttctcccgtggattttttttactccttataggccccccggggccgcgggattccacgcaaatagggtcgcgagacaccacggggtgaccctaggcttttgttggccccacatttaggccccttcttattttatggggggaccacacacttatataaggggacccaaaacgtgtgctgggttgaccacgaaaaaaagcacaaagggccttgggggtacaccgggtttctccgcggaattttctcccccgggcggatatcttcgcgtctcgaagaaccaccaacacgatgcgtggttctcctgcaggtcctcgtcccggtggtaacacaggaagtttgttatgggttctccttataaaagggggaggagaagccaggggggggtgtttttttagaagtttcctcaaatgttgggcgtacaacccaggcgggataagaaataaccccccaagagcgtttgtggggccttgtggggggccgcgccaccgcccccacaattgcgacacacaaaacctctgggtatgtgtaccccggtgggtaataaaagaggccggcgggtttcccgcgtgtttcctcccccccccgcgggggggaccacagacgccccttttatcacccgcccgggccacaaaaaagagttgtctctcgcaagaaaatagtcacagagccgcgggccgcccctttagagagggttctccccacccttctggcttttacactgttgggccccggggtgaacctgtggagcccaatttatgtgcccaccagatgtttttggccgggcccccaaaaactccgggataatctctctgggcacaacccgtgggggacactgggttcacattaccctccttataagatattgagagcacttttgtcgccacaggtgcaaccacatctccctccccacagatgagagttgcggggcgccacaatcacttctccgccacagagtctctcccacaggcgcttgtgtgctcaacgcccctttttgaagcgccctcttctgaaggagagtgtgtttctgagcacgaaacgagaggcacagctgttggggcacaactggtgcacagaagcaatatatgcgcgcccgcgttctcttgcacagtgcggctgagagcacaggtgcacagcccccacaccggtctacacctgcacacactgtggagggcaccacagccaacttcctgcctcctgaggactcctttgaaacgcacgggaaactggaacacatgaaatgagctgcccccccgcccctcccctgcaagaagtggccaagaatggaggtcctgaggaccctggaacacatgggcccggctttcctggatatcaggacttcccaataaataaagactccgtatactgggctttga

SEQ ID NO: 703243 - DNA, 202 bp, Homo sapiens
  misc_feature (25)..(25): n is a, c, g, or t
  misc_feature (29)..(29): n is a, c, g, or t
  misc_feature (32)..(32): n is a, c, g, or t
  misc_feature (46)..(46): n is a, c, g, or t
  misc_feature (54)..(54): n is a, c, g, or t
  misc_feature (60)..(60): n is a, c, g, or t
  misc_feature (76)..(76): n is a, c, g, or t
  misc_feature (85)..(85): n is a, c, g, or t
  misc_feature (95)..(96): n is a, c, g, or t
  misc_feature (104)..(104): n is a, c, g, or t
  misc_feature (112)..(112): n is a, c, g, or t
  misc_feature (123)..(123): n is a, c, g, or t
  misc_feature (132)..(132): n is a, c, g, or t
  misc_feature (146)..(146): n is a, c, g, or t
  misc_feature (155)..(156): n is a, c, g, or t
  misc_feature (173)..(173): n is a, c, g, or t
  misc_feature (192)..(192): n is a, c, g, or t
ttctcgcctccgtcgctggctactngtcnatnacgtcgacctgcgngggtgcgngctggncacgattgttgtttgngctctcttntggtcctatnngccctccngcgagagnggggtttcggngcctaccgntggctacgggctgngggtggtannctaggtggtgtttaacngtttctacgaccgttccgnctacttgggc

SEQ ID NO: 703244 - DNA, 1123 bp, Homo sapiens
  misc_feature (488)..(488): n is a, c, g, or t
gcggtgagccgagattgcgccattgctctctagccagggcaacaagaacaaaattccgtctcaaaaaaaaaaaaaccaacattagattgccctcgttttcacaatttggctgtttcccattgggtctattcttcccatctgtctgttaattaccacttttctctttaattagtattagagtacaaagctgcagtgtgtagtagcggattaggtgccctcctctatcctatagtcactctggggccgtgctattattcaaatttaccattagaacggggcgttgcactttaaagaaattaaaccattttatttctcggtggcagtctcttggaaggctccatgaaagttccactcttcagaagaagccgtgcgcagattcatagttgttccagcaaggggcccagcttctccgggtttggcaaattagactcgatcatctcttgtggggctttccttcaccatgtgaccaagacgcgcacgacgagaancgccgggcctcctccatgatgctcttctcttattaacgacgcacttaattcctcatttcgagaaagggatcttatactccttagtggctctcattctaatgtcctaattttactctcccagagcagtgttcccctttcgtagattacctatattgggcgcagcataggctaactaacacgtgttacgtagactttttggggactggaactggccacaattattttccaatttggccaataaaacagccctttcccacaggcagagtgagtctctaatcacgagggagactccttggggcatacttctcacagggcccactgcggtccgtcgcttattttcaccagggttcttttgcagaacaggtacccctttttgtacttaaaacttcacacacggatgacagcgcgaaaaaccacacacacagtgggcccgctggcgtcacatttttcccattcagcacaattattacaccctgttacgggcctttattttccaggaacagaagggcttcaacatccatataccgtgaattcccttaacgctctccgtttgttaaggcaaccacacgggcgccatttgttgcccacttatagtggcatcttaataccgcgaatgtctttggcacgcgtgttca

SEQ ID NO: 703245 - DNA, 713 bp, Homo sapiens
tggggggggggaaaggttaataaattttggctcttggacccacggcttaattatggcccttacacggaaaaacaaacacaaaaactggtccaaaagatgaactaaaactcagcagtggtctggtgtatcaagacgcttcctggtattgtttaacacgcctgatattgggagggataccgatctggctgtcgcctttgcagctcactgtcttacgcccaaatgtaatatgtctctttgggatagatacctccactctggtgcagatatcctctgaataatgtccaatctcaaaatgttggggatttccctcctcttaaattttcttaaattatttgggactatgcatgtttgtccgccaaactggaggtatccatgggaattcctatgtaaatggaaatcacctatacttggatactggaaaactggccaaatacataggaatttccttccttaaaaaacatgtaatgaagactattatctcctttccccagcactgatgtgtttctactagcacgggtgtgcctccccatgcacctgaaaaactgtgtggaacctcaaagtggtcgggacagatttccaagcatgtgcacctgattgttcctgtctccaattttaataattccccttttttgtttttttcagagaagtttaatatttctctgccctttttataacgtaaaaatgatttctcggccttgaaattcgctccagaa

SEQ ID NO: 703246 - DNA, 144 bp, Homo sapiens
gaaaaaagaaaaaaaatttgggaaaaggttagaaaaaaaaaaaccccgccccgggctttttcttttttttttcaaaggcccccagggtttaatggtcccctggggtatttttttcccgttttgtttttttttttcccccaagga

SEQ ID NO: 703247 - DNA, 106 bp, Homo sapiens
gctggactctccctctgtaaccctgtgaccacagggggcgcccccactggtggggcaaagggcttcaacttaaaagggaacccccgagcaggtttcggaacctcca

SEQ ID NO: 703248 - DNA, 1217 bp, Homo sapiens
gcgaagatcttcctcatcacaacctcatcactctcaccctgcttcgtgagatcaagatcatgtctccgagaaaagcccttattccggtggagtccacgaagtcgattcccaagtccagaggtgtgtgggcgctgagatctagaaatatagtaaagaggaggctagactgcaatgactgtgctggaggagtgtgaaggaaaagttgtgttgcaagagtggctaacgtggaagtgagctgagtcttgtatgggcaacgttgtacaaatctatcatgatgcgatttgtgactgccttgaactggtaatgcatggatagatgcacttacgtaatgggactacatctaagtgccgtaccaaatacacaggcaataccattgatagggacacatggatacccagtgtaatcgtacagcgagccacgtgccggtactaccgtaatgcaggtgccaggtagtgacgtatgcaagaacaaggcgtgctgagacatccgacctaaccacgtccagtgtcgcgtgatggtacggaccacatatgcttgccacggaaacggagatccatgaaagaatgtgggctatagagcaatacactgacgaaaaactacgcggtgcccccaaagagcgacaatacatgcgtcaccctcgtgctgtagaacaaggccccagtcgggcgaggccgacccctgggaacaccgggccctgcacggcagagtcgccaatacttccaacggaaaggcttgcagagtgaggacacaccagaaagcggaccacgcaaacgttagcccagaacggggagaagcaccgaaagagcaagggacacagacgaacgcatcaatggcgcacaacgtcacccagagctgccacagccaacatgctaagaagaccgccaaggccatgccccacaagaaaccgttagaaagcactactttgaggagaagtaatctgtggctgatataacggacaagatggtacagcaccgagggggacggggcaccgtctcaattggaaaggagggatcctcggtgcaaacgagaattcccatatggagggaagagtaggagtacgaacatcggcggtatcaaaagtagtgggaagagtgtggaagggatataaccgttggacaggcattgtagagcgtcaaccagcagataaatataagcaaacagacttggaaggcgtgtatatggggatccgaacaggaagaagacgcaatagaaattga

SEQ ID NO: 703249 - DNA, 297 bp, Homo sapiens
cttttaaaaaaaccggttttttttggggcccccattaaaaaggttaaatttcccccctcaccccctttttgggggccccattggggggcttgggggaaaaaaggaattttttttttttttttcccccccttttttgggggaccccctttggcccgttgggggttttccccccccgttaaggctggccccggggccccttttgggggtttcccggttgggggtttaaaagtttccggttaaaaaacccaaacccaaaaaagggttggtttttcccaaataatttttttggggggggga

SEQ ID NO: 703250 - DNA, 188 bp, Homo sapiens
ccactgtcagattgccgctcttgtcgatcgcgaggcccgtcggggtatcaaagctggcattggcgccaaccccatcggcatgcccggaactcaatacagcgccagccagcagggtcagcgcaccggtcgggctgatcttctggatggcctgggatccactggccgtgactttcacattgcccacgtgg

SEQ ID NO: 703251 - DNA, 1034 bp, Homo sapiens
gtggacaggccgggctcatttgcctaatgcaatgcggctgaactctcgctgaactcgcctggcggcgcctcacctccgagtgagccaaccaccgatgccgtgacatcacccgcatcgccagcacgccgaggggctcgcccagcagccccatgacccggccgaaccgggccactacccccggagaacgcggacagcggcggcaggaggcggtacagcacgggacgccgcggggccaaagtgtcaggcacaccgggatgtgacactagtgcacgacatcgcgaagctgggtcgagaagcgagacacccgacatcgccatccatccgacctgccgaccatcaatgccgtcacgtacaagcacgccgaacaccacgacgccggcacccccgcagagcccgacgacacacacaccacaggaccgacagcggccctcccatcacacacgacacaagaagttgcacacccagccgaagccaacgccccaaaccacacagtgacacccaccctgggcaaccaacgaaccgagccaccgggatagcaagagacacagacacatgacgacgcatcacacgagaacgagcgtgtagacaacaacaagaaacaaaccacacccaaagaagaccatcggctgagcacgatcacaacagaagacaggcctacgcttgcaataagaccccacaaccaccgcgccaccgcggaagaagggggtatcgtactcacacccacactaaggaccgagcaactgcacatgaccccccgcagtctagtgaccaccccgccaccaacgagcagcaacaataagcaacccaagacccggcacagcagccagcagccaaacacaaaccaccaaacgaagccaaacatccagcagagagacaagcacgacccaaacgcagccgcagcgagagaacagacaggctacaggcagacagaacgcggtaagaagcaacgaggccgcaaccagccggcactaacgcggaaccacacgcgagcgcgagaaacacgcacagccagaacgacgaaagaccggacacca

SEQ ID NO: 703252 - DNA, 300 bp, Homo sapiens
gggtttccctttgtctgaaggaggtgttagatgtgtgtggtgtgtgtgtgtgtttgaaggacgggtgtgttaggtgtgtgtgtttgaaggaggtgtgtgcagtcaacaaaggctggtgtgtggggaacacatcacagtctagatgtgtgtctgggcgccaccttgattttgagagtgtctttgtcatgaacatgtggtatctctcatcttggctgttaggagaaactgtcatagaagggacacgccacattttcaaaggcaggacaggttggggggctggaccgcagacaaagggaaaca

SEQ ID NO: 703253 - DNA, 428 bp, Homo sapiens
  misc_feature (21)..(21): n is a, c, g, or t
  misc_feature (140)..(140): n is a, c, g, or t
gtcggaagaacagggcttgtntcctaaaggagctggaggctgtagtcaacagaggaagtccccaaagatagcaggtcctaacagcctggaaactggcagtattgtctcatgtagtcacagggacttttagcaggaatgtntgcgtcaacaaagactggtgtgggacttttagcaggaacatgtgcagtcagcaaaggctggtgtgtgtcttttagcgggaatgtgtgcagtcaacaaaggctggtgtgtggggaacacatcacagtctagatgtgtgtctgggcgccaccttgattttgagagtgtctttgtcatgaacatgtggtatctctcatcttggctgttaggagaaactgtcatagaagggacacgccacattttcaaaggcaggacaggttggggggctggaccgcagacaaagggaaaca

SEQ ID NO: 703254 - DNA, 813 bp, Homo sapiens
cctgctcctcctgggctctctcttgctgccttccccccggcccgagtccgctggtcagcgccaagtgacttacgcccccgtaccctgatcccggagcgctaggcgagtgatgatcagatctccgtcgtacgagattctgatgtgtgccctgtgtcctggaggagttccgtcccagtccctgcggtctccctggtactgtcggggccccggccctctttgagcttcagtgaggcgcgccgtcagggtccgcgcggacgctattttcgtggctccggggtctcagggaagtggcggcgcctgggtctgcggtatcggaacagagcctgcttggagccaagtagcgcgctccctctcttggtacagacgcccttcggtcccagtgtccatggggtgcgaccgttggtcgcctcctctctgggcctgtgctgctggcctggccgttgcccgtccgcccaatatcgtgctgatctttgccgacgacctcggctatggggacctgggctgctatgcggcaccccagctactaccactcccaaacctggaaccagctggcggctgggagtggctgctgttcacagacttctacgtgcctgtgtctctgtgcacaccctctagtgggccgcctcctgaccggccggctcccggttcggactgggcatgtaccctggcgtcctggtgcccagctcccgggggggcctgcccctggaggaggtgaccgtggccgaagtcctggctgcccctaggctacctcacaggaatggccggcaagtggcaccttgggggtggggcctgagggggccttccttggcgcat

SEQ ID NO: 703255 - DNA, 298 bp, Homo sapiens
acaggcgatacatgtaagtataccagaaagtagcacatgtcccatatgtggcagatgctccggaatgttgagggcctaccgcacgtacgggttgttgaggtagagatggaagcagctgttgtagtaaggtagcagggggggtccatgcgcacttaatcccctgagcgcagcagtgcctgatgccacatccgcttgagtaggcaggcgagtgaagatagtagcccaaatcctggaccacaacagtgtccttctcatacctaaaatggctgggcacccctccagcacacggggcatagag

SEQ ID NO: 703256 - DNA, 187 bp, Homo sapiens
tgtcatggggagtaaaaattcttcatattgatgacattagatactacattgaacaaaagaaaaaagagttgtatttactcaagaaatcaagtacttcagtaagagatgggaagccctgcagtccatttgatgtagacaagccatctagtatgcaaaagcaaactcaggttaaactaagaatccaaac

SEQ ID NO: 703257 - DNA, 150 bp, Homo sapiens
ggagttgctctgtggtagcagtacccagagccaggcttcctggaaggggtgggcctctgtggcattggtactctctgttctttgaagagaactagagctgcccctcatgcagacaatgcacagctgcagattagatgggcagccctagtt

SEQ ID NO: 703258 - DNA, 544 bp, Homo sapiens
  misc_feature (13)..(13): n is a, c, g, or t
  misc_feature (86)..(86): n is a, c, g, or t
  misc_feature (99)..(99): n is a, c, g, or t
  misc_feature (112)..(112): n is a, c, g, or t
  misc_feature (132)..(132): n is a, c, g, or t
  misc_feature (144)..(144): n is a, c, g, or t
  misc_feature (153)..(153): n is a, c, g, or t
  misc_feature (188)..(188): n is a, c, g, or t
  misc_feature (237)..(237): n is a, c, g, or t
  misc_feature (274)..(274): n is a, c, g, or t
  misc_feature (283)..(283): n is a, c, g, or t
  misc_feature (316)..(316): n is a, c, g, or t
  misc_feature (339)..(339): n is a, c, g, or t
  misc_feature (343)..(343): n is a, c, g, or t
  misc_feature (357)..(357): n is a, c, g, or t
  misc_feature (359)..(359): n is a, c, g, or t
  misc_feature (364)..(364): n is a, c, g, or t
  misc_feature (373)..(373): n is a, c, g, or t
  misc_feature (384)..(384): n is a, c, g, or t
  misc_feature (390)..(390): n is a, c, g, or t
  misc_feature (403)..(403): n is a, c, g, or t
  misc_feature (543)..(543): n is a, c, g, or t
ggttggggttctngggaggtttggggtgtttttgatatctcattctttacaaaataattaaaaaattagttggggatggtggtatntgcgtgtggcccntgggtattggggngggtgaggtagggggactgnttgagtccaggnggtcaaggntgcagtgagccaagatagtgccattgcactccagntagggtgacagagtgagaccttgactcaaaaaaaaaaaaaaaacaaaanaaaaaaaaaaacccattggttcaaaaatgtgggaaantgggcacanttagttttcgacaaatccagttttccagtttcntttttcacagattgttgccaggngtcntttagctggcagantntcccngtgcattcnaaaagcattcnggttcncagaacaggtttntatacacttttcaggaacacttctgctgtgaaaaatacaatgtttgtagcactgggactccaaacaaagcctgaaggggaagatgcacttaaaaatatttattaaagaggccgggcgcagtggctcacgcctgtaatccna

SEQ ID NO: 703259 - DNA, 437 bp, Homo sapiens
  misc_feature (177)..(177): n is a, c, g, or t
tatttcatagggcggcttatgaatgagtgcctggcgcagattcacgtgccctggcagggtctcctcccctgccctcagtatcactttggcgttcttattgttattaaactgatgggactttgtgtttttatatgactctgcggcgcggccctttaaataaagctaggatacgccttnggtgcagctaaaaaaaaaaaaacaaacaaccacactcatcaaaaaacataaaaacaccaccccccgcgcgccccttatctcctggcgcggccacaacaacaacctacacaacacccccgcccttcctttcccacaccccacctttcttcaacaacaagggtgaaaaacggcgccgcgccccccaaaaaggagggggacgccaaattacacaaaaccacgcgctccacctcctctttattcatacacaccagcaacaccct

SEQ ID NO: 703260 - DNA, 158 bp, Homo sapiens
tgatgcggggaccacagacaaggtgcgaggccgccgatgactgcagcgctggctatactcgtccgtggtttctaggcatggctgggacgaacaggtcttttggagatggtgttttcttgggatctagcctgtttccaactggaaagcatgcccacggg

SEQ ID NO: 703261 - DNA, 265 bp, Homo sapiens
ggtctccagtattaccatctgttgtcaaaagtcccaagtagagagcatagcaatgctatacaacaaaagagaacaagtcactgtttcaactgcaggctgtgaactgtatggccttccaagctgttatttggaacgttgttttaaataaggccaacactataaaatctgaatttctctattcttggatttaagttcatgcctcagcatggtcctggtaccgggaagacagtgtctttgaataagttgcagacctgagcaagccagg

SEQ ID NO: 703262 - DNA, 109 bp, Homo sapiens
cattttaaggcgaaaaacaagtctgtgagaatatacttgagtatttatacaaacaagctgcaactactattcaaaaataggtttttttcatccaataggagtatactct

SEQ ID NO: 703263 - DNA, 545 bp, Homo sapiens
cagaaaacacacatatgaggcaagctctactgtcattcccattcaatatgctaggagatgagggcctggagaagttaatgaattgcagaaggtacacgggttgttaagttgcaaagatagaatctgaacccaggtttcaagttaagaactccactgtctgtgttgtcaggcacattgtctttcaaagaagcaccaggaaatgcctggatttggactaatttctcagaagagaaacttcttcccataacctaggctatctccaagggaatgtaaatatgaagattatccttatagacagtgtaaaatagagattattttctagtagtttgtgggccgaggcttgtactctgtgaaacacaaaacagttgagcatcggatctttaaacctggaggattttacttaaaaaagaagtctggattgccagctacccttgaaaaattggagatttgagctaggctggactcatattcccacatggccacaatcagctgcagtttttatctgctgttcctgctagatagatgtgtgtcctctggttgccaca

SEQ ID NO: 703264 - DNA, 515 bp, Homo sapiens
aagaacggaaagcttttaccctgcaccttccttgcagggaacaattatcttgccaaaacgtctttccctttcatctcccatttctctgtacccagtcccttcctgctccttgccaatgtgatcatgctttcttctctataaatgctaacatttgaagacccctttcctagggcacttaaccatccagtcagaccatcacattcagtagggacttgtcttggctaacagcagtgtatccatctggtcagctctactgagggaaggggccaagttactgctgccctctaatctgccctctggtcctatatctattactgtgtccataggaataataggtaagggctagtctctgtcaagccatgtaacaaaggacactgcaaaatgtctggcatcagaggggacatttggagaccaacttgggaggaaaatattcattttgtattgaatgatttttaatgaatgcaatattaatccttgcagatgagcaataatcattaaaatcagttaaaaatgat

SEQ ID NO: 703265 - DNA, 158 bp, Homo sapiens
  misc_feature (38)..(38): n is a, c, g, or t
cacaaggaacagcttactttttgccagatttcttaatntccacctagtggcgcaagggcccctttccccgctggccttctgcttttagctcctccgagttttctatctgctcctcttatttgtttctgcttgaaagccttatcttcctcgtccatctc

SEQ ID NO: 703266 - DNA, 250 bp, Homo sapiens
ttcaagatccccctggggactccttattaaaaattagtatatcattttgttgtccttgtgtgtgtctcatattggggtttcatgctatcaaagcaaatactaacaaaactgaataacacaatacgagagcaatacaattttagtaggatatttcaatactccactttctgtaatataacaagagataatattagtccggaaactgaagactagaaggcagtataaacaactattattttcaattaaggat

SEQ ID NO: 703267 - DNA, 743 bp, Homo sapiens
ggctgagctggagtcccccgcgcccccgcgttccgcccggccatggctgcggtggcgctgatgccaccgccgctgcgtgctgctgctgctgttggcgtcgccggccgccgcctccgggccgtccgcccgcgatcccttcgccccccagctcggggacgacgcagaactgccagctgcggtgccggacctgcgacctcgtgcccgcagccctcgcaggcggggcttggagggctgcctccgagtctccctatgacagagcctgttctagatcagcgcttgcgagctgtggctgccgcctcttctccatctgccgatttgtggccatgaagctccaagcccaatgccacccaaactgagtgtgaagccagcctgcgtggaagcctatgtgaaggaggcagagcacgcaggcctgtagcgcacggctgctggagccatgcccgctggatgcctgagcccggagcaggaagagaaaggtcctggaggctccaaggtggggccctctccctcttgtgactgtgttattccaccctctgcaaagtgaccttgtcaagtcagcccaggggattttgtctccatccacctggacatactacgttgcagactgacaatgggaaagtggtggtgtttcagactcagcccatagtggagagcctcggattccaggggggcgtctgaagcgcgtggaggtgagctgggaggtccaaccctgaagccctggaggtgaacgtggacctgtatgcccg

SEQ ID NO: 703268 - DNA, 678 bp, Homo sapiens
  misc_feature (472)..(472): n is a, c, g, or t
ccgggttcacaccattctcctgcctcagcctcccgagtagctgggactacaggcgcccaccaccacgcccagctaatttttttttgtatttttagtagagacggggtttcaccgtgtttgccaggatggtctcgatctcctgacctcgtgatccacccgtctttggctgccaaggggctaggattacaggcgtgagccaccgtgcccggccgattgtagctcatttttaagggagtgattaatttaacaatggggtgcagtgacatttttatatttgtgatctgtgctgattattggaattgaaggaagtgtcgacatgggagagggggatcaagggtgggggtattggggtttgtggggaggatggatccttatgactatgaaatgattgaagttgtcttgaaagttatagaacgagctggtggatggccaatgttgatattaatcaggggtggcggatgtatcaaggatntgagaatcatctgtctgctgtgatgtggatcatagatcatatcattatgcggggcctttgcggatgatgcatggggtgccctgtctctggggtgtattgtaggttgttgggtaggagtgtggcgtgagtgcttggttgtgcggtgtgttgggtgggttgaggtgagctggtgcgggttgtgaagggagtggtgagtgactgggggg

SEQ ID NO: 703269 - DNA, 192 bp, Homo sapiens
tactaggcctaacctcagaatctttgctgggtctgtaggctctgtccgggtggggcagctgccagttcgctcacactctggcctcctggctgttcctcctgtttgccttcctctcctttccattcactgtgtattccttcaccaagaccttgggggcctttgtttgtagtcgcagttgattcatgcgagctt

SEQ ID NO: 703270 - DNA, 294 bp, Homo sapiens
ttttgcagttagactggtgatgcacaggcccccttctccccgggccaggctcctgtcccgcctgggcactgcccactagtgatggcattaggtccggatgctgttctgtctctagctatcggacaccttcgcaaagatttctttcaggacagtctcaaaggctagctccacattcgtagagtccaggtctgaggtctccaggaagagcagtccattgtttacagcgaacattcggtgctcctcagtgggcacttcccgtgcgtggcttatgtccctttcgttacccacgagcat

SEQ ID NO: 703271 - DNA, 249 bp, Homo sapiens
cacagtgctattagtgtgtgttcagtgtgctccaggaacagaaaaaaacccggtgtggttggagtggattgccgcgcgaaaagcacgtgagtaagtcagaggttctggccgggcagatcgtgtacggcctacaggcattgtaaggagttcggcttttactgagagaaatgtgaagacattgcaaggctttaagagcagtgccatcacctgactcacattttagcaggattgctatggcatctatgttac

SEQ ID NO: 703272 - DNA, 685 bp, Homo sapiens
tcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagtggtggaagaggcagaaaatggaagagacgcccctgctaacgggaatgctaatgaggaaaatggggagcaggacggctgacaatgacggtagaccgaagaacgacggacagaacggtggggacggaacgaggacggacggaacgacacgacacggtgatggtgacggacacgaggactggacgatgaacgactgacggaacgctggagtcagctaccggggcaagcgggcagctgaagatgatgaggatgacgatgtcgataccaagaagcagaagaccgacgaggatgactagacagcaaaaaaggaaaagttaaactaaaaaaaaaaggcggcgggacctattcaccctccattccatctcagaatctaaacgtggtcaccttcgagtaaagaggccgcccgccaacgggggcagtgccaccgcagatgacagcgcttccacaccaaccaacatggaattgcacgggggaac

SEQ ID NO: 703273 - DNA, 863 bp, Homo sapiens
gatagcaaccatatccggtgggtaagtgtgcggtgcatttgtgatgtgtcgtcactctataatctgctgatgtaatgctactctaggaaccgttactttcttccatgctgtcttgtgactgttcaaaagtcttgttcgtgagatagctctatttgacacaccatgtctgacagggggaatcgtaggagccatagattctctaaaacaatattaagtgagtctccctggtatgctgcagtgtatggtgcaacgattgtgttagtgtgctgtatgctaactattcattactgagagtaccgatctcatgagcatgtgctgtacatccttgctgtcttcccgtgagtatagtaattgtgatgagaaagagcgcttgtacagggaaaagttgttagtgggaaatccttggtaagtcaatagagagacagacatattattttttacattacaaagtaccaaactcctaatggtaattaagttggtgccgaaatttatacccctactcaagtcacttgttggacctctgtcgctagctatctttataattggggctttgattgcttcaacatagcctgcgtagatcctgatcaagacgtagtaagaagtgacagtaggatctggccttcggagtacttgtgctagctatgtagtagatagtgtttcctagtcgttcggcttctaggatgtctcttccgatatactttcaaattgtcattcctggcattggtactcagtaacttaagctggcgtattcatacctcgagtgatgcttatcttaacaatgatttgatccctggggcacttatatttggttacacacttacttggggcgattggaactggttgtaatcgggagtgctgcaaca

SEQ ID NO: 703274 - DNA, 110 bp, Homo sapiens
atgagaggcaagagtgaagacagtggaggagactgactgatgaccatcacacagtgttaatgcggactggggcggcgccatgaaaatcccgttatttatacagatataca

SEQ ID NO: 703275 - DNA, 241 bp, Homo sapiens
  misc_feature (66)..(66): n is a, c, g, or t
  misc_feature (92)..(92): n is a, c, g, or t
  misc_feature (97)..(97): n is a, c, g, or t
  misc_feature (99)..(99): n is a, c, g, or t
  misc_feature (179)..(179): n is a, c, g, or t
gccgtctgcaagctgggttagagagaagccagtagtggctcagcctgatttcaaaaacctcaaaantggggaagctgacagtgcagccagcnttcantntgtggccaaaggccaagagcccctggcaaccaacccactggtgcaagtcctagattccaaaggctgaagaacctggagtntgatgtccaagagcaggaagagtggaagaaagccagaagactcagcaaacaaggtagacagt

SEQ ID NO: 703276 - DNA, 379 bp, Homo sapiens
tgttacctgcagtcgatctagaggaccccgtaggatcgtatgagagtctgcttgagtatttagccccacaatccttagggctggctcgccggttcttctgctcagcctatatcctccgcatctatagtattcccagctcgcaatatctcatctaccaatcgaataatcaccagccgtacatgactaatcagggtaacgtccgaaaatactgttatccagcacgaaactaaaggatgagtctgatctcttatacgaggtatccttaagtgactagttattgccacaagtaatctcctcggtactcctgcctcactcatttacaccaaccacccaactatctataaacctagccatgggcatccccttatgagcgggcgca

SEQ ID NO: 703277 - DNA, 140 bp, Homo sapiens
  misc_feature (4)..(4): n is a, c, g, or t
  misc_feature (8)..(8): n is a, c, g, or t
gtgnaacngcatttgcaatcggatacctttattaagtcaagaattcccttgcacgcagggtctgagaaagcgacagcgtagatgaggcgaggcgcaggacgctcgcctggtgccgggtgccggctgcccactgtgatccc

SEQ ID NO: 703278 - DNA, 167 bp, Homo sapiens
acacattggcttcatgtagaaacagtggaatatagaacatctgtttcacagatctgggactgtgggaggccaggacacgattcggcctctgtggcggcactacttccagaacactcagggcctcatctttgtggtggacagtaatgaccgggagctggtggagcaat

SEQ ID NO: 703279 - DNA, 148 bp, Homo sapiens
gttagagcattggcaagcgtacgggcaggcctcctagggagaggagggtggatggaattaagggtgttagtcatgttagcttgtttcaggtgcgagcgccattcaacgcctccgggccattcaacgcctccgggccattcaacgtccg

SEQ ID NO: 703280 - DNA, 184 bp, Homo sapiens
cagcgcgcaggtattatcgctacgcgatgtgtaatccctcgtgaacgtgttatccctcgccacacgtgttatccaacttatgtcttcctcagcgaccaaatatgatttaccatctcttggagtccaagactgcagtagagtggtattatacatttgtgcataaagaatcagtttaatttttcaa

SEQ ID NO: 703281 - DNA, 769 bp, Homo sapiens
  misc_feature (31)..(31): n is a, c, g, or t
  misc_feature (268)..(268): n is a, c, g, or t
  misc_feature (541)..(541): n is a, c, g, or t
  misc_feature (553)..(553): n is a, c, g, or t
  misc_feature (575)..(575): n is a, c, g, or t
  misc_feature (577)..(577): n is a, c, g, or t
cttcatgtcccgctgtgggaggggctctgcnacgccgggactgtgagatggccaatgacggtctgacccgttgggccgggccaggtcgcggacaacgtcgaccgtttgtttaagaagcgtggactcttgtcctgagtgcaccgaggctttcagcctgcgggacagtggtgcgatttgcattagagaaagggagatgccatgtgctggcccagcactccaacaggggcctgacctctaggaacgggacactggaggaagcctagacatntgaacaaatcaagtcatccagatccacggtcagctcctgccccgacttggccttcctcctgctgggctggcccacggacctcgggaacctgccctggctgtgggtgacctgcagcctatctcccaggactatggaagccccatgcaggaacatggttctgacactttggggattataccctaagcttaaaggactggaaaagcccctgaagtcccgagaccacaaccctccaccttctaaagataagacaagtcactgaaggtctcagaactntggcccattcancccttccctcaagacaagagtntngccaagcatcaatctcacccccagagaccagacggtgtccaggtcttgggcagacgaaacctgctccttggggatggtcttcctggctgtgcttccaaagggctggcctgcaatcagctggttttcacttgatcctttcggggtttgcattatatctgactgaaggaatgaactgggagagaacagcagagc

SEQ ID NO: 703282 - DNA, 408 bp, Homo sapiens
acaagtcctacaaaaattgacctgtcatggtggcgcatgcctgtggtggcatatgcctgtggtaacagctatatgggagtctcagttggaaggatcgcttgagcgcagaaggacaagcccacagttatccatgtccatgccagtgtattcaggcatgggtgtcagcaaaccgtgtcataacactgattaaggaagtaagtccgatctaattaagctagctattcggagacaaatgcattgagacctttgtggctcagtgtatacctgtcgctaattccaagtagattacagggttaactatgtataataataatattcgcaacgccacaatagagaaaaagattgacaagtgcatatctcaccgttgcatatgattcctttgtctaagcaaaagagtatcagaagaat

SEQ ID NO: 703283 - DNA, 807 bp, Homo sapiens
ctgttcacatgttcagagtcacctgacccacagcatatatgcgttatgactcaaccctccactcctgattctcaagagtgtatcacctgtcagccaaatgaacttgggatatgtgtgggccattctctaaactgtgaatatgttgtgcctctattaatgcttaatatcaaagactatatcaatgcttttcttgttgcccacctctaaccctaggataacagagaaacatacctatgcaaaggaagttcaagacttaagtctttccttaaggatcagcccaacaatgacttctcagtcaaatggattaaactggaaaatgatttctatgttatcatgttcgtaacacgagatcatcctaggcgaaagttttttttgtttccgtttgcttttaaattagtttatttctaaatcttagtcttccacatttctagaggccacctgacacaagtcccctgtatctgaagtctagcatctcaaggactgatctggatagtgtgctagtactgctccctagtggataacttaatcttttaatacagttcacgtcattcccctcttgttttcagaagagaaggtggctacagccaggcataacatatccactgtgtgcatagagggtctcttcacgcttgatgcttgtgcattccatcagctttctctcaagtctttgatcaagttcaaccttaagaggatgatgttagacaacaggtcccagtgcagttccctctattttcacccattttgcctcacagccataattggcccgattagtgtacctgtcgatcacgcggtgatcctataagtacg

SEQ ID NO: 703284 - DNA, 572 bp, Homo sapiens
  misc_feature (31)..(31): n is a, c, g, or t
  misc_feature (344)..(344): n is a, c, g, or t
  misc_feature (356)..(356): n is a, c, g, or t
  misc_feature (378)..(378): n is a, c, g, or t
  misc_feature (380)..(380): n is a, c, g, or t
cttcatgtcccgctgtgggaggggctctgcnacgccgggactgtgagatggccaatgacggtctgacccgttgggccgggccaggtcgcggacaacgtcgaccgtttgtttaagaagcgtggactcttgtcctgagtgcaccgaggctttcagcctgcgggacagtggtgcgatttgcattagagcctatctcccaggactatggaagccccatgcaggaacatggttctgacactttggggattataccctaagcttaaaggactggaaaagcccctgaagtcccgagaccacaaccctccaccttctaaagataagacaagtcactgaaggtctcagaactntggcccattcancccttccctcaagacaagagtntngccaagcatcaatctcacccccagagaccagacggtgtccaggtcttgggcagacgaaacctgctccttggggatggtcttcctggctgtgcttccaaagggctggcctgcaatcagctggttttcacttgatcctttcggggtttgcattatatctgactgaaggaatgaactgggagagaacagcagagc

SEQ ID NO: 703285 - DNA, 342 bp, Homo sapiens
gttggtttgcttttccttctatgtgggggggttaccccttcccaaaaaggggggtggggaaaaccccccttttggcccctttttttaatggaaaagggggggcccaactttaattttttttaaagggttgggaaattgttttgggggaaatttaaaaaaaaaggtttcctttgagggcccctttttttggttttgggggcatttcaattttccctgggtttttaaaaaatggaattttttgggatttttttttcccctgggaaaaaaaaggtccggtttttggggattttgggggggattttttccctcccttttttaatttcggcccttttttggccccca

SEQ ID NO: 703286 - DNA, 949 bp, Homo sapiens
  misc_feature (31)..(31): n is a, c, g, or t
  misc_feature (268)..(268): n is a, c, g, or t
cttcatgtcccgctgtgggaggggctctgcnacgccgggactgtgagatggccaatgacggtctgacccgttgggccgggccaggtcgcggacaacgtcgaccgtttgtttaagaagcgtggactcttgtcctgagtgcaccgaggctttcagcctgcgggacagtggtgcgatttgcattagagaaagggagatgccatgtgctggcccagcactccaacaggggcctgacctctaggaacgggacactggaggaagcctagacatntgaacaaatcaagtcatccagatccacggtcagctcctgccccgacttggccttcctcctgctgggctggcccacggacctcgggaacctgccctggctgtgggtgacctgcagcctatctcccaggactatggaagccccatgcaggaacatggttctgacactttggggattataccctaagcttaaaggactggaaaagcccctgaagtcccgagaccacaaccctccaccttctaaagataagacaagtcactgaaggtaaaatcagctcctcagtgtctccaaggacaggaatgccatgggctgggaggcgccatgggtgaacagacttccctacttcctgcctccccaagggtggggagcagtctaggggatggctgtactcctgggcccagtgtctaagtgaaaattaggaggaaatggagggagggtggcgagcgaggacagactggccaaggtcccccgcagccactcctgaagtcctcacgagggagaagcagcctctccttccagccttccccaagtcctccctaagagtgtattctactggtttctgtgcagatttttttcggctgcgaccaatagtagcttaaacatggattattttctttttaatttcttcctgcaaaattcttaggaaaccattaataaaagtaatatacatgtgaaataataaaa

SEQ ID NO: 703287 - DNA, 213 bp, Homo sapiens
cgggaggtggtgccttcctcatgagacgggcagcaaccccttcccacgcttctgtatggcacaccaattaggcctcatggcagatttttttttattctgctcccacctcccacccgggactactggcgggtgccttttttttttttttttttttttttttttttttttttttttttttttttttttttttttttttttttttttttttttttt

SEQ ID NO: 703288 - DNA, 194 bp, Homo sapiens
ccttggagctttgcaccctcaggaatctttgtgttgttagcaggagagcaccgtgcttggttggcctacctgatgccacagagggagtggattcgtgggtacataccgtggtgagcagtcacagggttactccttttacaacaccagctgtggtcattacctttctgctcttgccctagtaccaatacgcggtc

SEQ ID NO: 703289 - DNA, 230 bp, Homo sapiens
ggcagcctgggaacacctccgcttaataggcgttgttagagacgaagagtggactcgctggctgcagccccagcctgaccgctcggagtgtactttccttgacaggcgaggctgttggtcgggactcgcttgacatactcctcctgcgcagccttcagtgttctccttcttcccgccccaggccttcatggcagaggcctgcagggctcggccgcaggagaaggtcaggg

SEQ ID NO: 703290 - DNA, 445 bp, Homo sapiens
  misc_feature (329)..(329): n is a, c, g, or t
  misc_feature (339)..(339): n is a, c, g, or t
  misc_feature (366)..(366): n is a, c, g, or t
  misc_feature (392)..(392): n is a, c, g, or t
  misc_feature (401)..(401): n is a, c, g, or t
  misc_feature (421)..(421): n is a, c, g, or t
  misc_feature (437)..(437): n is a, c, g, or t
gttgttggagatgtgagtcttcccgaagctcctggccgaataaagcctttccttctttaactcagtgtctgaggggttttgtctgtggcttgtcctgctacatttcttggttccctgaccaggaagtgaggtgattaacagacggtcgaggcagccccttaggcggtttaggcctaccccatggagcatctctgtggggggactccggccagcttgagcaacgcagatcctgagagtgctcctggggtaggcaatttttcccagttggaacgccttcaccagagcagttgcttgggcaggcccctgttggaggatccaaacgcattggnctttaaacgncgggaaggaacttggcaattttggganttccagaaattttgaaacttttggtnaagatttantttttttgggaaatttgccnaatttccatttttganttggaatt

SEQ ID NO: 703291 - DNA, 390 bp, Homo sapiens
ccttccttccctatggaagctgcggaggaagcacctcctcactgtgggcacgctggaaccccagggagaggctgcctggtcacaccagagtgaagtaactgaccaaactcagcagggaagggcaacaggaagcccagaaccaacctgtgcctgccattcccgactccccgcggccctcacacagcttctccgcctctgagcccttgagggtcctcttgagcttcaggaccacagagttgctgagcctacacttctactgtctccagcttttggaatctagccaaagtggctgtctattctcccagggccctggtccctcctgcccgcttgtattaagcaaccaactgtcgaacattttaatttggtgaataaaaatctcttgaccctgga

SEQ ID NO: 703292 - DNA, 227 bp, Homo sapiens
  misc_feature (130)..(130): n is a, c, g, or t
ctaggctggttttgtttgagtccggcttgcaatggcggggttctgagttgctggagagaggaggaggactgagaaaggtgagtctctagcttaagatttttgggggggggcttgggagttcgggatcctngaatttttcgtttggggtcaaagacgtggtgttggtggcatataagaggggaagaaaatgtgagatagggtggttttatatggtatagatgaaggtg

SEQ ID NO: 703293 - DNA, 120 bp, Homo sapiens
gtgaattctctgaatactgtcaacactctaatctaagtttgcctttatgatgcagtggcagcattttgaattcctttaaaagaatactgttaatataattgtttttgtgttaaacctaaa

SEQ ID NO: 703294 - DNA, 542 bp, Homo sapiens
  misc_feature (195)..(195): n is a, c, g, or t
  misc_feature (197)..(197): n is a, c, g, or t
aaaaagggggggggggggaaaaaaaaaaaaaaagggggggggggtcccctccccccccccccggagaaaaaaaaaattttttttgtggtttccccccccccccctttttttttttctccccccaaaaaaaaaaaacccccccctgtgggggaaaaaaaaaaaaaattttttttcgccccccccccccccctaggngngggggggagaaaaaatattttttggggggaaaaaaaaaagctttttttttgccccccccctctttttttttttgggggcgaccaagttgtttttcccccgggctcccccccccccgggagaaggcgcctttctaaataatatttctctcccccccaaaagaatgggcccccccccgtgtgtaaaaaaaaaagagggggccccctccctctggtgggccccccccctttaaaaaggaagaaaaaaaaaatgttgggccggggggcccttaatcccccaagcccccagggggccctttttttaaggaaggataaaggcccgggggttaacggaaccttcccgccatg

SEQ ID NO: 703295 - DNA, 757 bp, Homo sapiens
  misc_feature (181)..(181): n is a, c, g, or t
  misc_feature (658)..(658): n is a, c, g, or t
cttggcgcgaggaaccccctcttgtgtaaatgtcctcctctgttccgccccgcgcgcttgtggtgggagcaccttcccgctctcgttccctgatgctcccccccccttggggtcaaccgaaattccattatggggcccgcacacaaggtatgttcgtcgtggaagatttggatctcgcccnaagaccccgcggtgttattcacacccgcgttatgtgtgatggcggtggtgaaagaaatagagagcgagaaataggagacgtgctaacacatatataccgttacataaaatacatttagttggtataccccccctgtgagattcatctgtccaacacccttctattggcccccccctccccccatgtagtgggacacccacccgcgccaattactcgcgggataccattcagatttactcagctgccacgcaaactcctttcttgtaaataacccgcggagtatttaagcccctctttacgttacagccccactgttttcccactctctcacgccgttataatactagtaccaagacctatgtttttacccgcagttatagcccgtagatacaggcctttctacgtttcgtctgttattctaaactccttttacatcccctcgtcttcttcttgtttgggtagatccaaccacctggnttatactttttattcgtgtgcggtgtttcccccgcacatatcatccaacaacaatagaaagaaagatcctaataatttttaaaaacactcatcataaca

SEQ ID NO: 703296 - DNA, 889 bp, Homo sapiens
  misc_feature (250)..(250): n is a, c, g, or t
atcaaatcaggcgacaggtgcccttctcatctgtgataccctcctggctactctgttccttcatcatcctgtcctgctagtgcaaatgagcatgaaaggccacgcacaattcgctgacacctgtggactagcagaagtcgatagtttgtactctaacctcagaaacatcagtatactctgacgggcatccatgcatctgtgacctggcaggtcaaaaattgaaagtgcatatctctgcaacgagtgggtntcacaagtgagaaacatccagatacacccaaagtatcaggaccgagcaatgagggtcctttgggaaaggagaagttaagcaacatctagcaaatgttatgcataacagtcagtgcccaactggttataggtgttggactaaatcagtggttattagggaactgcttgacgtaggaaccgtgtaaatttctgtgcggagaagttcttacatgttttctttgcttaagtgtaactggcagttttccatttggtttacctgtgaaatagttcaaagccaagtttatatacattatatcaggtcctttttccaaatggtagccatcatggatccggtagggggaaaatgtgtcatttgcattaccatcttttcaccattgggctattttaaagacaaagacaaattcctgtttgcttgagaagaacgaatatgagttactggtgtggtatggcttaaatgacctagctgaatatcactaaaaaggcgtcctttccaacttccacagtgtgtgtgcaattccacagtgagacattccgcggtcaaactgggcctacaattttgtaaccgtcccacggggtgggattaacaacaccttcaattgggtacaactttgtgcccaaaaaactttcagggcccgcctgg

SEQ ID NO: 703297 - DNA, 685 bp, Homo sapiens
  misc_feature (231)..(231): n is a, c, g, or t
  misc_feature (335)..(335): n is a, c, g, or t
ttctgcagcgatttaagttggtacgcagggttctcccagtcatgacgtttatatcgacggccagtgatttgtatccgactcactatagtcgcagttgggtacgggctctgcttagagttcagaggtttaataaattgatgatatgttggtttaaattgaaaagtaccgatgatgcacatggtttggactgtcagcagcttaagtagcacagtgtcttacagagatacctanagctaaggctggtgacacctacctggcgtggttgacctggtatcagtcgcagtccctatgggtcagcatagctgtcatatcagatcccaatgatgtcggctganaatcaagccagactgctgtgcggtcagcttgccgccgtggaatgccctgtgtcttggccatgtccagccaagggtacaacgtgcttgttgccgatcacgcaggtttgccattggaagtcaaaggcagaatcgcttcatggcactacagatgtggaataataataatctcagctagaggtgctgataggagggtgccccaacttcaggaggatcatgtgccgcctgtggttgttttcagggtcacttgcagcacacgcagcgtccccttgatgctcgatgtggaccgcagacgggcctgcagacctaacccctggctgtggacaggagagtctgctccaggcttctttcct

SEQ ID NO: 703298 - DNA, 278 bp, Homo sapiens
gaagacacctgcagcaatgcggatttcagtttcggggaaggggacgccaacggaacctgctttacggagtgccggatccatggggttgccggcgataatgggagacgtctctgtaagcccatatccttcggtaatgatgccaccggtggcgttttcccactcttcaacaagttccatgggaagagacatagcgccggagaaagcgaggcggacacctttaatggagatcttccgctttttagattcgcgcaatatacgctggtaaatgggtgtcatca

SEQ ID NO: 703299 - DNA, 142 bp, Homo sapiens
ctggttgtacgtagtgcatgcctgctacaatatagccctatagatagaccttgaaagcagtatgctaagtgaaagaaccccactcaaaaggctacatactgtatgattccctttatttcaaagtatcttgaacaggagaatc

SEQ ID NO: 703300 - DNA, 319 bp, Homo sapiens
ggacggcgtacagagtgttgtagatcaccccctccccaataaagctaaaactcactgagttgtaaaaactccgttgaccagaatagactacgaaaatgggtttagctattctgaacacacaatagctaagacccaaactgtgattagataccccactatgcttaggcctaaaactcaacagttaaatcaagcaaaatagctcgcccgaaacactacgagccacaaggttaaaagtcacaggacctggcggtgctacatatacctctagaggagcctgttcttgtcatcgatagatcccgctcgatctacctcacctctt

SEQ ID NO: 703301 - DNA, 342 bp, Homo sapiens
  misc_feature (262)..(262): n is a, c, g, or t
gaggaactctatgatggaagatgcctaacctgtgatcagaacctccaaatactgccatgagaaacgagagggcaggtcttcataaaagccctttgaaccccgcatcctgccctgatgttagagagatacgggatatctggcccctacactgtcagactgccagacactgtggtcatgtcactactcagccgatagcagctttgttcacgtgtcctgtgtcagaagcactgacgctccacccattttcgtgagagttattacnacccagaacagtgtgcggctgaagactggttggctttcacacttgtggcgcggcggactcctctagacgtcgaccctgca

SEQ ID NO: 703302 - DNA, 414 bp, Homo sapiens
tgagacggagtctcgttctgttgcccaggctggagtgcagtggggcagtctcagctcgctgcagcctcgcctcccgggttcaggcgattctcctgcctcagcctccctagtagctgggattgcaggcgcccgccaccacgctcggctaatttttgtatttttagcagagaccgggtttcactgtgttggccaggctggtctcgaactcctgacctcaggcgatctgcccacctcagcatctcaaagtgctgggattacaggtgtgagccaccacacccagcctcatcgaaattttaataggcattgcattgaatctgtaagtcacgtgcagtggcatcttaacaatatttagtcttccgacccatgaatataggatgtctttccatttttctaggtcttctcccatttctttca

SEQ ID NO: 703303 - DNA, 977 bp, Homo sapiens
attaaacttttttaaacatattatgatcattgtgcatgcggacgatgcgttgtgatgccactaagtttaacctatctaccgtactcaagaatgtagttaaaagatggttacagtgtgcaggttggtaacataatgaactaacatctcttttgccagtggctttaaactgcaaataggttaaagaatattgttcttgtaggttaaatttttattctttttttcttatatgaacttatttttaaaaattttgtgagtacatagtatgtgtatatatttataccatatatagaatattttgatacaggcatataatatgtaacaatcacatcagggtaagtgaagtatccatcacctccagcattaccctttgtattacaaacctattctacacatttagttcttttgaaatgtgcaattgttattggttacagtaaccaatttgcatggaatgtctatttccatctggccactttggcaagtggcaagattttggtcatgatttgttttatggtcataaataagaattgtatagaagtattaataaaatccatacatttctgaattctgaattgtatagaagtattaaataaaaatccatacatttctgaattctgaataaacatttaaaaatttgtaatattttcctttaaacatgtggtcttactgcctgcaaagacatacagacgtcttattttaattaccgtaaatgtagtatcagatatttactctagagaataacgttagggtaagaaagtataaagaagggtggtaggatgtgaattgtgcatattcaaaagaaagagaaagtgagaaaaaaacttaaagtaaagggtgtaagagataaagacaacaaatggagaggagtacgaggtagatgaaagggaaaggaaacaagaaaaaaaaagggggcataggtgagaaaagaacagggaggggagaggagaaaaaagaagaagagttataatgtatatataggg

SEQ ID NO: 703304 - DNA, 905 bp, Homo sapiens
gcagatacaggctgacagcctctgtacatcgtaggtccacacctctcctctcctccacagagagggtgccgtcagaatcccctgtcgctttctgtgatctgcaagtggggggcagacaggcgcatcagagagccatcttcacacagagctttccagagaaacgtattaattcagaagcaagccaaagacccctggagcctcaccacaaacaggccttttggagtgtgaattggagtcgaagatacacagatcggagaatgatttttctggtcttaactaatcctcgctcttcatgtgtgatctattaagaagtcatcactccacttgattgtcagctcttctgcgtgtacattcgtggaagaggttaagagagacatctcagccactttaggacgcgccgaggcgcggtggatcaccttgacggtagaggaggttgtgagactatgcctggccaagtagtgtgttaaagaagccccctagtctctactagaaagactatcaaaaggaattagcgcggcgcatggtggccactgtgtctgtacgtcccaggctactcgcgtgaggctgacgggcagggagaatcgcttgaaacccaaggaaacgggaggtcacagtgacgccaaagaatcatgccatctgcatcttccaggctttgggtgcaattcacaaggcgaaggacctcgttgttctacacttcagatgggggagacataccccgctcgagggccacatttgttctccggcgtgggggacaccgagggggcatgagaaatttggggccccctggggcatattaggttgtttcccttgaccccagtttttttgggccccctcttgggtaagacttcttgcccggagtccgcaatggttcgggtcggatggttccggtggcccgggtaactggt

SEQ ID NO: 703305 - DNA, 176 bp, Homo sapiens
ggcagtgcaccgcttggtttacctgcaaggtcggactactatgaggactacccctttaccaagcagctggagatgcttgtaccacgtggccaggcacacaggaacgtcctagacgctgattcgacgttctatcgagggaggatgtgaccgtcttctacctgtgtgttttgcagaag

SEQ ID NO: 703306 - DNA, 637 bp, Homo sapiens
aaaaaaaaaaaaaaaaaaaaacccaaaaaaaaaaaaaaaaaaaaaaaaaaaaaaaaaaaaaaaaaaaaaaaaaaaaccttttcggcccctttggcccaatcgtttttaaaattggcccagcttttgctttgggccccaatttgggccaatttggccaatttccccttatggggggcgttttaacaatacatggcccgggttttaaaaccttcggctgggaaaaaccctggggttaccccatttaactctttttgaaaaaaacccctttttgcccagggggctaaatcccaaagggcccccaccggatgccttttccaaacttttgcccacctgaaaggccaatggaaaatttaaagccgtaaattttgggtaaaaatccgcgtaaaattttgtaaaaaaagcgcctttttttaaccaaatggtccaaattgtgaaaaacccttttaaattcaaagaatttccccgaaatgggctgaagtttttccaatttggaccacagggtcccctttaaaagaaggggcttccaattttaaagggggacccgttttagaggcaagggcccatttggagaccttacccttatggttttggggttaaggtcgccaagaccctttaatgggccctctgggcccccctt

SEQ ID NO: 703307 - DNA, 146 bp, Homo sapiens
ccccccccattgctttccagagcgaactgtgctgggtgctggccctggcgttttgcagctttccggcgtccggaaggcagtgagctcttgtcgctggatcccgtcctgccgtttccatgccccctgttctcagtagcggagcctca

SEQ ID NO: 703308 - DNA, 125 bp, Homo sapiens
taaagaaaaaaaaatcgaccataaaagtaaagatagtaataaggtctggtctgtatgtctcttcttatgccagtgcaatgtttggattgtggtcgcgtgaaaagtaagtgtgggggataacatca

SEQ ID NO: 703309 - DNA, 603 bp, Homo sapiens
gataactttgagggaaattttgagtcactggtaccttgcggtagatttgctaagaagcagccatggtggcgtaagcatgttcggagcaggtagatctggaccttcagcagaaaagtatatgcgtggcgaagcccagctgttctattggaggtgtcactggatggtgcacatggtttcatattccagaaggttggacagttggctgcgaacagctgtgggaggtggattacctctccttcagcgttgcaatagcatactgggtactatcaaagtagactggcaacgagtggagcaaggacatgaagaagagccgaagagcagctgaagatccgtaagagcaatcagatacctactgaggtcaggagcaagagctgaggaggtggtgtcatttgtgacagacagaatgtcctagtaactgcgtggattcttcggaggctttctgcttgggccttggcatcgctaaggaagcatgacctcatgtgcatggtgtcctgggttatcccaagcctagccagcttctacatccatcataggacatcgagttcctccctcctcttctcgcgatgcctttcttccgtggccattggcccacacatctggctg

SEQ ID NO: 703310 - DNA, 216 bp, Homo sapiens
tcaccagctggcaggtgctggcatgcctctgttacggcacgggctgtggacagccctcacacttgttctgggacggtggtgtccaacttctcccgtggcctcacagggacaccagtggctatcctggcgtgtggctcgttgtgggcaggcacctttgggttctgaccaggctgctggcccagagagctccactgtctactacctgcgtgatcaaca

SEQ ID NO: 703311 - DNA, 134 bp, Homo sapiens
tttgtctgcggtatgaactgcagaggggcaccttcagcagaaagtaggccgtcttgaaggcgtcaccaactggtccacatgagcaccatcttgatgctcaatgccctccgtgggaactggctgcgcggctggtt

SEQ ID NO: 703312 - DNA, 771 bp, Homo sapiens
ggtcttcactttaccccagcactctgagccttgtgcgtcagctcatcgcaagagtagtagcagcattggagacccatcctctgacccccttggctctccaaccctcctggctttgtgaggcgccttgagccctactccgtgcagatgccacccctagccaatgtctcctcccgttccacccaaccggtccagaatggccctggacagtagtcccacatccgaactccagcaacttcttcttccatcccatctaactgagactgaccattagttgctgcgttcacagtagagccagcgttggggaccaccaaagcgtgccaccacgtgtcttctcttgagacatggcctctctagcacaatcttgcacgtaaatacagagacaaaatagtttccacatcttgtgccagaggaatcctggcagcccagagactttgtagatccttagaggtcatctggagccctaaccccttgccagatcactgccacactcgtccatcaccctcttcctgtgagtccacccaaccctatctcctgacagaagggccacttacccacgtagtacactaactcaccagccccactgccagcagcagcaggtgattggaccaggccattctgccgccccctcctgaaccgcacagctcaggaggcgccttggcttctgtgatgagctgatctgctgatctcagctttgagaagcatttcagctccagggaatcgaagcctcacaccagcgaggacaataacagccatgttactgaagacgaacgg

SEQ ID NO: 703313 - DNA, 170 bp, Homo sapiens
tgggattacaggcatgaaccactggccctggcccaggcctactcttaaaacctcatttagcacacgttttaacacaatggctccactcctaaaggctgacagaaatttctaaaaaattgcaaataaaacccaattccatttaaaaaccccaaatcccctctaaattaaac

SEQ ID NO: 703314 - DNA, 406 bp, Homo sapiens
gtttccactccctaggcaagttttttaaggcaaaagggggttccctgttcccaaagtttgcagccatcagcaaggaggaccaggaacccggcgattgaggtgtttccaggtggggacaagccccttttggtttcagccacagcaccccttattccaggtgccctgcccaacctgttcaccccaaaatacctttttgtgtattcagcaaacactcattaggtgacagcggcccccaggttttgtgttgggggacgaaattggccctggcctcgaccagtttaaaggtttttcacacctttgttcccagggccccgctcagggcccagcaaaaagtccgtaggcttgaacatgtgttgagggcatgaaaaataaatgctgttcatgtgtgtagctcaaaaaaaaaaaa

SEQ ID NO: 703315 - DNA, 211 bp, Homo sapiens
tgaccgtagacgctgtgtatgtggtgttgtgccggagttcccttagtggtgagatgagttggcgaggatcacttaagttcaggagttcgaggctgcagcgagctatgactgtaccactatactccagcttgagcaacagagcaagatctatctaaaaaaaacaaaaaaggactctaaaataaaactgatgttcacatagttcagcgtctga

SEQ ID NO: 703316 - DNA, 839 bp, Homo sapiens
ggcgcgctgtacagccgcgccgcgtgttgccgcggttgtatcttaaaatggcgccgtagacctggacaagtatgtggaaatagcgcggtgtgcaagtacctgccagagaacgactgaagcggtatgtgactagtgtgtgacctcctcttagaagagtcaactgtccggccagtatccaacaccagtaaccagtgtgtggagatatccagtggacaagttttatgaccctttgtgaactgtccaagaactgaggtcaggttcctgaacaaaatacatatcatgggtgatttggtcacgacggaggtaactataagtgtgagacctacaacttaaccttctgtgcattaaaaggctaagtggcctgatccgtataccatttgtgcgaggaaatcatgagagtaggacagataaccacaggtcctatgggatttaatgatgaggtggcagaacaaattttggaaatgctaattgctgaagatactgaaccaaaagttttgacatgctccacagtaggcagttaatagatgagcagatttgtgtgttccattgggtggtttatcctcctgatatcaaacagttggattcaaatttcgaaccatcgaggggaatcaggaagtcctcataaggcggcatttggtgaccggtgggcagatctgagattgattcctgcgtatcagtcccgagaaacggtgttttggagcaggcaacaagcgttggtcacttcacactaaattctggggagcaatcataggacaagcaaatttttggagaactggaaatgtcgccaacggacggggaatagcggtgtcaaattatacaaaaattcggcaaaggtccaa

SEQ ID NO: 703317 - DNA, 131 bp, Homo sapiens
aaattaaaaggggggtttttttttccccctgggatttttgtttgggcccaaaattgcccccctttttgggggtgaaagggggtttttttacaagcccaaacccccaaaaaaagggttttttccctggggga

SEQ ID NO: 703318 - DNA, 279 bp, Homo sapiens
gtccatggacgtgacagaacggataaacaatgtgtcatatgtatgccgtggagtattactcaggaataaaaagagtgccgtctggagccgggcgcggtggctcaaaactgtaatccccagactttggcaagcagaggctagacaactgcttcatcccaggcatttgagaacagctttgggccatgtggtgagaacctgtctctctttctaaaaaaaaaaataataaaacactcaaactagatggggggtagggggaaaccaaatgaggttgatatttgg

SEQ ID NO: 703319 - DNA, 124 bp, Homo sapiens
tttgtttacgttccgagaagacctagcggttggcttctccgactcagacgccaagatggggaagtcattcgccaatttcatgtgtaagaaggacttccatcctgcgtccaaatccaacatcaaa

SEQ ID NO: 703320 - DNA, 778 bp, Homo sapiens
gtttaagatgagcattccctaaagcggtcatctcttgatctctctcccccactctggcccagtatgaccccacagcagtgcctcagtggttgtgacagggcatgcctgcacgtctgtcagctctggagggttcttgagagcccgatttccctctaacccagatcgtcaggtatgggatgccgccaagaatatggtaagcaggaggaggccgagagcgcccatcagctataggatcgtgtaagcttgtgataggaccacagccggagcttcagcttacgtagagatgctggtgatgcccattagactttccgtcttgtatcccaaatatggccatggtagtaggattctttaaaggtaacctaggtttaataatagtttcccttggttaagtgtcctctttgcgctatgaggtgcttggttactttcaagcttcttattctttgcctgtctcttcatgcaaatattaaatgcctacgcaggtgcactgttctagctatgtccgggaacaaaagcaaaggtcccttgtaaatctgtgctttctaaagtgactgggagtaggggggattagtgggagagcagacaggagaaataagctcatatcttatggaatcgaggcaagtggttaggtaaactatatgccaagtatcatatggattacagaataagaggcatcctggccctgtgctcaaaatcaatttaggagaaacaaattataaattgggtgtagaatagggtgggtcaaattttttccaatcaggtggagacaggttagagaatt

SEQ ID NO: 703321 - DNA, 1578 bp, Homo sapiens
  misc_feature (1535)..(1535): n is a, c, g, or t
agcatataggcagtgggcttgacgtacctgcatggtggtcggtcatccggtacagcacccagtgtgggaaaacgaagagcaccgttatcaatcgacgagtgatcaagttctggtacgccgtaagacagtagttcactgggtctggtaccgtagagcatggcgaatcgtgggagagggcgagcatacttaacccggtggcctgcgtagcagcgcctagcttctggtcgctgtgagagagctttacgcccttggcaactggtactcgaggaccggtgacaggtcagtcgcgtgaggcaaattcacatgtggtgccatgggctcggcgaaggcgtcacgactgtggtaccagcagagtcctgtcccatggcagcagcacgaatgttagtccatccggcgatgtctgggaacattggcgaggccatagatagtgaggctagcatgtctagtctttgtgctaccgcaatagccactttcctagtcactcgcgaaggaccctggggagcatagttcattattcacgcctgctcatggtcgcaggaaatggtcactcactctaccatgctcggttcaggtattcaccattcccactctttggcacaccatctgaacatatccaagggaacaaaggacgctcttggccttgatgagcgaaggtcctaaaagtgctggggcactggtaggaaacaagtggcagatcggagtagcagatacgcgtcataagaatggttgtcccattccattgtttccttccctcagtgccgaggcaaggtgagtgacctcggggaatgggattgtgcaggaacagaatgtcccccgcaggggtgcagttctaaggaaggcaacacttggaagaacaccatttcctgtatactgggagacgacggatacacggggagctctacactggtgccaggcgtggtaccttgtgatgactgcggcgtcgtcacatctcagaaggcccttttcccaaagaaacccccctatggaccggaccaaggcgtggaagcgcgcacggcaggcgagaagatcaaacgtgccgacagactaagcagacgggggtcaaagcgggaaggaaatacatcaccggccacttatgaagcgcccctgcaaccaggcacccgggtgggcaacgcccagcgcgatgggccgacgaccagggactctacaacctcagtacactgagaccacagcatcggagactctccacccacgatggcaccaaagtggagccgtcacgaacagcgaaaaagggaccaaggagcaacagggcagggagaaacaaggacgcacggcacaccaacacaaacgaggagaccccacgaggagcaatactcccgcggagcaaaacagaggcgagacagacaagcagacacacccaagcgaacgacaacaggccaaacccaaggcgcacacgaccacacacgcccggacagcacaagaacatccgcacacgacgaatcacacgacacacacaaacccaaagcatggaacacgacagcaagagacggcgacgcacagcgacacgacatcgacgngaccggaaaagcactagcaacccacaccacaacaactccacgc

SEQ ID NO: 703322 - DNA, 232 bp, Homo sapiens
  misc_feature (72)..(72): n is a, c, g, or t
  misc_feature (102)..(102): n is a, c, g, or t
  misc_feature (107)..(107): n is a, c, g, or t
  misc_feature (125)..(125): n is a, c, g, or t
  misc_feature (151)..(152): n is a, c, g, or t
  misc_feature (167)..(167): n is a, c, g, or t
  misc_feature (173)..(173): n is a, c, g, or t
  misc_feature (179)..(179): n is a, c, g, or t
  misc_feature (194)..(194): n is a, c, g, or t
agatggtgagaaaaggtccaagtggattctaaaattagatatagcataatagctaacgcttggcttcagggntggccaaccagacttaaatgaaagattcanttganaagctcatgaaagttgtntgttaaaacatttgttacactccacnnaccactgcaaaaaantctgantatcangcaagataaactcanctcagaaaaatgtcatatctggggctctatcttttggt

SEQ ID NO: 703323 - DNA, 876 bp, Homo sapiens
tggaaatggattctcctctctttgtggcccagggttgagatggtaccagtgcgactgggccggggtgacaaaccaaaactctgtctcaaaaaacaaaaaaacaaacaaacttttggaaatggattggcaatatgtctgctacttgggctggggcgggacagtttatctaataagcagaggccagctcctgggttgtgctagggtaataagccccttcttaacgaaggctaagctcccctcataaaaacgtggtgggtgttcctctttttattatttttgtggtaatgggtatctggatggggattctcgggttgtgtttggattctggtattctataaattcagcttctccaagtgtgcttttaataaggggggccaaggggtttaaccttttggcaccatattcccctgtgctgcgcgtataacggcgcccagcgtgaaattttcttcgcatacgagttgagacaaggggctacactgtgggcatgtgcgcttctgtgggcccccctttggtccctccactcctcgtcgtccctttccataaaccttcatcatatttaacccctatatatatcctctcccctcccctcctttttccgccctcttcttttttatttcccgcccccgacattatttgccggctcctgtgggagtgcgcccctcgactctactatctggacgccgcgtgccacgtgtccccccgcaagaacttgcgcgcacctctcgggctctgcgacgcgggggcacttctcccaagggccatctcaaaacaagtattgtggcgccccctaagaacctctcagcccggggcaacccccccggtgggcgtttgcccccgcgcacaccacctctgttgtggtgaatatctccccccctt

SEQ ID NO: 703324 - DNA, 719 bp, Homo sapiens
  misc_feature (3)..(3): n is a, c, g, or t
  misc_feature (6)..(6): n is a, c, g, or t
  misc_feature (82)..(82): n is a, c, g, or t
  misc_feature (210)..(210): n is a, c, g, or t
  misc_feature (235)..(235): n is a, c, g, or t
  misc_feature (247)..(247): n is a, c, g, or t
  misc_feature (273)..(273): n is a, c, g, or t
ggnctnttctttaaagatgtgtgtcatccatcccttggggccttctgctgaaaggaagaccaagtcccaaaaaagccttttnaatggtaccctcaagtaataatagatatagcccagtcctgtatcacacctcggtgaatgtaaaatatctggaccttgcttaataataggaagaagtgacggtgctttaacaagacctgttttaaatantgtaattcaagaatgtttcctttcnagataatgatcnagaagctaattttaaaaacgggtgcnaggtaccacacaagtacaagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaataaata

SEQ ID NO: 703325 - DNA, 258 bp, Homo sapiens
cagactgtggagccccaggccacaggccagtctcgccttggctctcatgactgtggtggtggagatagcgtggggagcctcgcccatggtctcacgtggcaagaagtgcctttagctctggaactaagacagaccgatgggcgcggctacttcggaggtcacaaggagaaaacaaaggaaggcttgcgaagcctgcaaccactagcgccacccacaagagccggcactaggagccacacaacgaggtaccgagctcga

SEQ ID NO: 703326 - DNA, 715 bp, Homo sapiens
  misc_feature (18)..(18): n is a, c, g, or t
  misc_feature (22)..(22): n is a, c, g, or t
  misc_feature (28)..(28): n is a, c, g, or t
  misc_feature (36)..(37): n is a, c, g, or t
  misc_feature (41)..(42): n is a, c, g, or t
  misc_feature (78)..(78): n is a, c, g, or t
  misc_feature (206)..(206): n is a, c, g, or t
  misc_feature (231)..(231): n is a, c, g, or t
  misc_feature (243)..(243): n is a, c, g, or t
  misc_feature (269)..(269): n is a, c, g, or t
atgattccttcacaaagntgtncatccntctttggnncttnnctgaaaaggaagaccaagtcccaaaaaagccttttnaatggtaccctcaagtaataatagatatagcccagtcctgtatcacacctcggtgaatgtaaaatatctggaccttgcttaataataggaagaagtgacggtgctttaacaagacctgttttaaatantgtaattcaagaatgtttcctttcnagataatgatcnagaagctaattttaaaaacgggtgcnaggtaccacacaagtacaagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgaataaata

SEQ ID NO: 703327 - DNA, 196 bp, Homo sapiens
gacagggaatgagctagtggaagaagctaagctggtcttcagaatctcagcttcatagattctcatctgtctggataaagcagtctgcaagccataagggcaggaaggttccaatcctaggtcactgtgacctttcctttctttctttcccaagactccgggctggaacaaggaactttcctctctttcacctctc

SEQ ID NO: 703328 - DNA, 163 bp, Homo sapiens
tgtctcagtttcgggacgtcatgattccaaccacatatcctccagcagcagcagtttgccgagggtgaaaagcgaagcctattgcctgtcgcttcttccaggaagtacgagagcggtcccttgtgcccgtgtacgcgctgtcgtacctctagagttcctcgct

SEQ ID NO: 703329 - DNA, 111 bp, Homo sapiens
tgtacggttggcactagagtgtaccaactattcaactgcatccaatgaaaataccctgacagcttgcagcctgtggcacaccatgtacctcagatgtagagctgatgggag

SEQ ID NO: 703330 - DNA, 658 bp, Homo sapiens
atattcacactcttgttatactttttttctccgtgtccgggaggcccctctcagaggggggccgagaacccggcgagagccgaaacagcgggggcgagggcccccctatccccctcacccccccgtccaaaagagcgcgagccgccccccccccccaaagccctgtaccacaaaaaaaaaaaaccaccccccgaaaaaatatccggctccacgggcgaaatggtccccaccgtacaacacaaggacatccttgcccccgcccaggcgacgcagccaaagaaccccacaaatcacgtgcccccatatccaccccccaaaaaccccccctaaatcaactccccgctgctccccccggccaataatcccctaccacgatcaaacctccatccacaccatccgctccccaaaacaaaccatgctctgcgcgccccccacccgcgtcccccacaccaaagctcccgcccacgcaattgctccatcttaaacccaaacgactcagcggctcaaacctcacaccagaggccacctccacagacaaacggcaaccacactcccaaaaaccaccacaccaccacccatcagcgacacaccacgcgacacccccgcggctatctaaacgagccccacccaaccccacataacgctccgatgactcccc

SEQ ID NO: 703331 - DNA, 104 bp, Homo sapiens
gcggccgcctactactactactactgctcgaattcaagcttctaacgatgtacggggacatgatcagtatgtgtttccatataaaacttttctcaacggaaaaa

SEQ ID NO: 703332 - DNA, 166 bp, Homo sapiens
ttcttgcggaatgaatttgtgcccttgaggcgctccacctggagccgtgtgctcatataagatagtgcacacattctggtctttgtcggggctaagtaaaacacaccgcgcatgtgtctcttaatttatagaggagtcactctacagggcgggtgctaccacacag

SEQ ID NO: 703333 - DNA, 334 bp, Homo sapiens
ccttttgccctctgcccaaatgtgtccagcacgttttcaaagtttccccattagccccccctaaggacgctgggaccctgccagtttatgatttggcctaggcccccccttttttttgtcccctgggtttaagtcaggatttttccagagggagctgtttccagccagctccatcaggaaccaagcaaaggccaaataccctgccaaataggctagtggtattgtgtaaatgggcgggacgggggggtcattattatttgagttaagctgttgtttaggggtaaatacccgtaaataattaataataataataataaaggagctgccgttttta

SEQ ID NO: 703334 - DNA, 103 bp, Homo sapiens
aattcaagcttctaacgatgtacggggacatggtggggtggtgattacacctgtgaatagccactgcactccagacttggtgacagagcaagaccccatctca

SEQ ID NO: 703335 - DNA, 176 bp, Homo sapiens
gtggtgtacctgctggatctatccagatgttgggaccaaataaccacatacctggaccaaccagacttctcccgtgagccaggcaaaggaaattgtcatctgccaactgtcctactcattatcctctcagtccttcttgggggtaagctgattacctgaacgacagctgaacccct

SEQ ID NO: 703336 - DNA, 417 bp, Homo sapiens
  misc_feature (12)..(12): n is a, c, g, or t
  misc_feature (70)..(70): n is a, c, g, or t
aaaattgccagnattaaaagggtttgcaaaaatgaaaccttttttttttaattttgaaaacgaagccctnaactctgtcaccccaggctggagtgcagtggcgcgctctcggctcggtgcaatctcccacctcccgggttcacgcagttgtcttgcctcagcactttgagaggcccaaggggtggatcgcctgaggtcaggagttcatgaccagcctggccaacatggagaaaccctgtctctactaaaaatacaaaaattagccgagcgtggtggttcatacctgtaatcccagctactcgggtggctgaggcagaataattgctagaaccagggaggcagaggttgcagtgagccgagatcctgccattgtactccagcctgggtgacaagagcaaaactctgtctcaaaaaaaa

SEQ ID NO: 703337 - DNA, 706 bp, Homo sapiens
ttacagccaggctacacagccccaccgcctccacctccaccaccacctgcctacaactcggctgtgtagggcggttactgcctcgagggtggtgtgtgctggtattggcgcttgaccagggatgtgctgtcttatgtagtgctgcccctgcggttccgaacgaggggattgctaagtcggtggatggaggcacccttaccgaggtaggtttcaagccgcagcgtgatatgtggtgggcttatctgccagaaccgctgggtttaactaacaacacggggataacagacaaaatccaacgaacagaggcagcgtactacctgggctccccagacaacaggccgccatgcactgcagactccgttcaccacagcacaaccaacctccgagcaagcccaccggcccaacgacccaagctacaaggcccatgctcgagaaccaccaccaggaagcgataagcaccctatcaaataagaaacaagcaaacatcccctgagctctatgagccacataacaaaggaccacaccacaaccagtcgccgcaggcatacacgcgtcttaccacagcacgaaatatagaaaccatatagccaaacaagaataacccaagcagacgtgtatacattcaatgggtatcaacactactcttctagacgacacaagacccacacagaaattggactacacacattaagacagatacagatat

SEQ ID NO: 703338 - DNA, 933 bp, Homo sapiens
  misc_feature (262)..(262): n is a, c, g, or t
  misc_feature (266)..(266): n is a, c, g, or t
gtggggacaatattcttccagatctctaaaaggggtcccaaaaagcgttgctgccccaccttgggacccggaaaattttcccccgagacgcctttctcgggcttttatacaccagtcggggtccccgacgcactctccgtggtgggtccgcccgctataagactttggggcccctccgtcctacataggggggctcactcccctcttccacccgtcgcatttctccgctgttctatcccttcgcggggcttatctcggcgancatnggtctcgacaattcctcaacgatgcaccggttgtgccttatgtcccccacccgagcgtccgtattggatatccccacaaggcccgtcgcgtctccccccccaaagggccttttgttgccagaaagacctccttgtgagtcccttaagatcagccaaaaagctatgcacgcaagttttggtggcgccacacgctcggaagaaaccccccgggggtgattaacccccaagggcaggggacattatagagcgcggcatctatcttgttcataagttgcccactcaccgcaggccctgtcttagcaataatgtcaatcaccgcaccaggtcgcttccgggtgcaaatccctggggtaccgccgcggaacgtatgggggcaccaaggagggggcacaacaaatcgaagaggccaaggcaggatgggtagcccccgcggacaacacgcaagagatctcggggtctgaccagctaagagccgcccactattccccaggaggcagtctcaacgcccgcggggatgcccacagggatgagggagaacgaccacggggggcacactagagacgcccccaaagggccctagagcgacgcccattgcggcccgctggatactcacgcccccgcccccatcccccgtggaccctaacctcctttcgtcaaacatagaaca

SEQ ID NO: 703339 - DNA, 636 bp, Homo sapiens
  misc_feature (177)..(177): n is a, c, g, or t
acccttgcttccctttcgaattagcttagcacattcttatcatgcttttgtttctctttgtgaaagactccaaacatcgaaactacgttaagaccagttagagcttctttcattataatccagttaggagacaattcatccaacttgtcttgattatgccacagaagctaagtgatnaaatcagaatctgaaaagaagaaacgaaagcattaagtgcatccaaaaataaacttgttgaacctggggatagtgtaagagtaggagactttctgaaagccactttggaaatatgattttaatgagattcattattgtcctttaaggtcaaagttgaaagagtagtctatctggctaatatcaaagaggtttaatttttgttgatttggagataaagcaagtataagcttttcattataaatatgtttttatacttggaaaataagaaatagaagcaatcagtagtcacatatgtgccctgtgatctggttcctgtgaacattttctataaatttaaattatacgtaatcatttatagtccagaagcaggtgcaatgtggatatgcaaagctgttgaaatgctatttttccaaagttggctggaaataataccatacacaggaggatgggtaccgtggt

SEQ ID NO: 703340 - DNA, 1379 bp, Homo sapiens
gggagaactagtctcgattttatttatatctgttctagggataaagctcttttatggtatgctttgaaaccttacaggggcagccttcgggtccgggggaatctgcgtgtccctgcgggtttttcttctagggtatgggaattattaaacggggatattaggggccccgggggtccaaaatctggccaagtgaagagaagggccccgtgtgtgtctggtgtccctcagatagcaaaaagtgaaaggcgggtaaagggtgaatagctccaggcgggaaagggtgacgggtgggcaggcgtgcagcccgtgggcgtggggggtggttcccgccccatccctcggtaccatgtcaaagcccaggccgcgggtggtacccaccgtggagttcagctgggagtgggttttgccgtggtgaatctgtgggtaaagctcgtgggtgacatcagaaaagaggatgtgcaggtaacatctccgtgcaaaggggaacattgtgggtgaattttcgccctgtttcgcgtaaagcctccacgctttacaagacttgtgggggacccaggtgagtgaaccgctcgtgacacgggaggctaatacaggtcacatgcggagcatagtgtctcaatcgcagatgtgaaaccctgcggagagagacagaagagactcactccaatcgatattcaaagggggccaaacagattcctggggggctacacccttgttcacaagagggggccaagggaaaacggacaaccgactgagagataacctacaagatgagcataacccccgggctaccaaacgcgggccaaagcatcgtggggggacacacacttcctgtgcaccacgtcgttggaagagaacttccgtgggagaactccccaagagggccccaaattaagcgcgggtatacaacaacaccacggcgcccttctacggagggaaccccggaagaacatccagctgggggagcaacccctctacagcggcggagcccaccgctatctaagccaagtatccccaaagggagctaggagaaaacattacgcatccagcgaagggaggggaaaaaggagctcatacgaccagatgcgggagagggcatcacatcaagaacgcatctgtcgggtggtagaaccccccccaatgtgaaggccgccccccgagtttgagaaaagatcgatgtgggtgcgcacaccaacacaaccgcggcgagaaaaacaggcggaccacaacaacggcggctcgagcaaacactagcacacaccaggggggaaaagaaatctacaccccctatgggaggttcgtgagacacccgctggtgcgagacacgagctattcaccccccgtctgaacaacatcatggtggcgcacctagaccaccc

SEQ ID NO: 703341 - DNA, 169 bp, Homo sapiens
caggatcgtctctgcacggctcaggactctcaaagcccgcagctgtggacagcccggggctctctgcgtcctcctctgtgctgtccacctcctctgtgctgtccacctcctctgtgctgtccaatgctgtccacctcctctgtgctgtccacctcctctgtgctgtcca

SEQ ID NO: 703342 - DNA, 124 bp, Homo sapiens
tttgagctcggtacccgctgaatcgtccccccaatggccgaatgaagccctaataaaagcaccaacgtgatcgtcgacgtggggccacttccgcgatgagaaagtaaaggctttagcgtgaagt

SEQ ID NO: 703343 - DNA, 123 bp, Homo sapiens
  misc_feature (91)..(91): n is a, c, g, or t
cctgcaaactttttctgtaaagaccagatagtaagtattttatgctttgtgagccatacagtttttgttgcaactagtcaactctcaactnacgtggacagcatgtaaagaacgagagtgact

SEQ ID NO: 703344 - DNA, 356 bp, Homo sapiens
gcggccggttgtatcccaacacatttattaatagggaatcttttcgcatgcttgttgtgtcaggtttgtcatacatcagatggttgtagatgtgtggtgtgtttctgaggcctttcttctgttccgtggtctatatacctgtttgggtaccagtaccatactgttttcgttactgtagccttgtagcatagtttgaagtcacatagtgtgatgcctttagcttagttcttcttgcccaggatggtcttggcaatacgggttctttttgggttccatatgaagtttaaagtagttttttccaattctatgaagaaagttagtggtagcgtgttgggcgataaatcacggggatcctc

SEQ ID NO: 703345 - DNA, 123 bp, Homo sapiens
ggtttgagatgccaagggaacctggtcttttgatttggggttcaacatacagaggtagcagtcaccatttttctcaaagcggtgatccttatttggggccctcaaaaggggacttgctttaaa

SEQ ID NO: 703346 - DNA, 172 bp, Homo sapiens
  misc_feature (9)..(9): n is a, c, g, or t
  misc_feature (21)..(21): n is a, c, g, or t
  misc_feature (41)..(41): n is a, c, g, or t
  misc_feature (64)..(64): n is a, c, g, or t
  misc_feature (70)..(70): n is a, c, g, or t
cttgggggnctggggcggganaatcgcttgggcccggtagncggaggtggcagtgggctgggantcgtgncgttgcactccagtctgggcaacagagcaaaaactctgtctcaaaaataaatgaataaataagtgcatcttaatctgtgcacagtgaaatctgcagaatttc

SEQ ID NO: 703347 - DNA, 421 bp, Homo sapiens
tccccaaggaacaatgctgggattgccactgtagggaaccccatttatccagtgggaggattcgatggcaatgaattttttaatacggtggaagtttataaccctgagtcaaatgaatggagcccctatacaaaaattttcccgttttaacaaatttaaaaccctctccaactaacaggcttagttatgtaattatggttagtaaagggcccctttttaataaaaagggtgggtgggtataaatttttctaacaccaacccaaagcttttgcatattgcaaactatttaacaacccggacaaaccttttgggtttttttggaaaagaaaccaaaaaaaaaggttttttttgtggacttttaaaactttggttttttttctttttggaaaaaaataaacccaaaattttttgggcccctcca

SEQ ID NO: 703348 - DNA, 399 bp, Homo sapiens
ccgttggccgttgttgttaaactggaaccgcgtctggttaagatcctcattaagtaatcaatcaagttccggccaagcaagttggttaccccgttaccggagtccatcccgattccaattgttcggccaaaagcgttcaaggataacccaacctggataaccacggacatggcttgggtgtttaaagtctccaacatgatttgggtcatcctcttgcggttggcccttgggttcaagggggcctcggtcaacaaccccgggttctccttgggaaccccaagcaactcaatggaaaaagttttggtccaaattttttccatgttggtccaatttgttaccattccgtgccccattggggtcttcaaggttaagaagcctttcctgctttgggcccccctg

SEQ ID NO: 703349 - DNA, 810 bp, Homo sapiens
acagctaaggcaatatatgtaacaatacactaagcataatgagcaaaacattggttatgcgccaaaaataaacgcaatgccaatgcttaaagtgtgcaccaaaagatttaactggcaggaagaataattagcacaataactgaggtagactaacacatgcgaagatctattagaatacacactgcacaaaggacaagatgtttatacatcacacatgagagacatatatcaatatgcaaacttataaggatccagtcgaacagtaacaaattatgtaataaaggatggaatagctacaacggaataactatgttacgaacagaaagcttcgacgaaggtagttggaccaaatctaaattgatgatagcgctggaacaagtaataccaagttgtcctacgaataaggaaatgccggtaataagtaaaatgcaaagtcaatgcggtttcgaaacaccgatggccagttaaattagggagacacattaaacctggaaaagtcatgaacaggggaatatgcggaattagacgaactttccacgtaagtgaactgaataggtatcacaagaatagagcaatacctttcgagttaaattgatacttaaataaaataagtaaaggtatacctttcaaaaaaccacattaaatgcacagctggggaaacaaaggtatccaagttgcataggggcacaccacacaaagcggaaaaaaaaagttaaagtggcttgggacaaaagaaaaatttacaaaaaaaacacataaagtttaacactcaaaagggagaaaaaagccaaggcaaacgcacaaagagca

SEQ ID NO: 703350 - DNA, 1108 bp, Homo sapiens
gcctgaacctgcgcggacgaaccctccggtgtccctgaccaggctaggcttgagcattggctgatgcaggagctccacagccgatcagctggcccagattgcaggcggagaactgaggagtgatgagtcacctcggtcaacatagcaaggtcctcctcgtgtctcgatgaagagctagtccatgcgagatccacggagctggattgaggacgacgacgagcctgcgaacagtacagaggaggctcctgctgggccagggttggccgtttcctgcagaatcctcaaacagtcgcccaacgtcgttggtgactggcactgaacccatgagatgtgcagctcgggcgccggggccccgtggcagctgggacctagacggggcgcacctcggagaatgcttccaacgaagcaagtcggtctttgtcgctttggaacgggagcggttgttggatgtcacctgtgatcatacaaatcctcgtttgcccgcgagttcataccccgcacggagatacggtgatcccggggacactcgcaaagggtaccgagttcctacgcctagtaacccgggtcaccatgggcccacatgtgccggtccagcggaagtcttgaccaacccgagcgtagaaccttagccacttcgggtaaggcgcaccgcattacgtagggggccccccccgcatggcgccgggatgcgcaggataactcgcaagctgtcacctgggagcccccgcccgcttgcgacactcgtatatgccccctcccacagggcggtaacttgccactgctgccccctcctggggtgcgacccttagccagtggtcattccaccgttttcccctgtcttgtcacccagcaccgaaaccagcaccaaccgccaccccgaatcccgagccgatggtctccatgcacgcccgcttgtcacactccctcaaccccagtctcacactcacacggcctgacccttgccgcacacgggcccattggcacgcccccgacagcccgacgacacgcgccctgcgcgccgtgcgtgcccatggaccttgcacccggtcaaaacagcacccccaaacgcgtcaccccgcggcccgacaacacagcctcatgcaccgcg

SEQ ID NO: 703351 - DNA, 221 bp, Homo sapiens
  misc_feature (100)..(100): n is a, c, g, or t
cacattgtgctggcccctcttaatactcaccaataaattctacttcctgtccaaaaaaaaaaaaaaaaaaaaaaaaaaaaaaaaaaaaaaaaaaaaaaanaaaaaagaccccctcttttttttttttgtggggggggggtggggagggggtgtgttgtgaccaaaagggtgggcccggggggcgcggggaaacaggtggggggaggggcgcgcgccggccc

SEQ ID NO: 703352 - DNA, 299 bp, Homo sapiens
ccctggacctttgggacattctaagggctacctgagtccacatatacaaggactcagctgaatctttggtaagactgtgtcccagttcagcttctctctctgcatgtttccttcccatcagcatgcctgatgctgatcctatgagcctgtcctaaaacactcttttacgataatgtccctctcagagtctgtttcctgggacctgaactgtaacaggggcctttgcttctcggagtactgacctagccgaattttttttttttaatgttttggactctggaaaacatttccttagtgaa

SEQ ID NO: 703353 - DNA, 97 bp, Homo sapiens
ttttcagtattgcattgaagtgggaaatgagcttaaaactaattattattattattattattattattgttatttttacaaaatggaatacggtagc

SEQ ID NO: 703354 - DNA, 162 bp, Homo sapiens
gacggaaccgcgacactacttgcatgaagggcgcacgtctgccaggtgcccgagtcctgcttcctgctccgttgctgcctctcccgcagagagtccagctgcttcttgtgggcctagcatagagctccacgttgtccgacatcctagtactacccagacctt

SEQ ID NO: 703355 - DNA, 172 bp, Homo sapiens
gtctggacgcttcgactggcacgcatctcagcaaatgttcttgtatgactctcactgcaaacctgatataatgtgcatgactctgtcggtgctctacccaggagggcccatggacaccagtacaggccggatggcaccctgattctcccatgcacaccccgagaggtccaga

SEQ ID NO: 703356 - DNA, 296 bp, Homo sapiens
aatgagtggctggaggatgctacatgcccatcataggctttgtcgtagggaaataggatattacaaggatatggcaagatgttatcaagaagggtactcctctatagatcggtgggcaagtgtgtgagcatagttcccggtcgtacgtccatacacacgtgtacagttcagtggaattaagtccattcacattgtggtacaaccgtgaccaccacccatctccagaatgtattcacctttccaaactgatcctttgtgcccattaaacactaactctccattcccctctccctcca

SEQ ID NO: 703357 - DNA, 323 bp, Homo sapiens
ctgcagtgagctacgatggtgcccctgccactccagcctggcaacagaatgagaccctgtctgggtttgggggagaagtgatttacaatgttttgaaaatatcctttggcccaggcatggtggctcacacctgtaatcccagcactttgggaggccgaggcaggtggatcacttgaggtcagaagtttgagaccagcctggccaacatggcaaaaccccatctctactaaaaatacaaaaattagccaggcatagtgatacatgcctgtaatcccagctactggtgaacactccagcctggtgacaaaacaagactttgtctc

SEQ ID NO: 703358 - DNA, 960 bp, Homo sapiens
ggagaaataggaacacttttacactgttggtgggagggtaaattagttcaaccattgtggaagacagtgtggcaattcaccaaggatctggtactagaaataccatttgacccagcaatcccgttactgggtatatacccaaaggattataaatgaactcccgaccgcaggtgatctgcccgcctcagcgtccaaagtgctgggattacaggcgtgagccaccatgcctggcaattgctacaaagagaataaaatacctaggaatacaacttataaggacctcttcaaggagagctacaaaccactgctcaaggaaataaaagaggacacaaacaaatggaaaaacattgcatgctcatggataggaagaatcaatattgtgaaaatgaccatactgcccaaagtaatttatagattcagtgctatccccatgaagctaccattgactttcttcacagaattggaaaaagctactttaaagtttaaaaaactactataaagacacatgcacatgtatgtttattgcggcactgttcacaatagcaaagacttggaaccaacctaaatgcccatgaatcatagactggataaactgaaatgtggcacatatacaccatggaatagtatgcagctgtaaaaaaggatgaattcatgtcctttgcagggacatggatgaagctggaaaccatcattctcagcaaactaacacaagaagagaaaaaccaaacactgcatggttctcactcgtaagtgggagctgaacaatgagaacacattgaacatgcgggctggggggggcattcacaacactgggggcctgattggggaggtgggccgactgggggggaggagtaaccattaggagaaatacctaatgtccatgaatgggttgatgggtgcagcaaaaccacatggccgtaatatcctatgtaacaaacctcatgttctggccatttccca

SEQ ID NO: 703359 - DNA, 136 bp, Homo sapiens
tacggcaccctttgcgtaccacccaacccgccggcttaatcgccgctcaaggcccgcctgtagcggattttttctttaccattgtggggttttcaccggatgaacgatacccgtttggtccatttccagaggttaa

SEQ ID NO: 703360 - DNA, 380 bp, Homo sapiens
  misc_feature (17)..(17): n is a, c, g, or t
  misc_feature (61)..(61): n is a, c, g, or t
  misc_feature (74)..(74): n is a, c, g, or t
  misc_feature (108)..(108): n is a, c, g, or t
  misc_feature (180)..(180): n is a, c, g, or t
  misc_feature (210)..(210): n is a, c, g, or t
  misc_feature (244)..(244): n is a, c, g, or t
  misc_feature (275)..(275): n is a, c, g, or t
  misc_feature (302)..(302): n is a, c, g, or t
aagttgggaaatctgtnttggaagcccaagccaaactggaagatcaacgatgaacgggccntagtagaggaggncagcccaccttcgttggccgccccacagcccagncaggggcttgaagatgaaggggaaggacagcaggacgcagacggtgccgaccaggtgccaggccttgcgcgngccgtagcgggcgcagcagctggcggcgcngtcggcctcgtagcccacgagcggtgtgcacagnccgtcgccacctggcccagcagcagcaagcnatgcccgccgcgggagctgtaggcgcnaccgagtgcaggtagagcagcaggtaggtgaaccacatggacgcgcacaggtcgttgaggaagtgcccacggcgtagc

SEQ ID NO: 703361 - DNA, 543 bp, Homo sapiens
aggttgacctcagaacaagaactgcatacctgggagaattcaaatctctgtcagccccagaacactgggggggggtggctggaggccccagttgggagatccctcactgggcaggacctaaagacctccatgccagggagaactcaaatcactgtcagcctgagaacaccggtgggattggctggagaccccagctaaaaggaccctcattgggcgggactttgagaactaggtgccagggagaattcagatatctgtcagcccaagaacaccggtgggggtggctggaggccacggttgagaggtcccccactgggcaggacctcaagacctccatgccaggcagaattcaaatctctgtcagccccaaaacactggcaggggtggctggatgccgaggtccttcactgggccagaccccgagacatccataccagggagaattcaaatctctgtcagcccaagaacaccggcgggggtggctggaggcccgattgggaggtcactcacttggcaggacttaaagacctccatgccagggag

SEQ ID NO: 703362 - DNA, 551 bp, Homo sapiens
  misc_feature (459)..(459): n is a, c, g, or t
  misc_feature (469)..(469): n is a, c, g, or t
  misc_feature (508)..(508): n is a, c, g, or t
  misc_feature (527)..(527): n is a, c, g, or t
  misc_feature (540)..(540): n is a, c, g, or t
tgtctaactgctatggttagaacatccattactatgttgaacagaaatagcaaaaactgacatccttccattgttcctggtcttaaagaaaaagttttcagtctttcaccattgagtatgttgttcactccaagtctttcacatatagtagtcctctcacattccaggaccacagtgaatgactgaaatcatggataaaaccaaaccctacacacactatggtttttcctatatgtacacacctattataaagtttaatttataaattaggcaaggtcagagattacgaacaaaaattaacaataaaatacatcaattatgaccaagggtggtagctcatgcctgtaatcccagcactttgggaggccaaagtggccagactgcttgagcccaggagttcaagagaaacctgggcaacaaggtgaaaccccatctctataagaattttttttaaattancctggcatantggcacacacttgttgtctcagctacttgggaagctcangcagggaggatcacttgancctggggaagcanaggttgcagtg

SEQ ID NO: 703363 - DNA, 383 bp, Homo sapiens
gatgcatcgtgtcgatgatcagacgaagtattatagagatagctttgatagtagtttgtgcactgcgtcatcattctgcactctttggaatggattataatgagaagaagtaattgaaccacccccgttgttagatgtgataagtgtggtactgatctactggcgagcgatgatgatgttgcggggatagtcggcataggcatttgtcgctaatgatgctatgcttcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacactttgcatcgagag

SEQ ID NO: 703364 - DNA, 250 bp, Homo sapiens
tagtagagacggggtttcaccgtgttagccaggatggtctcgatctcctgagctcatgatccacccgcctgagcctcccaaagtgctgggattacaggcgtgggccaccgctcccggcctatattttcgattttaaaataaatataataccttattacaaaaatagagatggggattcaccgtgttgcccaggctggtctcgaactcctgagctcaagcagtccaccagccgcagactctcaaagtgctg

SEQ ID NO: 703365 - DNA, 1017 bp, Homo sapiens
gggcataattatgtattagtatctctaagaaagaggtggcttttacctatacaaaattcgtctggtagatcagctggctctaacacttaatgtaccatgaataagaccgtgtggggtggcaagtgcgattcgctccgtacaaagtggcagatggtactgctgggtgagctcacatgatgactagtagatttaccggtattacttactagttattatgcagatatcctgtattgcgggaggcaggaaacgccaagagaacgcgaaggaaggattagttgcctattgtcacccgaaatcaccaatggtctagccagatgttgtcccgggatcctttcccgtcgcgatcgcctcgtattactctgaactgtctcttggtagatgtggtctgggaagcttgctggagctagggggttctggtaacatggccccatatggaagtggagcacgttcaggaatagaaatactcattgaattctaagcgatgtatatatgactttagtagagagatttgattgggatttcgctttttggaatgggttagggcaggattgggaagagtttctgggacctcggggaacggagactagtctggtgatgtggaagtcttctttcacccgaaggttgagaacaagaaatatgcgttatttttaagtggaagcacttttaagtaagaacaaatctgaggatacgatgggaaaagatctccatcaaaggttaggagatcgcctagtcaggggggggttcggggagaacggaggtattagagtggatttctattgtgccaggcgtttattgcaagaagaacctgttgtgttagggccctggccaaggggggtcgcgccagacattcatttacttcatgggcgacccaaattggactagcatcggcgtgggcggttggggttcggcctcggagtccgcttggcttgtaggggtccaccaaaatccttcgaggtgggacccaagaaaggtgggcaaagtggcttggacggaattgcacctggggatgccactcag

SEQ ID NO: 703366 - DNA, 508 bp, Homo sapiens
cccttttgcggcgactgactctgttcggatgatactacatccagagtgacagtagagaagttcttcctaagacgacaatgacatcgatttgcagtggatcgaaccttagaggtatactagggaatactgatgcactagtgtgattccggcacccgtcccctgaagttttcagtccggtttgacaagagaatttggtgaagccacaaagatcccccaatggctacatcctagctgactgggagaaactatggcttctcccatccagctgtcacttggaccccactccccttccctaagaaaatagggaggccgaaagggcaaactaacaaaaatgagaaggaaactgggtttgggcccccactgctcaccactgggaggtggaagtcagcccggtggcggtttttttccacctccttcctttgccggctggctgctccctaccacctctctcctgctggccaaaggttctgaaactctcacaacgggtgcccaactcaaggaaaactca

SEQ ID NO: 703367 - DNA, 128 bp, Homo sapiens
acacagaggcagcagagcactgactccccacgtgatggtgctcctggcccagcacctggcccggcaccggttgcgggacgccagcttctggaaccattgcccacttcctggtggtcaggaaacgcaac

SEQ ID NO: 703368 - DNA, 388 bp, Homo sapiens
  misc_feature (44)..(44): n is a, c, g, or t
  misc_feature (53)..(53): n is a, c, g, or t
  misc_feature (101)..(101): n is a, c, g, or t
  misc_feature (144)..(144): n is a, c, g, or t
aagggatccactgcctcggcctcccaagtgctaggataacggtntgagccacntgcccggctgagatcattgcaataatattccgctttctatgaaatgantttgtttaccgtaaagtatgcttttaaagactttcagatttangctttttacgtgaagctgctaaactaaaagtaatggaagaaaccaagtctagtaggttttttcttttttttgtgggggtgggatgggggaggttagttacacttaaaatatcttctccagagactgtatgctcctatactagactgtaagctctttgagggcagtctgtcagatttatctttgtatcttccccagcgcctagtgtagtgccttgcacataataggcgcccaataaatattgatg

SEQ ID NO: 703369 - DNA, 193 bp, Homo sapiens
gtggtcatgactacgtcttcctactacttacctgcatctcatgtggtggatcaaggatccttttttattctctctctgagacaggatcgtggctctacttgcctaagctggcagtgcatgtgctgcaactcatggctatactgcacgccttacccaactggatctcaagttgatccatcctgcttcagatctc

SEQ ID NO: 703370 - DNA, 423 bp, Homo sapiens
  misc_feature (210)..(210): n is a, c, g, or t
  misc_feature (253)..(253): n is a, c, g, or t
  misc_feature (374)..(374): n is a, c, g, or t
  misc_feature (406)..(407): n is a, c, g, or t
  misc_feature (421)..(421): n is a, c, g, or t
gttcagtggttctcaactccatagaaggtccctaaaatcacataagcataagcccctgcacccagaccctactgagtcaggaccctctgggtggtcagtaccctgactctgtggggccccaggcacagctattttttaaaagccacaggaggcccaggtgtgaatgtcacgcctgtaatcccagcactttgggtgcctgaggcaagaggntcacttgagccctggagttcaagaccagtctgggcaacatagnaaaacctcatctctataaaaaaattttaaaaattagcacatgcctgtaatcccagctactcgagaggctgaggcactagaatcacttgaacccaggaggtggaggttgcagcgagctgagntcgcaccactgcactccagcctgggcgacagnnaaagactctgaatnat

SEQ ID NO: 703371 - DNA, 301 bp, Homo sapiens
  misc_feature (41)..(41): n is a, c, g, or t
aaacagtatcattgttcaaacacagtaggcaaagatccagnaaattagcttaaaagcagtttagagggagccgggtacagtggctcatgcctgtcatgccagtttgggaggctgaggagggcgatcacttgagtccgggagtctgagaccagcctaagcaacatggcaaaacaccccatgtctaaaaacaaacaaacaaaaaatgcggtttagagacaggaggcagcgtggatctctagagctgtcctgctgccgtccaggagtgccttgtatgtaagttgaataaactcgtctactcatc

SEQ ID NO: 703372 - DNA, 476 bp, Homo sapiens
gtctaacgggtcctcctctcgttctcaccacaccacattgcttcacatataaaaagcaacaatccaatacacggcacaacctatactgaaatataaaatgcaaatatcccttgattcagcaattccaatccttggtatttatctccagatacacaggagatagatgatcgatagatagatagacagacagataggcagggcgcggtggttcacgcctgtaatcccagcactttggaaggccaaggcaagaggattccttgagtgcaggagtttgaggttaacctgggcaacaatagtaaaactgtgtctctacaaaaaatacaaaaattagctgggcatggtagcggccacttgtaattccagctactcagaaagctgaggcaggagaatcgcttgaacccagaagagggaaattgcagtgagctgagattgcgccactgcactctagcctgggcgacaagagcgcaactgttccc

SEQ ID NO: 703373 - DNA, 435 bp, Homo sapiens
ctccgataaatccatagcccgttgaattaaggtggcaccattactgacatctacgataccgctaccaaaattaccgacattgatacccacagtatcgaacgatgatgtcgcatccatcaggttcagtgtgccgataccgcttgctttatcgcccaaaaacgtaatatttcgcgatacgaacttaccgccatcgctaatattgaggtttccgacgcccgcaacaccaatggtggtatagacattcttattgacctcccacattccccccgtggtgatgctgacattcccgacgccggtttctccataaccgagtgaacttcctccgttgctgacaacaagcccctgattactgatattcatttcgccgtggccgtcataaccaagattagttccgagattagtgataacggagttcttatccttaacagtaatgtt

SEQ ID NO: 703374 - DNA, 101 bp, Homo sapiens
aggagaacatgcggggtgtgcgcttcgacgttcacgacgtcaccctgcacgcggacgccatccaccgcggagggggccagatcatccccacaacacggctt

SEQ ID NO: 703375 - DNA, 279 bp, Homo sapiens
aaatggggaaaaagtccccgaaatgggggcccccggcccccctccccaattcattccctaacctgcaaacctttccaatttttcacgtcaggcctttgaaaattttttccccctttcctggtttccccccctcaaacacgcccagttccccaaggcccttttgtagtcccatgaattgaaaaggaaaccctgctcccccggaggggagcaggaatgttgccctgtttaccccctgactgtgcttaaaaaccctttccctaataaatggttttaaatcca

SEQ ID NO: 703376 - DNA, 667 bp, Homo sapiens
tggggacgcggtggctcactgctggtaatccccgcactttgggaagctgaagcaggaagatcccttgagcccgggagttcagaaccagcctgggccacctggagagaacccatctctacaattcgccaggcgtggtggcgcccctgtagttctagctactgggacagctgaggtggcaggatcgcttgagccgtcgcggtcgaggctgcagtgagctgagatcgcgccactgcactccagcctgggcgacagaccaaagccctgtctcccactctctatctctcactcttcctccccttcccgttcctccctccgtcccgatcacaacttctcctacccctctccctccccttactctccacccccatccctgcctccaccacatcctttccggccccttgccccactccgctccgcacctctcccccttctccctctcccccccccccgtcccatctggcccactccgccaacatcgggcctcttccatctccctggccactccttcaaccccactcccccgacacccccccgccccccccccctctcactctcctcctcctcacctccccttcccccctctcctccccctcccccccccgcctctaccccccccctctcctcccctctccctcccgccgcatctccctctcactctctctccccc

SEQ ID NO: 703377 - DNA, 454 bp, Homo sapiens
  misc_feature (72)..(72): n is a, c, g, or t
gagacaggttctcactctgtcacccaggctgaagtgcagtggcatttgaggtcagtctcaccttgacctccncaggctcaaacaatcctcccgcctcagcctcctgagcagctgggactgcaggcatgtgccaccatccctggctgattttttaaatttgttgtagagatgaggtctcactatgttgcccaggctggtcttgaactcttgggcccaagcgatcctcccgcctcagtgctgagattgcagtggtaagccaccatgtccagccaactctttaataataggcagttctgactggtgtaagttctgactggtatctcactgtggttttaatttgcatctctgatgattagtgatgttgggcattttttcatgggttttttgtttgtttgttttgagacaaagtcttgttctgcagcctgggtgacagagcaagaccctacctcagaaa

SEQ ID NO: 703378 - DNA, 381 bp, Homo sapiens
gacaatcacgagtgtgtggtcctggcatgtcatcaatagcccgttttgtacatacctacaagggagctgaaggggccaactcagctgtcatctagaattcaaacatcgggcatcctgcggtgtgagcagactcaaatgatgtacatggtataagaacatgaccatgctgttggctaatttggtcctttgcttctaacttggctgtctttgccaagtacctggctccacacctttttcctgtgtggtcccacagctccaccaatgtctccttggaaaacatggtggcacttcccttcctcgcgcttctcttttaagttccgtactcccttcactcacatcctagcaggcctctatttgaagtgacctctgcttccaatggag

SEQ ID NO: 703379 - DNA, 432 bp, Homo sapiens
ggcctagttattcatttcactaccaagccatgaaggagaaatctgttttaatgcataaatcaataaaatggagctttaacatgtgagaagccaagtgataactctgatatactttcctaagctatgcgggctgaaagctgggttatttcattatttaaaaattctaggtaggggactgtggctcacacctgtaatctcagcactttgggaggcccatgtgggcggatcacttgagaccagcctgggcaacatggaaagaccctgtctctactaaaaaatacaaaaatttgccgggtgtggtgacgcattcctatcgtcccagctacttgaaaggctggggtgggaggatcatctgaaccctgccaggtcaaggctgcagtgagccatgattgtaccactgcctgtgtgaaaaagtgaaacactgtctccaaa

SEQ ID NO: 703380 - DNA, 524 bp, Homo sapiens
ggacattgagggcgcaagagaggacatcgtgggtcctgtctacctgcggcagcgcgtgccatgccctgtgaatacaacaactcctactacggactgatgcttttgggaacacccccgtccatggtatcagtgtccccgtgtgacctgcttcaactggtaagggcctgtatacacgtacctgatagtaccggactactcgacgcgtaacgtgaccaatagaccaacatcagactgatgacggagcgagtgggtgatgaagaagagacagatgacggaggaggcactaaacggatgacagttcccatgggaccgcgtcacactgtggcggcaagccatccgagcacccgtgagcccacgagcaggcgtggtgcccaggctctggacgctcacgaacagggtgcccgttcctcctggacaatgtgccttgcgcacatctcagtggcccccaaggcgacgacgcgagcagctgttcaccctgcagacggtgaactccagtgggaccagcgaccgcacaaactccacct

SEQ ID NO: 703381 - DNA, 166 bp, Homo sapiens
tgactacaagtccgatcccatcacctacctgtttaaaaatcccaaatatgggccagacgcagtggttcatgcctataatcccagcactctgggaggccgaggcgggcggatcacctgagttcgggagtccgaaaccagcccgaccaacatggtgaaaccccgtcgt

SEQ ID NO: 703382 - DNA, 336 bp, Homo sapiens
tgtggagacgggggtctcaccatgccggcccaggccgggtcctgaactccggggctcaagcaatccccccgccccgacctcccaaagcgctgggaccacaggcatgagccacagcaccgggctgtttttaagtaatgggaaatgttctatatctccgtggtaacaggattggcatgggtgaagacattggtcaaaactcatagaatggcacacttagaaggggttttctttatataaattattcatcagaaaattaaaagggaaaaaaggctaggggtaacaacaaaaataccctttgagatgaatataaaatattccttagagaagcagcgtctc

SEQ ID NO: 703383 - DNA, 859 bp, Homo sapiens
ttcgcccctttttcttcggggttacgccccctccttggccagtgcgggcgcctgtcccccggtggtattgtcctgggcctcctttttggccccagggcctcctccttcctctggggacccggccccctcctggtacaaagggtggggcccccgactgcgttgaattccgggtggctctgccctattgcacgagggtgtgtggtcgaatcctctacatttcgtggcctctgggggagttcccccttcgtcctcccgtccggggagcgcatcttgaagtccccccagaatttgtgttggccaatgtgcaggttttatcgagtgcgcccccttggggcggcaccctcatgcgggagtgtggtgcaccccccgatggtgttagcaccgcgggtagacccacggatggtctggtatttcatgttctgccccaccccgcctgctttatgtggcacgcgtccccccccgtcttgagtagttctggtcgcaggcacacacaggcaagtcttcggggcacctttgaatgccgccctcgcgcgatgtatttgtattctccccagcggcacgctgcgctgtggctaccaaaagcagcccgtcgcgggtttgtgaggggagtactcacatcccccacttgatgaccacgagcgagtggacatctttttggaataacatgcacgcacaccttactaatggtcacatcgcggctcccccggataccctagtagcttccaacccggccgcctcctttgttgaccccattgggaactaggaacacctttttgcacacttgaggcaagtagaatgagtccgattgataggtataactacatgagaagtgtctaacaaaaattcgcccaacaagacc

SEQ ID NO: 703384 - DNA, 363 bp, Homo sapiens
gatcccttgggtgcatgcatgtgtatgaccaagtccaggggtgactcttgatgatttcctggcttgccagtgttttacaggatggtctggccaacaaagaaccaggaccaatctataataattagctgggcgtgatgccgtatgtctgtaatcccagctactccggaggctgaggcaggagaatcgcttgaacctgggaggcggaggtttcagtgagctgagatcgtgccattgcactgcaacctgggcaacagactgagaccttgtctcaaaaaaaaaagggaagaaggaaggaaaggaaaaggaaggtaaaacttggtgtccacttcctttggtagtcttcacaccacattgcatgcaccc

SEQ ID NO: 703385 - DNA, 153 bp, Homo sapiens
tgaaggaaataaaaaacgtgtgtattagatgcgacaggacaggcagccaaagcagtcatcctcataaacaggcccatgatttctccagcgctgacaggattgaagctcttgagcttcctggttcttctcccagacacctccaaggaacatgct

SEQ ID NO: 703386 - DNA, 434 bp, Homo sapiens
ccgatcccacctactgctcctcttctagcacaaataaggtttggcaccacaccccggttacaagcaaggacggggcggggcgtttgccatcactgaggccacttacaggagtttcatagatgctaagcgtatccagggtcattctggcaaagaatttgccatcatggctccacctaagaaaaacaaaagtgccagggtattcccatgaaaagacaaaggctacagagctcgttacaatggtccacttacttaaaaataggccaatgggctgagctctcacaatgaaaacccctcttcttgtgccccgtaaggatgtcccagatgattatggcctgagggtcatcctgcgtgtccatcagggggctaaaggtcaccaggtacctttcacaaggtgagaagtcaataagctgaaccccttgggaggttattggcat

SEQ ID NO: 703387 - DNA, 1228 bp, Homo sapiens
agcggagcgttgacggcgttcgcagggaacatggagtataccgtgtcggtcactgttgcacgcctgtgtacggcgtgagcggtcgaggacttacaccttgaggtacgagagctcgcgtaaggcacgggccacggagccgcgacggagtttgcgcttggattcgtcgtagtaggtggctgccgccaggcgtgttgtgcgcaagcctgctgtaccggcgctgaccctacgtgcgagctgtggctatgtatgcagtgtacatgtggcatgccagcagttgatgcgcaggagaaaacacaagtgttttcgttcagcaaagagccatggtggtagacgcggttctcggctcgctgcacattagccttaatgtgcgtggaacgctactcacgaaaccacttgggacgagcgactgtcacgcgacggaggcgacagaaaacagaatgacgcaaacaagaagttgagatgtacgtagtaaccgttacggcaaaatacgcaatggggatacttgcgaggactagttaagccacggggtacctcagcggagagacatgcctaggacttccaggaagtcttgaacgatgttcgagcatgagacgtcaaatcgagctatgcacaaccttctgacctgtaccctgatcatgtatcagcaattactcgtattatccggtccctctgtgagtgaggcgcatttaccgaatcatagcctatgtgtggcaagtactcgaaggcggaacaacatgtaatggtaatagactcgtggtagaattctaggcaaagttctcttaggataagaagtggtaagggataggacacttttgacaacgcaatggaaactttaggacgaaggattagtaatttaggagcacgcacgcaatcgaaagatttgggttggacaaggtcttaattgggtcccaacttgcccaacaacgtatttgcaatagcgggtaaggacccatgttgttactaattgggcgcatttaaatctggaacttatttttgtgtttgagaggccaaagtagaaatggggaggaatataaaaacatgcggaaggtaatcgaaaaaggccttacaacatggcgtatcagttggaggagcgttgctatgagagtgcgtggactgtggagtttcgcacatgctggacatggcttggcatggtgaacttttgtcacaagcatgtggttgacaatgtggggcataacccagcaatgaatggaaacctattgtttaagga

SEQ ID NO: 703388 - DNA, 360 bp, Homo sapiens
gagacagggtcttgctctgtcacccaggctggagtgcagtggcgcaatcatgggtcactgcaacctccgccttttgggctcaagcagttctccctcctcagcttcccgaatagctgggactatgggtacgggacactgcactcagctagttttttgtatttttttttttttggggggaaacagggattggccatgttgcccaggctggtattgactgaactcctgggcttattcactaccctttggctgccaaagggctggaaattcaaggtactaccaccgtgcccaaccaaaaataatccttttgctggcattcatggtgtttagaccaggtgcaccttggccagggtgggtttctgt

SEQ ID NO: 703389 - DNA, 485 bp, Homo sapiens
  misc_feature (60)..(60): n is a, c, g, or t
  misc_feature (206)..(207): n is a, c, g, or t
  misc_feature (228)..(228): n is a, c, g, or t
  misc_feature (230)..(230): n is a, c, g, or t
  misc_feature (250)..(250): n is a, c, g, or t
  misc_feature (256)..(256): n is a, c, g, or t
  misc_feature (268)..(269): n is a, c, g, or t
  misc_feature (298)..(299): n is a, c, g, or t
  misc_feature (305)..(305): n is a, c, g, or t
  misc_feature (330)..(330): n is a, c, g, or t
  misc_feature (335)..(335): n is a, c, g, or t
  misc_feature (338)..(338): n is a, c, g, or t
  misc_feature (340)..(340): n is a, c, g, or t
  misc_feature (343)..(343): n is a, c, g, or t
  misc_feature (377)..(377): n is a, c, g, or t
  misc_feature (399)..(399): n is a, c, g, or t
  misc_feature (454)..(454): n is a, c, g, or t
atttatttgtttaagtttgccttgttttctgtaaatacgagaaattcttggatgacgcantaagatacagagattgttatttgtatctagtgtgctactttgagaaagtttccttattgatagtgatgcttccactgttcggtttatcctgttgttttttcttttaaggaaaaaatagaaatatttagttttttggtgcttaccgnngttgtgttataacaatatcgntnacatcgtcaggactttgttnctgatnataaaaagcatnnatagaagccgggaccttcctttctttcannttttgncagtaatacctgggcacaggacttnaaagnaancncanattccctcccccttaaattttagggattaaaagnttgttgggaataaggccaaagnccagggggggcagtcgttacacagcatgaatcggggttggctatcaacttctccntttgctttttttgggggacccgttcattttc

SEQ ID NO: 703390 - DNA, 204 bp, Homo sapiens
gcctggttccgctgatcctggtgtgctgggcccgtcagcgccctcactcttgaagtccaggactgggtctgaccgtggtgggagcaccttgccagaggatgctcttccccaggacggatgggccctgtgtctcaggagtggggttgggggacagccttcagctgcagctcacaccctaccttccccagacttgcacaggggtgg

SEQ ID NO: 703391 - DNA, 970 bp, Homo sapiens
cttgtatactgaaaactggcacctcgatgattcccaaagacagctgtactcattgctgaatctacgcaaccgactacgccctcagcgagtattatgtcttgctcgacgaaactagctgactgaccatgacgctacgctggtgactgcttaaggcttgatgtgcatacaacagcactgtgaacatcgctactcctcggcgcccgggcaaccttcactgctacgactgacttccgccacctggcaactgactggctgcaggcgcaattggaatgcctcgacagcgcacacacatacttacccagcctagctccgggccaacgcgcgcatgccactgctcccgcacgccgtggccagccactcgccccccagcgaaccaaccgcagcatccagcccaacgcagcacacgcacaccctgcttcctacgaccaaacaaaactacacggaacttccctcttaccacgttacctccaccgcacaagccccaccaccagtaattcgtcattcacccacccaacaactcataactcactcacgcccctggcacccactagcggaccacacacagcccacgcgcacccacaaacccaaaccggcccgcaccggccgcaactccccaaccgcagcctcccgggccgcaccctaacgacaacccccggagctgcgcacggcccatgccttcctggataccacccacacgctctccgaaacaagtacacaaccctggcaccaccaccaaatccacccttaactcccaccgcacaccccagactggaccacagagccaatcgcgctccttccacacaccttaaccagatttaccacgcccaatcatcggtccacacctcggggcacccgaaacactataacttaaaactccctcccacaacaactttaacccaactctacccctcccaccctggaaccctctactctataaaccatcacatcaccttcaacccacaactccccg

SEQ ID NO: 703392 - DNA, 354 bp, Homo sapiens
acgaaccgagcttgtacccacgatatcggtcactcacagataacgctgtgcctgtgatctaccaggtgctccctgtgctgtggtgctggtattttcacaatgatgcctgtgtgacattgtgctccaacacaaacgagcagctcacatcccctgtcaccatcattaggggctatttgagagagttcaagaactcacactctgaagtgccctctctgatggtgctctcatccccctctccctccaccacgccaccgccactgtgggagcgttctgcgtcctcagcatgcaggaaccccagcgctccccattcaggattcttctcccagcctattcccctcctctgtttccctccac

SEQ ID NO: 703393 - DNA, 917 bp, Homo sapiens
  misc_feature (85)..(85): n is a, c, g, or t
  misc_feature (263)..(263): n is a, c, g, or t
  misc_feature (272)..(274): n is a, c, g, or t
  misc_feature (370)..(371): n is a, c, g, or t
  misc_feature (381)..(382): n is a, c, g, or t
  misc_feature (427)..(427): n is a, c, g, or t
  misc_feature (491)..(491): n is a, c, g, or t
  misc_feature (865)..(865): n is a, c, g, or t
cgacttcgatgatcgtgtgtcggatgaggagaaggtacgcatagctgctaaattcatcactcatgcacccccaggggaatttaantgaagtattcaatgacgttcggctactacttaataatgacaatctcctcagggaaggggcagcacatgcatttgcccagtattaacatggatcagttcacgcctgtgaagatagaaggatatgaagatcaggtcttaattacagagcacggtgacctgtgtaatagcagatttttacnattccaagnnnaaacaaaattttccttttaaaattttgaccccactttacggaacagaaagcaaagtagactcccccagacccagaaagaacgcagactggacggtnnctgaagtctnntggagagaatttcctgtgtgcttcttgggtactgtttattgcttnaaaactatcgattgtggcaacagggactattatttgcattgtattgacaagccacccagtttcnagcctaagaaacttctggcaatggtcgttggagatcagagtggaagttcaccatcacaccacctacagcccaggtggttggcgtgcttaagattcaggttcctattatgaagatggcaagttcagtgggtaggcataagatgtaccgattcctaacgtttcaatgagccaaatggcagggttatacctctagagagcgaatggttcgacggcttgggaacttcactgcattccttaggcttgcgggtcagtccggaatgagagaattgtaaatgggaatgactagggagagtccatggaaagacgcggcagtaagaacagattgggaacgtcaatagaagattgattatatttttttgtggtttatatctttgntgcacagtaagatatattagaagataagactataataacatgcagacgggtg

SEQ ID NO: 703394 - DNA, 244 bp, Homo sapiens
ttcccgaggtgctgataaaacaggaggagctcacccggagggctgaggagttggaccgaagggagcgatgagctgcagcattgctgccctgtggggggccggttactcgacagaacaatttggccccctctaccttcttttggtccagttcagccctgcttttcccaggacatctccatggagatcccccaagattttcagaagactgtttccaccatgtactacctctggatgttggctggat

SEQ ID NO: 703395 - DNA, 206 bp, Homo sapiens
tcccaggttcaaggtgattctcctggcctcagcctcccgagtagctgggattacaggcacccaccaccaggcccagctaattttggtatttctgggtgggagacagggtttcaccaggtgggctaggctgggtgtcaaactccttgacctgcaggtgatccaccttggtctcgggcctcccaagagtggctggggattccagggca

SEQ ID NO: 703396 - DNA, 243 bp, Homo sapiens
tactgagtggaggtctgagatccagtgcctctggttgcagatgttgtctatgacgggtgtggccccggaggcaggaattgctggtgtaggcctgcctcatgatgccctcggcgggtgcctaatactgggaaggtgccaggttccgtctcgtctcggccggagatctgattggtgtccatctgtctcccgtgtgtaaaatgtcgtatccgaggatgcctgtcatgctgccggtgccgtaggtga

SEQ ID NO: 703397 - DNA, 1149 bp, Homo sapiens
cttctggtgcggcttatgggttatgcgctccccacaatgtcctggaatcgctttgtggggttcaaaaccgcgggataaacccataatcgtgctttgtgggaccttgggccaccatccttggactagtgcaatctggcaaggggcttccccggggaaatcatcatcttgggaagttccgcaaactttggtggacccttggtcgatgcatccaaaggtgctctgggcacctttgttggctcccaggtcccgatctaatgaacaatcagactggactatagtcctgtgtgctctcctaaaccagcctagggcactggtagggggcctcaggcctccctagaaagcggtaccctttattcgcctctttgacactccaatcccaaggtagaaaactgttggagctgacgcacgaggcactgaccctgcctacctctcgtacggctattaactctcagccacggactcatccgtcctctgcgcttccagtgataagggtacctgtccatatgctttggcttctcaaggatacccgcctcaaccgccgctctcgcgctcggcttcgcgtgggcaaggtggggcctattcgattgggcagtacgtggactctcagtggacgcactaggcgtagcttcactgtgcctgtcctgagtcagcgttgcatctgcgccattcggtcgcaagtacttcacaagaacgtctaactctgtcagttgcccatctgcgatagagtgggacccttcctacaaatagtgtcttcactcctcgatggaaacttgctaacagagaggctattcgacgtgtaccttgacatttgtgatgatgtatgacttttaaggaccctggggcctgtgtctagggacctgcagtggcagaactgcagagctgagccttggcattggcgcgtgcttggaagccacttagccagcaagcattaatggggctggtgcccactttccactcagcagagtctatgtctaaatcaagagctcacttccctccagcacttcattgatgactgtgtgcccaaagggccaggcacagagacaccaggaaggcagcgacccacttgggatccagtaacctggaggaaattgcaagggacacagagggagtgccctaatccaacctgtaactcccaggagcatcatagga

SEQ ID NO: 703398 - DNA, 512 bp, Homo sapiens
tgagttcacagcaggctctgggcatcatctccgtgtcatcctaaggccacgggcggggttcccaccaaacaggagagcagctctcccgagatgaagccttctgatagccctagaaccaagaggaaccgtgtggggttgggtggggtgtttactgtgcactcctgatgttccctcccagtgaaggacacccacctgggacactgtggcccctggccctccctccctcccctcggtggcagagagaacttcctggtgggtgacagcccatggtccacccttgccaggtggattcaggcaaaatacgccaggctgtgtgctgaaggcatcccatctcttcctcgtcccctctcggctggatcggggtggggcagcgggtggtgagtgtgtctgtcctgccagttcagcctccaactggtctgctgtggggcaggagcccacctggctctcctgcagagctgcatggcctgccttgcctcacccgtgacaacaccgactttggttctccatctgca

SEQ ID NO: 703399 - DNA, 536 bp, Homo sapiens
agaagcttttcttattcttttattcttaagatcagtatctttttacagtattctttctacatgatccttttttgtacatttaagaatattttgattatattaaacaagactgcgtgattttgcgtactttttttaaagggggtctctcaagctaagctcaacacatacactcgctagactagcaacgaacaacatgtacccttaaactttgcgactcttcccctcgtcattatcccacagtctgctacaacacacttgagaactacttcttgtgctttgaaaagtccaccttgcggtttcataatacaatggcgttactgttggtgttttacagatccttgttattctagtctagaacttcttcgtcttcgtagaactttttaaaagagtgccgtgttttgaacttattgaaatacgttttttggaagggaaggaggaaggtgctgcttccatgaaatcttttaggatcgggggagttttttgggtattgggcgcgttaattgcggtggttgctacctgttagttgtttcttctct

SEQ ID NO: 703400 - DNA, 156 bp, Homo sapiens
  misc_feature (83)..(83): n is a, c, g, or t
ccgtgatgctttccaagaacatccaacacgagctattataattaaaatgcacaagctctttgatccaactcttccactgtcangaatttgcccatgggaatatacccctatgcattattcattattactgtgcaccagaatgttatttgtattagc

SEQ ID NO: 703401 - DNA, 429 bp, Homo sapiens
ttttttgttcacactgagatactgtgtatgtagactgccttgattattgattagcccccgtgttatgataccgatatgtgttttagcaaagtacagccgaccatgcttttggcatcatagcatcacgggatggaatcagggggttccattttcgtagagtgctcgtgtcacactctctgcaccatttttcagcaggagaatattttctagtatctctgatatgtttagccataatcatcatgtcatgtaggaatgtgtcatctcccatgtatgggggaaggtgaatatgttgtcggacgaacccccgctcgccgaggtccatgggttgggctagtttatatggcctttttcctggagataaattttccagggctttcagtctggaatcattgcaccttccttcgcctggggcccttccctaaatatttc

SEQ ID NO: 703402 - DNA, 473 bp, Homo sapiens
ggccggcggggcattgtggggtatacaccagaccacgtggctcctagggattggcagctggctctctgtgaccaaactcagaaccaggctgccaccctttactggcccgggacttgttaaagtgacttccctctctgtgccttggtagcttcatctgtaaaatgggggtgatggtggcgctgccatcgtggccatggcaccccattggctgtggtatgctgtctcttcctgtggggtctgatgtccaaagacagggcccccagggcgcagcagcgttcccctctggttcccgcagcttgccctcattccagccatccccagtgaaccataacttccagccatagaagtttaaacattacctaagaccataaccaccaggaagtttggtggcccatgagtgaaccctgccctcactgggaagcagccccgtaaactctgagtgcctgggactgttcctgtgtggaatgtgcaca

SEQ ID NO: 703403 - DNA, 107 bp, Homo sapiens
gtgcatacaaatccacctagaagcatttctgactcgccaagtgctctaaaaaagcagcgcaactcacagcctacatcgcaccgtcactgccaccaggctcatacaag

SEQ ID NO: 703404 - DNA, 536 bp, Homo sapiens
aacatcaagaacaattttgcgctcatatatgagctgccggaagagagtctagactttggctacccagagaattgctagacaggcgcgctgaaaaccttcatcactcagcagtggatcatgagtcagcatcagacaaaagaagagcagtcacagatgaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcg

SEQ ID NO: 703405 - DNA, 250 bp, Homo sapiens
acttgttaaccagtcctgttttctttcgtctttttttgtggtaataaaagtcaactgaccaagtgaccataaaaagggggctgtcttgggctcctgttttttaggctcgcttgttacttaagctccaacaaaagtttgctgtgtgattatctcaattggttttaaattgggaggcaaaaactttaagctctaccaatgaactgttttggaaacaagacacactttggtattaaaaattgcttgcagtaac

SEQ ID NO: 703406 - DNA, 996 bp, Homo sapiens
  misc_feature (410)..(410): n is a, c, g, or t
atatctacggttctgtgggctgtgtaactctattactttggctggtacatttggtatcagtcacacctccgatctaacatatatgtgcgagagattcgtccttctgactctatgcactgaatgaagcaactcgaagatgtaacaacagggattgaatctacaatgtatgaccatacataggactaaagggcgtcctcactaaatagccgtttcttcacttagcaagatgaagatgattcacagtttgccactccggtagtggattccgtagagataacaggggaggataggatgcagggatacttgtggtctaaacatacatcactaagacaatgtgtgctctgattagagtactttaagattttaggagaatgaggtcacgatattaaggatgagactagagggacagnttctgttcgcgctgttggggcatcgtgtttaatttggacgggcggttgtaacataaatacgtacggctgatatgtttctataaagaattacgcacaatgaatgcgctgtggacagttgagactttacattgagtgatcagtactcgtttagggttgtcctagaaagttaggtatttccttagagaattagaagtcaagaactggtaaatgagttttcagtgcagtgatcaggtacgtcgtctgatggtaagagtacgtagtaatttttaaaattaattagccacatttatttaagaaagcgacaatgttatatataggttgtcctctgagtgctctcgtgggttgtcgcgacgcagatgagacactcttaagaattcatgattgtcattcgacactgggtagacgctgatgcattcgggatcgggaataattgccatgtaatgcggcttctcaaacggacttcatggggctattattggggacctttcacatcgtcactaatctggattcatccggccaaactaatagtgggccggttcgtacttcaaatatccccttagggtgccaagcctaacggctgccacgg

SEQ ID NO: 703407 - DNA, 999 bp, Homo sapiens
atggaggcgctgcacgctgctagccgagacaagtccggaccacggccgccaccgacggctgcttctgctgccgctactgcatgtacctgctgccggctggagctgtgcagggactgggagacagaggagaggccccggactcgcgaagcaggagtgccacttactacgcgggtggacaagtgtacccgggagaggcagtccttttttctcggtcgccgaccactcccatgcccctaagcaaagcgaagatttccaagccagcgccctactgggaaggaacagctgtgatcgatggacgacatctacggcacgctgacacggctcaacctgacctcatcgtcgggacaatacctatggctcccctttccttctcaccacacttgactcccccccctacagctcgctgctcccacaccctgacacactacctccgccctctctggcggccggacccacgaacccttgacagcacactgccgacctctagtacaccctaccttggcacgatgagacaacgcaatagaccgtctaggtccgcatagaccaccaggccacaacgccactacgccccctggaactatcacctacacccccctcgccacagaccaccacgaacgggcacgacggaggcccccacacctcaccggggcaatcggccccacctatacatacacaccacgaactctctggacccccgacatccacgcacgatccgccaaacacgcgggcaccgaaaccgccgaaggctcagtcacgcccaaaggacaagcgcacccttcacagcgccatccacccgcccacaccctatacacggcaagggcacacaccccactaaatacctacatcgtgcacgtagggaacccaaaaaacagcggcacacactccacagataacacgccaccgacacaacccattccacactaccatgtaacaaaactgtggcgagaccgtaaccccattggatcagccaggcattaaggaaattccacgagagagaga

SEQ ID NO: 703408 - DNA, 1369 bp, Homo sapiens
gcaacagcctgctgcgtgcgcaaactggacggaggcgctccgaggtggctgctggtgtggcgtgctccatgggacgagcagtgctgcgcagtgctcatctcccccaacctgggggatcgtgttcttcaacagcctgcgaggccagcgtcgcgggctggcgcgctggcgaggatgagtgcggagcatggcgctgagcctcctggcgcagactgggcatcacgcctctgccactcagcctgcgtgccccaggtgaccaagccaaacccacgcgtggtcttctcgagcaagatgggccgtgaggcaggactggaccatgttatgtgcatgcacccgccactccgtctggcgccgaagcgcgagccatggccctcctagatgttgcagcccacttgcttggttgttgaaaactcacacggcgcgagtccccgagacgaaaaaaaggagtagagtagctgacgatgcgtggtcccccccgtgatttgcacccccgggcacctgcacttaccgttcctttggcacaggtgacgctggtgatcccggcagcagtgaccaagcaacgcttgtgacacgggcttccccttgcctgtggacattcccatcagttgggcgtgcacaggccaccgcacgtgggacaccttacaagtgttgatccagggggtcctggaggcccggtacgaagccaacggcgagtacgcggttggggcaatccacagaagcgcacaagtgcctccgacacagtaggcaggacggggcccatacacatgcgatacacacgcgaccacgcaattcgaacccttgggtccaacgggaagcgcggccctctggggagatgaggccccatgcgacaggtgaagagcccaagaacaaggtgggccttgaagcgcaacaccaagccccaatgaccgtgcactgaaagagtaacgtctcacaggtagacaccccgggggcgaggttttgacagcaaagagaacccctaaaccggacacatgatatcccggaaaccctgtgactagggaataggtgtgtcgcctgggggcgtgccattctactgtgacccaggtcgtcacgaaagacggacctgtcccacggtcggtatgccaaggtccgcggcagacgggcccacgcggtcccacatcagagttatcccaccggtggccaactgtcccccgacagactggcaacgcattcgtcttttgcacgtctcaccccagcatatacacagttagtctcgtggccccgctgtagggccacccaaacagtactgggtccactaaagaggacgctactcctcagcttcggtagggaccatcaagtgaattcccgcagttacaggcatccacgcgtgatggctaacacgtccatcgcggcc

SEQ ID NO: 703409 - DNA, 425 bp, Homo sapiens
  misc_feature (366)..(366): n is a, c, g, or t
cacatgagcgggctgctatttcatttggctagtcatgtctttctaattgattgcaagacctgacagcacgtgatttctctaattacttgtttgcttgcacaatcgtgtgtctgctgatatctgccacatagactgtcagattctatctagcccagggtccattccatacattgttgctgctcatatctccacctaagatggtgcacacaggcccccatggatgtctgtcgctgacgctgattccatgcagaattaagttttcacgtatggcgtgagagaacaagggctaatcaactgctccagaataatttgctgacttggccctcactccctcctaatcgtaatgccacctttttcacatacganaatttttgttctttgcattctaccctgctctgcccatctgtcttgttatagcaccatac

SEQ ID NO: 703410 - DNA, 426 bp, Homo sapiens
  misc_feature (10)..(11): n is a, c, g, or t
  misc_feature (13)..(13): n is a, c, g, or t
ggagacggannancttctttgttgcccaggctggagtgcagtggcgagatctcagctcactgcaacctccgcctcctgggttcaagcgattctcctgcctcagcctccccagtagctgggattacaggtgcctgccaccatgcccagatattttttgtatttttagttgagacggggttttgctgtgttatccaggctgttcttgaactcctgacctcaggtgatccgcccgcctcagcctcccaaagcgctgggattacagatgtgagccatcacgcccggcctcattttaaaattttttggcaaagatgggggtcttgttatgggtgtccagggctgatctcgaacacctggggcttcaaggaaagcctcccgctgggggccttcgcaaagttgttagggatttacagggcgttaaattcacca

SEQ ID NO: 703411 - DNA, 704 bp, Homo sapiens
taagagcatcccaccctgctcacggaggcacccctgaaccccaaggccaatccgggagaaaatgagtcacattatgtttagagactttcaatgtcccagccatgtatgtggctatccaggcggtgctgtctctctatgccttctggacgcacaatctggcatcgtgcatggacatctggagcatggtgtcgacccactaatgtccctcatcttatgagggctatgccgtgccccatgccagtcactgcgatctggatctggcatggtccgaagaatctcacttgactacctcatgaagatcctgactgagacgtggcatatatccattcgttagctactgcttgagcgtgagaattgtccgggacatcagggagaaactgtgtaatgtagctcctggactttgacagtgagatggccagctgccgcatcctcatcctcccttgagacgagttactgagttgcctgatgggctagtgatcgccatcggaaggtgaacgtttccgctgcccagagtaccctgcttccaggcagtccttcatcggggatggagtctgctggcgatccagtgaaaccacctacaacagcatcatgaagtgtgatattgacctcaggaaggacctctatgctaacaatgtcctatcagggggcacactatgtaccctggcattgccgacgaatgcgaagagatcacgggcctgcaccag

SEQ ID NO: 703412 - DNA, 137 bp, Homo sapiens
catcattcttctttctttctttctttctttctttctttctttctttttttctctctttccttccttccttccctccttccttccttcctttctttctgtttgtaatagtttatgctgtaataatttatgaaggagag

SEQ ID NO: 703413 - DNA, 433 bp, Homo sapiens
acatgtggtacccaccgtttgtggtgggaggactggtgtactctgtgatagccttttgctaaccaggaaaagatttacaagtcaagttcgtccttgattcacaccactttataggtgacctcgtgtactaaatctcttagcaggccaccaagtagttatttgtaggggaacactataccgtgggccttggcaactagtcttgggtgaaacatttgtgccagcgtttgccaaaaggagtcaaataggtgcccttgaaagtgaaagcagagttgcacttagctcaggttaatgtagtctgcgtcaaggcttataaataagcagactaataacactgaggtgtccgccctggaaagcagttagagttgccctaagttgtctaacttgtcttccagcatcttgcccaggtgcacctgcagttgcaggtcctcccacc

SEQ ID NO: 703414 - DNA, 574 bp, Homo sapiens
atcccattgtcagttaagcatgacattgtcttgagcaccagaacataaaatccatagtgattaatcaaaacctatctcgaaagactagtggaggctgtattttacgtggcaaaagagatttgtgggaggagtcctcagccaaagttctaccagaatcaccgttaattgaaagaagtctatataatcaagcacacgcaggttggaatatggggaatttgacagaaatgtttcttcaagtctgagtttactttcttcctgatcatgaccattgaccttgttatttctgggcttggctcaagaccaaggagagtggatgttgatgaacattccgggtgaataaaagtgcttaggttgtagtttatggctttgttagactggtgatgtcaatctgtgtagtgtaggtcctgtgatatagataagattcaactttctagatctagaaagatgctactttgcatagatttgtccgtcaaacataaattgcgtagaataaaaatatcacagagacacctgtactttgctactgaaagattgctcactaagaaggaaagttactctaccgttacaattcgtg

SEQ ID NO: 703415 - DNA, 688 bp, Homo sapiens
atgacccaccaatcacatgcctatcatatagtaaaaccctagtcccatggacccctaacaggggcccctctcagccctccataatgacctccggcctagtccatgtgatttcacttccaaatccataacgctcctcatactaggcctactaaccaatcacactaaccatataccaatgatggcgcgatgtagacagcggagaaagctgcataccagaggccacctagacaccacctgtccaaaaaggccttcgatacgggataggtcctatttattagctcagaagtatatatcattcgccgggatttatctgcgcctattgcacactcgcagccctagctccgcctgaagcgcccccaataaagagggcactggcagacaccaaacaggctatcacgcccgcattacaatccctattagaaaagtcccaactcccttaaaacacactccgatatcacatcgccactaaggaggttatcaagtcatcgctggagactcactcgagtagctcataaaataagaacaaagcagcgcgaatgaccacggtaatctccctacgcacagaattacattacactctcgcgtgaagtcacctaatacacgcctcctacacgcctaagatgtaccccgagatatcacgtaagcataccgacggcttctacggatcaacattagagtcgcccggcag

SEQ ID NO: 703416 - DNA, 137 bp, Homo sapiens
agtaacgacagatactccaaggatgaggacttccctccggtcttcgcggaaacgtgagggtacatgtccaccagcgctgtcgggctagtcggggctgtcgggctagtcggggatctccactgtcgggctagtcgggg

SEQ ID NO: 703417 - DNA, 824 bp, Homo sapiens
  misc_feature (279)..(279): n is a, c, g, or t
  misc_feature (322)..(322): n is a, c, g, or t
  misc_feature (340)..(340): n is a, c, g, or t
  misc_feature (345)..(345): n is a, c, g, or t
  misc_feature (349)..(349): n is a, c, g, or t
  misc_feature (355)..(355): n is a, c, g, or t
  misc_feature (475)..(475): n is a, c, g, or t
  misc_feature (538)..(538): n is a, c, g, or t
  misc_feature (548)..(548): n is a, c, g, or t
  misc_feature (594)..(594): n is a, c, g, or t
  misc_feature (733)..(733): n is a, c, g, or t
agttttttgtgactggtttaactgggaaaatttgggtgttataaaagtctttcttttgtgccccccaattacctcttggaataatcgcaagataaaagagttccgggtaacaccgataatctttaaaatagaattttgaggaaatggaatagggtggaaagtactccggtacaccgttagtacccccaatagttgtcactccccacgaatttgttttttctcctggcacccgagttagatactctttgggaaaaaaataatgaaaatggatttaaggtntgactacccctatgttagccacatctggatgagaacagttacnaagagtttggtctctaanttganttgnacccantgggtaaatttcgccaaaattccgtaatggtgtattagtattagaatagtgaataaaatgggaaagttatacatgtatacttattatcttgctccagtattttatctcacttgttctagnattttctgtaaaccctgctactgggtttgaagagttttagtcatcctttaacaatttttaaanatttagcttntagattccatttggtaaggaaatcaatattggaagtattgctaaantcttataatatgaaaagagatccactaatgtagcttaaggttattagatttgggcttttaatcatggaataatcttatgtattggtgtaagagttgatgaatgactttagctgtgtgaatatataatagtcaaactgcnaacattttgcatcccttttgtgacctaatttacagacatttaaattgtgttgcagttctgctttgccgtttaataaaaagctatttccaga

SEQ ID NO: 703418 - DNA, 941 bp, Homo sapiens
  misc_feature (435)..(435): n is a, c, g, or t
  misc_feature (561)..(561): n is a, c, g, or t
ggagccgctgccggatggtcgttccaaagggcccgcgcgttgccgaccactcggacccgaccatgctgctatccgtgcctcgttgtctgcgtcagcccatctctcggcctgcgcgtccgcgaacctgaccgtctactttaaggagcagtgttctggcacggtagcactgttgtgcacttcccgtatgcgatcgaaatctaagagcagcgaacgctcgagattctgtggcgaccattccgggatctccacgatgtccgcgcgacatattgctaacggatggatccgcaggcaccgaaacgcataacaagggcttgtggcaaggacgacagccgaggcactgcagccgctctattgtactgcctgctcgttctgagccgcacgttctttcgcacgcccgttctgcgaggctagatcatagagcgaccgacggactgncttgcgttggctgcgacggtctctaaggcgggtggacaaaccagtggagccagggaactagtcggactcgctgggcggggcagcgtctagttggtgaaatgtccttgctgtctcgcgttaccagtnacggtctcagtgcaacacaaagcaccgaagatctactagcgaaccagcgaacgcacccgttcacgcaaattacagaacagtgctagtgattgtctggtaccgcagacctagtcattgtagcggcctttggcacaccaatgcaatgttacattagtctagtcgttctaacttgacagagaggcaaaagatacagagtttgattagagcaaggggactatgacggtatgctcaaagggttgactgaggttatagtacgacgcttgtgaggaggaactgtatagtacgggcgagatagagaggcatatgagcgtgaaagaatttggcacaccaggtcacgtggaaattccaggctccctttgtggaagaacgaatttggggaa

SEQ ID NO: 703419 - DNA, 508 bp, Homo sapiens
  misc_feature (48)..(48): n is a, c, g, or t
  misc_feature (50)..(50): n is a, c, g, or t
  misc_feature (159)..(159): n is a, c, g, or t
  misc_feature (222)..(222): n is a, c, g, or t
  misc_feature (232)..(232): n is a, c, g, or t
  misc_feature (278)..(278): n is a, c, g, or t
  misc_feature (417)..(417): n is a, c, g, or t
ggcaccggtgggacgtacaaggttggtcctagtgattgtccccggggncnactcgcaaatccgtaatggtgtattagtattagaatagtgaataaaatgggaaagttatacatgtatacttattatcttgctccagtattttatctcacttgttctagnattttctgtaaaccctgctactgggtttgaagagttttagtcatcctttaacaatttttaaanatttagcttntagattccatttggtaaggaaatcaatattggaagtattgctaaantcttataatatgaaaagagatccactaatgtagcttaaggttattagatttgggcttttaatcatggaataatcttatgtattggtgtaagagttgatgaatgactttagctgtgtgaatatataatagtcaaactgcnaacattttgcatcccttttgtgacctaatttacagacatttaaattgtgttgcagttctgctttgccgtttaataaaaagctatttccaga

SEQ ID NO: 703420 - DNA, 237 bp, Homo sapiens
  misc_feature (10)..(10): n is a, c, g, or t
  misc_feature (31)..(31): n is a, c, g, or t
atctgttatncttcacaggtgttgatgaggngacctaacctcctggctttttcccaaagccagtttgcaggtcctgatggtcgattttggactactggtgaggctgcagcaaagggcctggcccagagagatgctcaagagtaggatgaaaagaccgtgggtttcttcctctgcaaaaggaaaggtttgggactgatggatgctgaaaagtctcattccctccaatccacaacagct

SEQ ID NO: 703421 - DNA, 140 bp, Homo sapiens
ctcacagagcgcccgggaggacgggctgtttgtggggtatgggctcagaacctagtgggcgctggttagggcacgtggaagtgtggactcccgtgcgtagatgacagtggagcccctacgtgatacacagagctcgcgct

SEQ ID NO: 703422 - DNA, 240 bp, Homo sapiens
gaagttgccagacatgtcactaggtgttaatgcccagaagagtcaggccttgaagcaaagtcaaggccatttcacggagacccatgtaggagttgtgctttgtcatgtgttatttaaggtgttaagaaaaattatctaaaacttaaccacaaggcaaaaaatgtcactgatacccttttaggagcatgtgagagcaccatccatgcagctgtttgacttacaattccctattaattaagt

SEQ ID NO: 703423 - DNA, 284 bp, Homo sapiens
ttcctagaagctctggcgagtgctctgactggctgtcttcaccacatttcttctgaaagcctgttgaatgctgtgcattcgttttgcatgatgaattatttccctctggcccctattaaccagcttatcaaagagaatatcatcaacgaactgctgacttcgggtgacacagagaagaatattcataagcttcatgttttgaatacttgtctgaaacttgatgaaagtacttacaaatctgtgcacataccgttgccacagctgccactgtcagcatcacagcc

SEQ ID NO: 703424 - DNA, 778 bp, Homo sapiens
  misc_feature (293)..(293): n is a, c, g, or t
  misc_feature (295)..(295): n is a, c, g, or t
  misc_feature (316)..(316): n is a, c, g, or t
  misc_feature (427)..(427): n is a, c, g, or t
  misc_feature (462)..(462): n is a, c, g, or t
  misc_feature (464)..(464): n is a, c, g, or t
  misc_feature (470)..(470): n is a, c, g, or t
  misc_feature (474)..(474): n is a, c, g, or t
  misc_feature (479)..(479): n is a, c, g, or t
  misc_feature (482)..(482): n is a, c, g, or t
  misc_feature (514)..(514): n is a, c, g, or t
  misc_feature (531)..(531): n is a, c, g, or t
  misc_feature (538)..(538): n is a, c, g, or t
  misc_feature (669)..(670): n is a, c, g, or t
  misc_feature (674)..(674): n is a, c, g, or t
  misc_feature (691)..(691): n is a, c, g, or t
  misc_feature (700)..(700): n is a, c, g, or t
  misc_feature (703)..(703): n is a, c, g, or t
  misc_feature (708)..(710): n is a, c, g, or t
  misc_feature (712)..(712): n is a, c, g, or t
  misc_feature (723)..(723): n is a, c, g, or t
  misc_feature (729)..(729): n is a, c, g, or t
  misc_feature (753)..(753): n is a, c, g, or t
gttccgagggaccactcccagtaaaaaggaggaccaccaccaagaagtgggggtcctcctcctaagagatctgcaccttcaggaccagttcgcatgtagcagtggaatgggacggaatgagctcctgtatcacgtggaagagatacgttatggaggtcgacctcgaagggaacgcgctgccctctcgtagcagatgtctatttgtccccaagagatgatgggtatctacgtaacagacagctattcaagcagagatgacccaagtgctcgtgatactagagattatgcaccancnccacgagattatacttaccgngattatggtcattccagttcacgtgatgactatccatcaagaggatatagcgatagagatggatatggtcgtgatcgtgactattcagatcatccaagtggaggttcctanagagattcatatgagagttatggtaactcacgtanangctccnaccntacangangggcccccgcatcttatggtggaagcagtcgntatgatgattacagcanctcacgntgacggatatggtggaagtcgagacaagttactcaagcaagcccgaagtgatctctacttcaagtggtccgtgattcgggttggccagccccgaaagagggcttcccccttctatggaaagggggtacccnncctncacgtgattcctacagnagttcaagncgnggagnnncnagaggtggtgngccgtngaggaagccgatctgatagagggnggaggcagaagcagatactagacaa

SEQ ID NO: 703425 - DNA, 198 bp, Homo sapiens
ggggccccttttttcccttttccgccagggcccgggcctgggcccaaggggggggggtgggtcctcccaggttttttggggggggccccctcctgcctgttttgggtcctttggtccccccctaggggtcccttttttttttttggggggtcccccccccccttatttaggttttttttttcccctttgggggggcca

SEQ ID NO: 703426 - DNA, 749 bp, Homo sapiens
ccgcacagcgcggtgagttatatttaaactccacggggcagggcgccatcacagcagtccgcggtcacaggggccagaaccgaggatgccccccaaccctatgaactcaacacagccatcaactgcagggatgaagtgtgtgtctccccttccatctgctctgcagaggtccctcaggctccctatcagccaccgtccagcatgcctcagttatctcatgcacccccatctatcctcctcccgacatcgcaaacgtcgcaggacttccagcaagtcggaggcagtgagcataggggtggaggccacgggttccaaggcaaaatgggccgagggagcttggggaggccgcacacacacacaacaacacaccactgccctgcagcaggcttcacaaaaagcaacagacgcaagttccagtatgggaattattgcaaatactatgggtaccgcaatccattcctgtgaggatgggcagcacttcggatgttgaagcctgagtggtatcggaggcccgggacgtcctagatcatgggctgacaaaagtgaggcccattcttgaccccttgaagcactttggccattgcaaaagatgcggggaccacgatacaccggccaatgggtgcgggacctaggaactcatcagaatacccacgggcatccaatcccacttcatgccccagcctcaaaaagaaatccggaaaacgatagcctattccggaaggaacaatgcgataatccaaaaacccaaa

SEQ ID NO: 703427 - DNA, 1255 bp, Homo sapiens
taatggctaagaatgttaaagaacaaaaaggtactgggaaatctgacaaaggacagaattcagggtgaatatttccaataccggtgatttttaaaatataagtaagtggtggagtatcgtgagaattacccctcacttctcagtgtgacagtgaagtttcatcattatattaggaaaaagttatcaccgttcaacgttaaaaaaagttaagaggttaaagagggtggccaccactttattaaaactactggggtggccaagggaagaggtactatagttaacaagtgtgtaaaccagtggtgtagtgtctcctcattaacttttaaagtggtgaggcgcccattgaaagaaacgggtaccactcgtggtataaatctcttattaacagtgtggttacaaagccacaaaagacgggaagaggttgtcaagcaaccccattccccataaatattttgggagatatttacaaagccacgaggcgtgaacatattgaggaatttgtgacaatcgtggatacgtggcccagtggtccacgataaagatagatttgtggtgaccatttttataatccaggcgtggtggagaaactctcgtggcagcgtggtcaactcagggtaccaaccaaaagaattcaaacccctgtgtgtcccgatgtgtataacttgttataacttacaaagaagtgcgcgagaaaacccagaattcaacactttccgagttacagagcggtccacaaagggccacccaataggggcagtcagactcgtgccagatcttatttgacaatagtagttaaccacaatacacagctcttataagctggttcatattacttcccccattaaacaccaagtcagagaaccacgggtggccctttcacaggtgggtagaacttattccaaaggagggagggccggataaaccttctggcgacaggatggtggtcaaagaacgtgaacacatcagagctgcgaccccaattagggccaaagatgggcaacgggtggaaccccggggggggcgacagtccgggtataacaaggggcggaaaacccatttatacagaccaaaaaagagagataataaaggagtttgagcggtaaaagcgccaatggggtgggatcacacgaaagacgcgggggcactttacgcaaacatagtaggaaagaccacggaaaaagacgaggaacagaacgatgtacactcacgagggagacactgcacgacaaacagcagtatacatcacgagcaaatg

SEQ ID NO: 703428 - DNA, 143 bp, Homo sapiens
tatgcatgctcgcccctgaggttatgcagctcgcccctgagttatgcagctcgcccctgagttatgcagctcgcccctgagttatgcagctcgcccctgagttatgcagctcgcccctgagttatgcagctcgcccctgagtt

SEQ ID NO: 703429 - DNA, 577 bp, Homo sapiens
atcgaggagatggaggagcgcagggagaagcgggagctgcggcaggtgcgggcggccctcctgtccagggagctggcaggcggcctggaggatggggagcctcagcagaagcagggcccagcagcaggagggacgcgcacaaggcgcaaaggagacggtacaggaggcaccaaggtgatagaatcattggagaagaccctaggaacgtcagtaagcgctgtcgtgtcttctgccccacagcacgcacccgtatactgccctccttgctggtagaagctgaagagcacggtcccccaggaggcagctcaggataggtggtatggagctgtgccgaggcttgggctcccacataagcactagtctatagatgcctcttaggactggtgcctggcacagccgcgggccaggaggctgccacacggaagcaagcagagtgaactaatttcatttcaaggcagtttttaaagaagtcatggaaacagacggcggcacctttcctctaatccagcaaagtgattcctgcacaccagagacaagcagagtaacaggatcagtaggtctaagtgtccgagactta

SEQ ID NO: 703430 - DNA, 489 bp, Homo sapiens
tttgcccttttttcccccaggttgaaatttccccccccaaaaggggaaaaaaggggggggtccccccggggggggggcgttttaaaaaaagggggttccccgggggggggggatttgggcgggggttaaattttgttggatttttcccggttttccccaaggaattggttggtttaaaaaactcaattttgggggcaaattttaatttttttaaaggggttttgggggtaaatttttggggggaaaacctggggaaatttttaaaaaaagggggaaaacccttttaaaaggggcgtttttttaaaaagccaaaaaaggcttttttttttaaaaaaattagcagggggttaaaactttaaaggagggttggttgggtttttaaatggggatttttggttttttgtttaaaaaaccccccccccttgtttggaaaaaaaatttggtttggggaaggttacaggaaaaaaaatttttaaaatttttttccca

SEQ ID NO: 703431 - DNA, 162 bp, Homo sapiens
tgctcgcccctgacatctaggtatcgggaggactcatgaccacagcttctgggtggcaggatggcatggactgagtcatgagtccttccacgatacggaagttgtcatggatgaccttggccaggggtgctaagcagttggtgatgcaggaggtgctgacgg

SEQ ID NO: 703432 - DNA, 675 bp, Homo sapiens
tagacacattatcctctcccaagtatacttggcttgacggcagtaccaccaattaagaatgcaaatgctgtcctacactgcatttcttacttatctccagcatcaaaggaatttgaacaatttgactggcgggcacaagggaaggttatgcctcactgtatatataatcatttacacacttagtgctctcaaaaatgtgtcattctttcacaactcaaattttgcatgaagtatttataaaagataaagaaattgacatattttaagaaaatattgcaagaattacggatgtgagcatttgaagcatcattatacattaaaaatccataaagctttcagagatactgccattttggtgtagcatcaaatcattgatctaataaggaacacttttgaactatgaaacattattgttctctagagtttcgtgcagattatacaactcaaatggttatatatgatcatttcaagaataaagaatgcaaatgcttaatttaatgacaagtattctgtttcatggcagacttttttttaaacaaatgggacactgaatccttctaatttttgcataaatccatcattctaagatgtccagagatctggccttttgagggtaggttctatttagaagtaaagcaactggttcggacacttgacttcaccttagggttgcct

SEQ ID NO: 703433 - DNA, 380 bp, Homo sapiens
tcatagatttttttgttgtttagagatggagtctgttcactggtacacccaggtctggagtgcagtggcgcgatctatgggtcactgcaacctcttgcctccgtagattcaagtcaattctacggcctcatccgtgcctctgcactcagccgtcctcaagtggtctgggagttacagactgtgcaccaccgatgcccggtgtaatttaatgtgcttatttgtatgtgaaaattagttgtccgtgaattcgaggttttgaagatttatatgttctattatattatttttacagagacgaggttctcgtctgttattgaccctagcagtggatgtgactcatacgctcacatgcagtcctatcaacctcatggcgctcgact

SEQ ID NO: 703434 - DNA, 115 bp, Homo sapiens
aaaaaaattgcccccccttttcttttttaaaattttggggcatcttcgtagtaaagaaatgggtttttatgccagcttttttataaaaaaataaaataaaataaatggggccata

SEQ ID NO: 703435 - DNA, 232 bp, Homo sapiens
gtcaacatgcacctgcgcacacacacgggtgagaagcccttccagtgccacctcttttggaaggccttccggacccaaggcagccttgacaagcacaaccgcacccacaaccgggaaaggcccctcagttgcgaggtctgttaacagcgcttcactttagaagggggcccttctctaggcacgttgccagaccgccatatagagaggggccgcgccccacttctctccaaat

SEQ ID NO: 703436 - DNA, 187 bp, Homo sapiens
taacccctctttagtttttgtgcgcctcagaaaaccaaattaaaccccccccccgagtgttaaagggggggcgagggaacaaagagcaagaaagcgcaggaagagccgagcgcggggagcacctaccaggttcgcgtgcccccgcgacacattatatggcccggaaggggtatttgggttttcacat

SEQ ID NO: 703437 - DNA, 461 bp, Homo sapiens
  misc_feature (266)..(266): n is a, c, g, or t
  misc_feature (283)..(283): n is a, c, g, or t
ctccataatgtgtgcccaggaccagcctgggcaatatggcgagaccccccatcttttcaaaaaattaaaacaattagctgggttatggtgatgtgcacctgtattcccggctgcttggggggctgaggagggaggattctttgagcccaggagtttgaggctatggtgagctgtgattgcgccagtgttaatacaaaaagtgagctttgctaattcattttcaataacctacagcagcttttgaaatgttgtcattggaaggatcnaatgcacttggggctcntggacagctacagactcataatatgtgggcaaggtcagattggatgtatttgcacaatctggggactgtatgaggaccttgttttcattgtctttggaacacagcagccttagtttttagctctgtcaaagaatggaattatttcaagactgtttgctcagcaaaaatcaatcaaggg

SEQ ID NO: 703438 - DNA, 491 bp, Homo sapiens
  misc_feature (82)..(82): n is a, c, g, or t
  misc_feature (93)..(93): n is a, c, g, or t
ctaagatcctcacactagtcaagagtatacatgatgctagaattcaggcagtgctcctgattgagatgcagtgctctgcgtngagcaatgatncagactccagtatacgcgctcccgtggtgcatgcttcagtttctctctcccagcgtctcactaacagtgtggcagcttagccagtccctgtgcagcttcaacagctttgattaaatctggtctgcttccagtcctggagatgccagagaaatcacactgattaccctaacagactgtatgaaacactagacacatacattctgcacagcctcaacaacttcaggagagagagaacccagactctgggcaatgcctgtctgaatgactctttctgaatcacagatcagggatctgccatcagcccctcacagtgattgttctgcaagtctggcaggcctatactgattcctgcttattctaaaatacagtattgagcactgggctggcttcgtgagtgt

SEQ ID NO: 703439 - DNA, 294 bp, Homo sapiens
gcgctgctggccctgttcggtcagggcgacgaacacccggcgctggtcttcggcggatttgcgccggcgcacgatgccgtcacgctccagccggcccagtacgccggtcatgctcggcttgaggatgcacgcgaggtgcgccaattggtgactttcgagttcaccctgctgacgcaggatgcggatcacccgccattgctgttcggtcaggtcatgttcattgagcagtggccggaagaacgccatggtcgcttcgcgggcctggagcaaggtgagcgtaagggacggtctggg

SEQ ID NO: 703440 - DNA, 115 bp, Homo sapiens
tggtggttaactccccccaatctgaagtccgtaaatgaactactctacaagcgtggttatggcaaaatcaataggaagcgaattgctttgacagataactgctttgatattgctc

SEQ ID NO: 703441 - DNA, 247 bp, Homo sapiens
ctctttataaaaccatcagatctcatgagacttattcactatcatgagaacagcacaggaaagacccacccccatgattcgatcacttcccaccaggtccctctcatgacacatgggaattgtgggagctacaattcaagatgagatttgggtggggacacagccaaaccatatcaccttactttgaaactttaaaatgttttgtatatagttgataactttggagagatttgggttaaatgttggt

SEQ ID NO: 703442 - DNA, 85 bp, Homo sapiens
gctggatttcagcacggcgttagtggtttgtcctcttaatactgctttgacattggaggaatgaattcgcagaagtggcaggggg

SEQ ID NO: 703443 - DNA, 110 bp, Homo sapiens
cacgaggcccatctgtgccctgcaagcctgtatggatggatttcgactggtgaaattaaatgaggtcatccgttaagtggacattgttattacctgttcaggttataata

SEQ ID NO: 703444 - DNA, 989 bp, Homo sapiens
gaggagtttgtttacgaggacatggaggccctctgcagtgtcctgcgcactctggccactgacagtaacaagtaccgtgccaaggtcccgggcaagctcaaagagcagtgcaatggtttcaccggcagcgatccgaggttcacactttcactgctctttgagcttgcccgggacttgaggaggattgttcgatgacatggaggccctctgccagtgtcctgtgcactctggcgcactgacacgtaacaagtaccgtgaccaaggctgatcgtcggcaccagcgctctactttccgcgtccgtgctgcactccgtggagggcggagatgtgcctaagaaagagtatagtgcgcttacggcttggagagtgctctagcatggaacgctgggctcggaccggatctaagcggcctctcaaggaaggtgctgaagtacgcggcatgcacactaccagtcttatagaacaatgagtctactaccgagacatctttgcccctgggtcctgtgctgtagctggatgccactgccctgaaggtctgcaacgttccacgcttgagaagcgcctgtacgaggctgctgcttcagaaaccggaccaaggctcgacagccgtgtgcagaaggagcgcggcaccacattctggtgaaaggcaaggcacacggctgagagcgagactttgttactggcctaggggcgcggtgctcaacaacaagaacgaaccgccgaaaacgaacgggtagcccagccaagtgaggggcactcgacttcatttgagagtgccaaaaccataacaagacatgaggagccgatgcatggcggcccggacactggacctgaccttgactggcggcccgaggccctcacgaacgtcaaggcaggaagaggcccccaggtggggctgaaagggacccgcacttcaggggcccagaaccctgcggaggcgaacccaaggggaatcgaactgctgtataacaaaacggccaacaccagaa

SEQ ID NO: 703445 - DNA, 392 bp, Homo sapiens
ggtccccgttggatgagtaggaaaaatgatactaaaatgttatatctttctaaaagctacttactagggattatacattctatttttttaattatcaggattcctagtgcaacaccatgctgatggcaatattaagtaaatggtaaatgcttatggaatgaataaggagcattactagaccagttcagtgtaccacaatgaactggaaaagcagcaagcaggactcgacagacatgtaaaacaaaagaatctggttaactcagcccttgtgtattttaactttctgaaatgacttcatattcattctcttaccatttctggatgatagttgccagtgtaggtacaactactgacatccaatactcaggcagaaaggtgttgagggggccggg

SEQ ID NO: 703446 - DNA, 434 bp, Homo sapiens
tcactcactgcctgcccggaatcgccatcttgctcccgtgtccgctgaacgtgccgacgcctccgtggaccgtgacgccgatgtcgtcacgtaaactcctcgcgcggctttgggtggcccggatcctgcttgtcggttgaatcgctggtttgagtcacttctatggtactgggaatcggatccagtgacctctgttttgtttcggacccaccggctgcctcaaaatctgtaggagaaaggaatgacaacgttctaggccagttgttcgcagtgtgtggttctgggaccagcggcatcagcaacaccggagatactgttaaaatgacaaattctcgggccctaccccaaacctgcagaatcagaaactttggagtgaagcgagttatctgaattttaaccagcgggtaattctgataaagtttgaaaaccacaaa

SEQ ID NO: 703447 - DNA, 1113 bp, Homo sapiens
agcggaggtctttcgtaacgatctattattcactcgaagagttcggaaaccacagttattgtctctcattccatacactggggttgtattttgccaaggtcatcttatatcgaaattgactgcttgcaaaaccgctcggtattattagccaacagtaagagagtatcttagcaggggatcgagtcagattggcgcaggtgtggagagagattatgccttgctcgttgagcgtggtctttgaacacatacttgactgagccttaacgtattcccgtctaatgtggaatatattaaaggtaggccatcattgatgttactatagccaaaggttggagcacagtgcatgtagccagatgttcataggtctacttggcactatctatgatttccatacgtcacatagtgacaaccaaaagcgaagaaagggcgcactctctgtagagtgagtgctgctgcccactctgagagtgtcctgtgagactgacttgtcatgctgtggtcgatatcaagatcctgatccaggtcacagttgtgatacataagtggggaggccttgctgcacaagtgaaacagagaagtttagacaacatggactgcagaacataaaaagtttggaacaggttgaactacattccgtggaactgctcaaagagaacgtgatcgattcgtacagagttctctttcgtttggcgtgaactattatttgttaaacgtatccccataactctgtatccgaaaacaagctaatatggatgggcgggacctggattaggggtaaagatggcgttttacaccaagaggaaattggcgttggggttcccgtccaaggtgggaacttgtaaggggtccaacgaaaaggcgttccaatggtatttacattcggaactttacaggtttgccttattgcaatttgtgaattttacccacccaaaccacggggtcgggaaccgaaccccttggaaagacggcatgacacccacaggggccttggcgttttgcgattcggtcccacagccacaggcaaaattcctaaacaaaacgcccccctaaacacttatcaacaaggcttttgggcgccttcccaccaatttgctatggtaggggtattggtcg

SEQ ID NO: 703448 - DNA, 941 bp, Homo sapiens
gccttataatggaacatcagagcaaaagttaaatctctaaagaaaaaaagaaaaaaagtttgccccagtactaggacttgtggccccggaagttgacccttaaattaacggtcacggatctcttcagatgtgaaaaaggcccttaatcctggtagtggcccttataccaccgagttatgggcacaagaactgggtggctatctggcatgcggaagacaatgtcacaggtcggtaaaggtaggaatggtgtcccctcaagatcacagtggtggccacattgtgacagcatcaaagaggggggggtctaaacggagatccattaggccattaaagggatctcgcctaggactggcatgagcggcccataataaaaagagggttgcacggagcaatccgtgaaaggtgtgcgcttctggttttgtgcgaaaccccacgagagaaaagcgctagtcaagaaggtggcgaggtccgtaagattttttaaagtcccatccttcaagagttgtgaggagatacacttttctggtcccttacaagttaccccacgcgtccggtattcgtgtatagcacgccagaattgaagatacgataccgtagaaacgtggatgttcttccacgaggtgtcgatgactgggtaaattcgggcccgagaagtgttgggtactaaagaaatggcagacgggggggcagggcttggatgcccagttctgggtagacctctcacaagggcctaatgggtagaagtgatttaccaatcttggttctggaaagaacacccggtatataaggccagacaatgtttacacccttcagttgtggtcaacttgggttgccaaaacacaacaaaaataggggagccgtacaaatgtgtggggcaccaacaagagatcggccccggtggagagagcgctacaagcggggaaaaaacgccttggcacacc

SEQ ID NO: 703449 - DNA, 837 bp, Homo sapiens
cgggcctggcgggaaagtggaaaactatcggcggtggcccaggctcggtggctcacgtcctggaatcccagcactttgggaggccaaggtggggggatcacgaggtcaggtgatcgagaccatcctggctaacaggtgaaaccctgtctctactaaaaatacaaaaaaattagccaggcgtggtggaggcgcctgtagtcgcagctactcgggaggctgaggcaggagaatggcgtgaacccaggaggcggagcctgcagtgagccgagattgctgcactgcactccagcctgggcgacagaggaagactccgtctcaaaaaaaaaaaaaaaaaaggaaagaaaactacaggcggggacggatcccggggagtaaatgggagcagtgggtcgtagtctctcagaggccccggttccccttgggaccttaatctcttaagtccggggccagcggtacggagtaacttctctgggggcatccgagccccaagagccttggggctttcctcaatcgtggcccgtggagaagtgggaaataggtccccaaaaggggtaccttttcgtggacgctcggttaaaatgtggaggaaaatgtgagaaggggctttatacccttaacccccttttcccgagagtgaacattggttccaggggcagctcggccttcattctcacgagtctggtagggcgatacatcgggagaacgcccaaaaggggtatcgcgcacggtggtaaaaaggcgagaggacgtctggagaaccccggaaaagctccgtggactaacttgggagaaactgggggcctaagccccgggaaacgcctgggaggaaagaggcga

SEQ ID NO: 703450 - DNA, 402 bp, Homo sapiens
ctttggggttcatattttttcagttaatttcagtaaaaacataatttttaaaagggattgcccccattttcccctcctgggggggatccatcaagccagggggggctgctccaggggttcatagctcatcatgcgatatgtgcagggcatggtcacaaaaatttgcaaatggcaaacaatttaaaggaatatgccattctcatactgatatctgccaggatcaaaaaaatttcccaaaccaagctggcccaaacacaccccaaccaccattttggaaaatatttgcttataaatgataaaacatccccactgtccttttacctgtatttcaggggcaaggggacacaaattttgaaagctgacaaaaaatgtggaggaacaccccaagtccctaagccaagg

SEQ ID NO: 703451 - DNA, 906 bp, Homo sapiens
tggtggagagatgatgtgtggtggtagtgggggtgtgcgttgcgtgtgtgcggtgtgtgtgggtcgtgttgtagtgggtgtgtggcgggttgtgggtgtggtcagacaggatagctatcagtgggcaagcgctccccctgggggtactcgcccgattgttcaagcccccttgggcgtcttttttcgcccctctggcgcgcgtccccgtattcctggggggggagtcccccccaattttcgttgggcccccttcaagcaagtttcccctggcccggtccgggaaacatattcccgggttttggccctctcccgcgggttttctacagaccctgggggcgcccccacgacgggccagatccttgtgcttcgcttcctgccttgcgggcctcccgtttggtgccgccgggagaccccacatgggcctaggtgttaaccacgcttaagacggtcctctcttgggggccccccgcctctacagggcccacccctcttggaggggcctctttcctcaccaccaagaggctatcctctgctgcggccaaatttaaggggcgtggcaacccccccccccccactttgccctctctaagagatgcttgtcaagggtcaccctgctccaccattgcacaaacatattcccgcccgttgtatcccccatacgcttgtcacttactcttttgtaggagcaactgattcaaatttcgagtgtatccagcacattctcctccccaaatcccctcctattggtgaaaatcatcctgagccctcctccttataatgtgtcccaagacaccccatgttcttctgctctgtgtgccccccaacaacaacccaacaagagcaaaccccaggacaaaaaataatgggggacccccgggggaaaaaattttcaaagcccccaaaaaa

SEQ ID NO: 703452 - DNA, 462 bp, Homo sapiens
aaagggggagcccgagaaccacgggggttcccccttcccccctcccggggttggtttaccaaaaaccggttcgccctccctgtgtgtgttaagggtttttttccccacccatttcccttgggttgggggggctgtgggccgcgggggaaaaattccaaacccccccctcccggggggggttccgggggttttttttttttttaaacgaagttccccggggccaaaggcgggggggcgcgggggggttttttttttttttctttttgggttggggttttgccccccccctccccgcaaaaggccctttccctttttcgggggaaaaggggggggggggggggaacccccccttccccgggttttttggtttggaggggggggtttggggggcccccccttttatttttttcggggggcccggggtggaatttaagccccccggggtccctggggcccccccca

SEQ ID NO: 703453 - DNA, 197 bp, Homo sapiens
tgagacagagtctcactctgttgcccaggctggagtgcagtggcatggtctcagctcactgcaactccgcctcccaggctcaggcagttctcctgcctaagcctcctgaggaactgacaccacccagtgtgcctccacccctggctaatttccgaatttctagtggcgccccgccctttaccatggtggacaggttg

SEQ ID NO: 703454 - DNA, 138 bp, Homo sapiens
gctatgtttacctttttatcccagcaacaatcctattctagagtccatatcaacaagtagggtttacgacctcgatgttggatcaggacatcccgatagtgcagccgctatgaaaggttcgtttgtaccacgattaaa

SEQ ID NO: 703455 - DNA, 118 bp, Homo sapiens
cccggtacacagcagggcgctgatgtaacacaggaacacagcaagaaacacggtcacacgagtctaaacacgcggcaacgtaataacctaggtaggtcgtcagagactggaggaaagt

SEQ ID NO: 703456 - DNA, 794 bp, Homo sapiens
  misc_feature (794)..(794): n is a, c, g, or t
tagacgaagtgcggcgcagatggccggcgtgggatagtggggtctcgaagtactccgcgacctactgacccggagactgacagtgtctgtctacccgggactcagtattagccttcgcctcactggactcgtctgcacaagagtggggttccggagtagccctcgtgggaagctctcgaagaccaaagtgtatgcagtcccttcgtggtgacgtcgtgcgacagcaaacggtgttcgtgcatgtccagtctcgaaccgggcccaacaagaggaattgccatgaaacaaggtcttcgtggagagagatggatagagggcttaaaacaagatttcgaagagacgctgactgtcgggcgggtgagtgatctctggtggcacggaacacccatgttcactgcaggatatcggacctttgatttggaccatgggccttcgtgagctatccgtgccggcccaagaagggagattgactgtggtccggagtcacgtgtgggtacctccgtgagcaatcgatcaaatcgaatacctagggagacctttcacctgtcgtcgatgaggtgccccaaaggcccagtgataggtgccgtcctatgggggctgcatttgggcaggaggtggtggaccgttggtcaccggcctgtgaatccgggtactgtgcccagggatgctttgcttccagggtgaagtgagggtggaccgtgggcttgggtgccgatgtaggaacactggagggcttgccgaggctattgggaaacaagggcggggtaaacgagcatgggttcacggccgcaaan

SEQ ID NO: 703457 - DNA, 290 bp, Homo sapiens
aagcagttatacagactcaccaaatggaacaaatgatttttctctctttcttttttttcttttgagacaatctcgctctgtcacccaggctaaagtgcagtggcgggatctcacaaccccgcaacccctgcctcccgggtttaagtgattctcctgtctcaacctcttgagtagctaagattacaggcattcgccatcacactcagctcattttggtatttagtagagacagggtttcaccagtgttggccaagctgatctcgaactcctgggatcaagttatccgccca

SEQ ID NO: 703458 - DNA, 162 bp, Homo sapiens
tgcgaagacatttcacatcaccaatgatgcgccgatccctatctggacattcctgtcgcgcatgctgacaggcctcaattatgaggcccgcaagtaccacatacgctactgggcggcctactacctggccctcctgcgattcccgcacccgggaaacgcacg

SEQ ID NO: 703459 - DNA, 189 bp, Homo sapiens
tattaactgcaatagagatgggtatacaccatgttggccaggcgggacaggaacatctagacctcaggtgatctgcccgactgggccacccaaagtgctgagattacaggcatcagccactgtgtccaagtaataaatcttttatgtgtgggagaaattaccatggagaggttaaaacaaccatattag

SEQ ID NO: 703460 - DNA, 440 bp, Homo sapiens
  misc_feature (440)..(440): n is a, c, g, or t
ctctttaaagattactagagacagttttagccagcaaggtttgccttgaaaattcactcaggctggagtgcagtggcgtgatcttggctcactgcaacttcagcctcctgcaacctcagcctcctgggttcaagaaattctcctgcctcagcctcctgagtagctagctgggattacaggcacctgccaccatgcccggctaatttttgtatttttagaaaagataggcatctccatgttggccaggctggtcttgaactcctgatctcaagtgatctgcccacctcagcctcccaaagtgctgggattacaggtgtgagccaccatgtctgggctttttctttttcttttttttgagacaaggtctttctctgttgcccagggtgggagtggcagtgggtcctattcacaggttcactgcaggcctcagccttcccagn

SEQ ID NO: 703461 - DNA, 229 bp, Homo sapiens
caaggtgctgggattgcgggcgtgagccgcacactccgcctatattcaattttaaaaataaaaataggctgggcgtggtggctcacgcctgtggttccggcgctttgggaggccgaggcaggtggatcacaagaagaatcgcttgaacctgggcaacatagcaagaccttatctcttctaaaaatacaaaaattagctggtggcgtgcgcctgtagtcccagatactca

SEQ ID NO: 703462 - DNA, 1622 bp, Homo sapiens
gctccgggcgcctcctgctctgcacttacacgctcggcagctgcggggagcccggcagccacgctctccggcgcgccgcccgcggaccaccacggccgagggccgctgctgggcgccgcggtccccggcgggcgcgcccgagcagcaggcggcgatgcgggcgccgaccccggctggggggcgcccgagctgccgcggctgcgccccggctccaggaggggcggcgtagcccgcgggaggaccatggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcgcgccggggccgttgcggcggggcgggcggcggcgagcgggcgcggaggggggcgcgggcggtgcggacgggcagggggcggggccgggggcggctcagtcgggggcgctgaccgcctccagggagtggggaggagagagggggagacccctttgccttcccccctcagcaaggggctgcttctggggctccctgcctggatccagctctgggagccctgccgaggtgtggctgtgaggtcagggttttagagagcagtggcagaggtagccccctaaatgggcaagcaaggagccccccaaagacactaccactccccatccccgtctgaccaagggctgacttctccaggacctagtcggggggtggctgccagggggcaaggagaaagcaccgacaatctttgattactgaaagtatttaaatgtttgccaaaaacaacagccaaaacaaccaaactattttctaaataaacctttgtaatctaaaaaaa

SEQ ID NO: 703463 - DNA, 364 bp, Homo sapiens
  misc_feature (27)..(27): n is a, c, g, or t
  misc_feature (176)..(176): n is a, c, g, or t
  misc_feature (203)..(203): n is a, c, g, or t
  misc_feature (209)..(209): n is a, c, g, or t
  misc_feature (263)..(263): n is a, c, g, or t
agttactcgtccagggtagcacccacncacaacaggcagtatgtgtcttcaagaaagttctcaaaacagggagacttccagatcaccctctagggaaaccaaggagctgcttcggaactaaaggagaacttcatccgttctccaaatttttgggcctccctgaaaaccacatggtnttccctgtcccaatcgaccagtgtatngacggntgagtgcacaggtgccgccagctgccgcaccagcccgaacaccattgagggagntgggagaccctccccacagtgccacccatgcagttgctccccaggccaccccggtgatggagcccccccttgtttggtaaataaacatgtgccctcaggca

SEQ ID NO: 703464 - DNA, 259 bp, Homo sapiens
gatcgtgccggatacagcaccacccctcaatgattactgggttcctatactgacggagatcgttggctactacttgattgcacacggttacttcagcgtctatggcatgatgtgtggacacgctgttgctctgcttgtaggaggacctggacaggaatgacagttcggccacgaggccttacttcatgtataacacccttaagaaactcttgatcaagaccaacacgaaggcatcggagtcctgaaggcccagtgctcc

SEQ ID NO: 703465 - DNA, 2166 bp, Homo sapiens
gctccgggcgcctcctgctctgcacttacacgctcggcagctgcggggagcccggcagccacgctctccggcgcgccgcccgcggaccaccacggccgagggccgctgctgggcgccgcggtccccggcgggcgcgcccgagcagcaggcggcgatgcgggcgccgaccccggctggggggcgcccgagctgccgcggctgcgccccggctccaggaggggcggcgtagcccgcgggaggaccatggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcgcgccggggccgttgcggcggggcgggcggcggcgagcgggcgcggaggggggcgcgggcggtgcggacgggcagggggcggggccgggggcggctcagtcgggggcgctgaccgcctccaggtccccggggcccggtggccgcctctcgcgcgccagctcgcgctccgtcgagttcttcctgtcgcgccggcgccgggcgcgcagcagcgtgtgccgccgcaaggtggcccaggcgcgcgagaagcgcttcacctttgtgctggctgtggtcatgggcgtgttcgtgctctgctggttccccttcttcttcagctacagcctgtacggcatctgccgcgaggcctgccaggtgcccggcccgctcttcaagttcttcttctggatcggctactgcaacagctcgctcaacccggtcatctacacggtcttcaaccaggatttccggcgatcctttaagcacatcctcttccgacggaggagaaggggcttcaggcagtgactcgcacccgtctgggaatcctggacagctccgcgctcggggctgggcagaaggggcggcccggacgggggagctttcccagagacccggggatggattggcctccagggcgcaggggagggtgcggcagggcaggagcttggcagagagatagccgggctccagggagtggggaggagagagggggagacccctttgccttcccccctcagcaaggggctgcttctggggctccctgcctggatccagctctgggagccctgccgaggtgtggctgtgaggtcagggttttagagagcagtggcagaggtagccccctaaatgggcaagcaaggagccccccaaagacactaccactccccatccccgtctgaccaagggctgacttctccaggacctagtcggggggtggctgccagggggcaaggagaaagcaccgacaatctttgattactgaaagtatttaaatgtttgccaaaaacaacagccaaaacaaccaaactattttctaaataaacctttgtaatctaaaaaaa

SEQ ID NO: 703466 - DNA, 866 bp, Homo sapiens
catggtggcagcctgtaattccagaacttagggaggctgaggtgggcaagatcacttgaggccaggagtatgagaccagcctgggcaacatggtaaaatcccagcactacagaaaaatctaaaaattagccaggcatggtggcgtacacctgtaattttcagctacccaggagggctgagatgagagaatcacttgttcctgtgccaggtcacggtctgcagtgaacctgtgatggcacctcatttgcactgcggtcttgagagacagagcaaagccccatatcttagaaaacaacaacaacattgttcagtgacaccactgttgccagcgcacctttggcaaccgcacaaaacatttacctgccttgcggacaccactaaaacttgttgctacccatctctgggtctgggggtaactcactctcagcgtggggtccatcttctcaccctaggggatttcttaacaacaattcacgcacggggcggttagcaactaatacttggccccgaggctgggtctctctgcaattgcccgtgtgctcaaggccgatccttcctagacatgagcctcctgagtcagcctggtgcaattcccatgttgtgctgaacgcccattgggcatcccgcaaaactgggaattaggccaccgtttaagacaataaccatgttctggggcaagcttacttcacacaaagggactcacagttgggtccaggtccatccctagctaactaggcagcacggagtaacagctcctaggggccatattactccgcccggaaatccattacagattctcattgtccacacccagagcactggttcaaccagctatagtaggaacaacatttgccgcagggagccaa

SEQ ID NO: 703467 - DNA, 2187 bp, Homo sapiens
gctccgggcgcctcctgctctgcacttacacgctcggcagctgcggggagcccggcagccacgctctccggcgcgccgcccgcggaccaccacggccgagggccgctgctgggcgccgcggtccccggcgggcgcgcccgagcagcaggcggcgatgcgggcgccgaccccggctggggggcgcccgagctgccgcggctgcgccccggctccaggaggggcggcgtagcccgcgggaggaccatggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcgcgccggggccgttgcggcggggcgggcggcggcgagcgggcgcggaggggggcgcgggcggtgcggacgggcagggggcggggccgggggcggctcagtcgggggcgctgaccgcctccaggtccccggggcccggtggccgcctctcgcgcgccagctcgcgctccgtcgagttcttcctgtcgcgccggcgccgggcgcgcagcagcgtgtgccgccgcaaggtggcccaggcgcgcgagaagcgcttcacctttgtgctggctgtggtcatgggcgtgttcgtgctctgctggttccccttcttcttcagctacagcctgtacggcatctgccgcgaggcctgccaggtgcccggcccgctcttcaagttcttcttctggatcggctactgcaacagctcgctcaacccggtcatctacacggtcttcaaccaggatttccggcgatcctttaagcacatcctcttccgacggaggagaaggggcttcaggcagtgactcgcacccgtctgggaatcctggacagctccgcgctcggggctgggcagaaggggcggcccggacgggggagctttcccagagacccggggagctttcccagagacccggggatggattggcctccagggcgcaggggagggtgcggcagggcaggagcttggcagagagatagccgggctccagggagtggggaggagagagggggagacccctttgccttcccccctcagcaaggggctgcttctggggctccctgcctggatccagctctgggagccctgccgaggtgtggctgtgaggtcagggttttagagagcagtggcagaggtagccccctaaatgggcaagcaaggagccccccaaagacactaccactccccatccccgtctgaccaagggctgacttctccaggacctagtcggggggtggctgccagggggcaaggagaaagcaccgacaatctttgattactgaaagtatttaaatgtttgccaaaaacaacagccaaaacaaccaaactattttctaaataaacctttgtaatctaaaaaaa

SEQ ID NO: 703468 - DNA, 169 bp, Homo sapiens
cgctataataagtgatggatattatagtatatgatgcttgcgaattattagtactaactcttaaatttgagaaatgttttctctaacaagtcactcatctccacctttcacacacattctagaataaagttttagagcaaaaggctccaggtctggggtctaggtccta

SEQ ID NO: 703469 - DNA, 1768 bp, Homo sapiens
gctccgggcgcctcctgctctgcacttacacgctcggcagctgcggggagcccggcagccacgctctccggcgcgccgcccgcggaccaccacggccgagggccgctgctgggcgccgcggtccccggcgggcgcgcccgagcagcaggcggcgatgcgggcgccgaccccggctggggggcgcccgagctgccgcggctgcgccccggctccaggaggggcggcgtagcccgcgggaggaccatggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagcgagaagcgcttcacctttgtgctggctgtggtcatgggcgtgttcgtgctctgctggttccccttcttcttcagctacagcctgtacggcatctgccgcgaggcctgccaggtgcccggcccgctcttcaagttcttcttctggatcggctactgcaacagctcgctcaacccggtcatctacacggtcttcaaccaggatttccggcgatcctttaagcacatcctcttccgacggaggagaaggggcttcaggcagtgactcgcacccgtctgggaatcctggacagctccgcgctcggggctgggcagaaggggcggcccggacgggggagctttcccagagacccggggagctttcccagagacccggggatggattggcctccagggcgcaggggagggtgcggcagggcaggagcttggcagagagatagccgggctccagggagtggggaggagagagggggagacccctttgccttcccccctcagcaaggggctgcttctggggctccctgcctggatccagctctgggagccctgccgaggtgtggctgtgaggtcagggttttagagagcagtggcagaggtagccccctaaatgggcaagcaaggagccccccaaagacactaccactccccatccccgtctgaccaagggctgacttctccaggacctagtcggggggtggctgccagggggcaaggagaaagcaccgacaatctttgattactgaaagtatttaaatgtttgccaaaaacaacagccaaaacaaccaaactattttctaaataaacctttgtaatctaaaaaaa

SEQ ID NO: 703470 - DNA, 317 bp, Homo sapiens
gacatggtgtgatcttggcctttgtgatcaatgtaacctccgcctccgcctcctgggttcaagcgattctcctgcctcagcctgccaagtagctgggattacaggcacccaccatcacacctggctaattttttgtatttttagtagagatggggtttcactatgttggccaggctggtcttgaactcctgacctcaggtgatccacccaccttggcctcccaaagtgctgggattacaggcatgagacacggtgcctagcctaaagcttgtatttaagaatcgtgagtaaagatatcactctaactccatagttat

SEQ ID NO: 703471 - DNA, 357 bp, Homo sapiens
  misc_feature (80)..(80): n is a, c, g, or t
  misc_feature (128)..(128): n is a, c, g, or t
atcaccacatatggacaatagcccaatgtttcctgagttccctagagggttgaaagagaataggacctagagagatcacnaagttgggacaggcactcattaatttgatccaatgacaagagaccagnatgggaagaaggatgccttgagagatgtcagtgtgcacccatggatagaagcagctggtgactgggtacttgggaagccacatggacacacacaaagctcctggaagacgttttcaaggagttgggctgtgctgggatccagaactggctgaagaaaccatgagctgacataaaatttctgccacctagcagaatggaggctccatttggaaattaaattatatactta

SEQ ID NO: 703472 - DNA, 866 bp, Homo sapiens
ggttgactatgatagccacacaactttcttttggttcgtgttgacatggtgtgtcttacactatgcttttacttctttttctgtatccccatattataagatgtgtcctctgtaatcatgagtataatcggcgattggtcaacaatcgatttctgattaatctgtcttttacagaatttgagggtgttagttcaatcctatttaatgtacttacttacatattttgcgattaaatctgtcatctcgtgtgttgcttgtctatcgtgtctttgccttgtctttgcctgctcctgggtgattccattaatccatttttccccctcttagcatgtcggtgcgttatactgttgcttgcccataagttacccaagagattaccagatgcatgcctgagctttaaggtctaagagtaaatgagcatttcttgtctacttcctaatcaatgaaaggacttttacggacacttttatttcatttatgtatcctgcccctattatgtaactattactgttatgtattgtaacatttgaaatcccagcaaagtatattggttcagtcagtattcctttattcctttcggagttactcagtgaacgctctcaacctgtgcattgcacttcatcttttgtgcatatccaagctgtatatagcggtccttacgactttatactttgaaaagtcccttcaaatatttcctgataacagaactctgtgttggtttggccttaaaagttgactcctctattattgcctatcatttcaagaggatcttttttgagcagagggcaatgaaaggctcgtggggagggaattgcccaaaccgcttttgaaacaacccttgcaatggcctggttaatatctgggac

SEQ ID NO: 703473 - DNA, 429 bp, Homo sapiens
  misc_feature (41)..(41): n is a, c, g, or t
acattgtttactgcctccatcgaggatgcaccgtttcagtntcaatgactcaatattctggacaaaagtggacgaatgtaactaaggctgggaatgtcaatacaatcaaactagcaagggaaatgatcacaagtcagtcataatctggctaatatgctagcgtaactatttatgtagcaagttaaaaacacagagcctaactttagctagctaactgctaagaggatgtcatgtcattggaggagtgggtgagtgactgtctatttcccctcatcgtttttcagtggctacacacagctagagatgcaggagtctggtttggttagctagcaagaactttaatgactgttatacatttagcatagatcttacgttcacaaattccctctggctatctactccgatttcagagcactctccggtcgacgc

SEQ ID NO: 703474 - DNA, 258 bp, Homo sapiens
ggtcagacaataaaaatcccacccttaggcttgagtgttcctgtgctcaagcaattttcttgccttggcttcctgaatagctgggactataggcatgcaccaccacgcctggctagtttttgtatttttagtagagacggggtcttgctattttgcacaggctgatctctaagtcctggcctcaagtgatcttcctgtttcagtccccaaggtgttgggattatgggcatgaactgctgcacccagccctttatactc

SEQ ID NO: 703475 - DNA, 294 bp, Homo sapiens
cgtttgctctagacggatcccgatgtctctctggttttgtgctcctcctgtcgtggtgctcctcctgcgctccaagctcccccaaggggccagctatgctgccctgaggcagtggcttctgggcacaagcgtgtgtgctgcagcagcagcaggtgtggcaggtggtttgcttgcaggcccttgggtgtgcgcacgtgatgcagcatcctgggcagagccttggctcctggggtgtgtctctgcagccagggcgagcatggcatgtgtcttgtctctcttgggtggtgtgtgcat

SEQ ID NO: 703476 - DNA, 884 bp, Homo sapiens
  misc_feature (13)..(13): n is a, c, g, or t
  misc_feature (109)..(109): n is a, c, g, or t
  misc_feature (112)..(112): n is a, c, g, or t
  misc_feature (117)..(117): n is a, c, g, or t
  misc_feature (126)..(126): n is a, c, g, or t
  misc_feature (183)..(183): n is a, c, g, or t
  misc_feature (185)..(185): n is a, c, g, or t
  misc_feature (199)..(199): n is a, c, g, or t
  misc_feature (214)..(214): n is a, c, g, or t
  misc_feature (231)..(231): n is a, c, g, or t
  misc_feature (234)..(236): n is a, c, g, or t
  misc_feature (245)..(245): n is a, c, g, or t
  misc_feature (294)..(294): n is a, c, g, or t
  misc_feature (303)..(303): n is a, c, g, or t
  misc_feature (319)..(319): n is a, c, g, or t
  misc_feature (322)..(322): n is a, c, g, or t
  misc_feature (370)..(370): n is a, c, g, or t
  misc_feature (401)..(401): n is a, c, g, or t
  misc_feature (447)..(447): n is a, c, g, or t
  misc_feature (456)..(456): n is a, c, g, or t
  misc_feature (472)..(472): n is a, c, g, or t
  misc_feature (476)..(476): n is a, c, g, or t
  misc_feature (481)..(481): n is a, c, g, or t
  misc_feature (489)..(489): n is a, c, g, or t
  misc_feature (494)..(494): n is a, c, g, or t
  misc_feature (524)..(524): n is a, c, g, or t
  misc_feature (529)..(529): n is a, c, g, or t
  misc_feature (542)..(542): n is a, c, g, or t
  misc_feature (579)..(580): n is a, c, g, or t
  misc_feature (621)..(621): n is a, c, g, or t
  misc_feature (637)..(637): n is a, c, g, or t
  misc_feature (639)..(639): n is a, c, g, or t
  misc_feature (727)..(727): n is a, c, g, or t
  misc_feature (767)..(767): n is a, c, g, or t
  misc_feature (793)..(793): n is a, c, g, or t
  misc_feature (803)..(803): n is a, c, g, or t
  misc_feature (881)..(881): n is a, c, g, or t
aaaaaaggaacanaaggcaggctccggctccctccacccccgtgaggagcccttgtccatttcagccttgcactcagaaagaccccgggggtattgtagtacaacgtgnttnatgtntcgtggtanctgtcagagccttaaaacaggcccacccactactgtgaaatttcaaggaaataactnantcagtaaaaataanagttccaaggtaganctggtctcacaggtgancannngcttaaatncagagccttcttttctgtccaaagccactaaaatttgatctcctccttnacacattcncaggtcccaaatatgntanccaccttctgacaggtggctacaggtctacactaatggaagctctgcnaaaaacatctaaaaacaaccctcctgccaangaggtcagctggaaggaatatgctaagcccataaactggtcagagnaggtaatgngcgcattcagagaccnaaanaatantccagganttagnacctactcctcgagaggaaacggagagaantgctnttacttaaatatnaaaaataagggagaacaaaaaaataaaaacgtcccannctggaagaaaaatagggaagctgagggaaaatgaggctgtncataaacttttaaganancaaacttggctgtataactttcagacctagcttatggttggggaccacctgaactggccccagggttgcctctctctcaacacaaggngcatactgaacccttctgcagtatagtacacgttgctgcngcaagttcaaaggccacgagggaaanaccttttaancagagcaagggggaatctgaaatgacagaaggggggaaggtcggttcgcctgaagacctcttctggcctgtttggaanaga

SEQ ID NO: 703477 - DNA, 107 bp, Homo sapiens
cccccccccccccccccccccacatttcccggttttcccccagcccctggggcattttcgggccatcggtcggtttttattaaaaaagatttgttgttttgttccca

SEQ ID NO: 703478 - DNA, 900 bp, Homo sapiens
  misc_feature (896)..(896): n is a, c, g, or t
ccaggatgatgaggtcttaacaaaaaccagtgtggcaaaaaaaaaaaaaaaaaaaaaaaaaattttttaaaaaaaaaaaaaaaaattttttttcaaaaaatttttttaggggcggaatggggaaacattgtgggccactacaaaatatttggggacaactcccttaaatttgcgttttggacaggtttaaaattgttgtcgtgtggccaacaatattggtgttttctactgttgggcgagcacttttttattcaaaagggtatgtcgtgtcgcaaaagagaagtctaaagggagaattaagtagtcgtgtccccaacaattgtgtggggagagggggcaatatcccaacaaatttgtgagtcccggggagtggagccactttatttttttaaccctgtgggcggcgggggacaaagagttttaattgggcgacccagagggtcttccctttcgaggaaatcgttgtgaaacatttacctttttaatatggcgccttgggttctgggcccaatagagggcctatatttttgtacaaaagtgggggcccttacccggcggaggcacttttagcaaaaaactttgtgaggaaagacggggcagcgacacagtggacttagcgggctgccccctcaacacataattgcgagccggcgcacgggacagttaaaagtctcaccaacaaaaaacaacagaaccagcagacacaaacagatagttggccggcgcgcccgccgccaagaagagagattaccaccacactcttgtgggggccacgcgcgccaaagaggagtaatcaacccgcgccacaccgcgccacaaagacctcgggcaccaccaggggcgcgggccccccaaaaaacaacgcccgcggaccgccgctcggaccccccagggcnccag

SEQ ID NO: 703479 - DNA, 458 bp, Homo sapiens
actcttacatctgcactcctaggccagtactgcctgtggcaattgattatttgcccatacttatcatacaggtcctggaataacccatgtaggagaaaatcaatcatgactatgataacctaatttctcactctgagcttcaaggaaatgtcctcatgtcctcttctcttaccctcaaatgccgagattcccgtgaacaaaggatactgtactggcttccgatgctttgcattctccttcattctctgtaactgttgctggtgacatttcatgctccaagggttatagtgtttaagctgggaacttatattccccttcttctctacagtgtagtacaagacttcagatttctttagccactcaaattcttcttctaacttatggctataaagagataaggaccaataaatcagtatgtcttatcagaattcagaaggccgggcatggtggctcatgcc

SEQ ID NO: 703480 - DNA, 472 bp, Homo sapiens
  misc_feature (18)..(18): n is a, c, g, or t
  misc_feature (44)..(44): n is a, c, g, or t
caattaaaaaaatttatngttggatacagacattttcaaggacntatgtcatatatgttgggtggcacttctgccatgctctcctctccccattagtcccctttgtcccctagacactttccatgtccacctgtatgggcatgagtttaggtatctgactaagatctagaagccgcagattagagaagaaacacaatgtatatagttgttaaacattttcatgaacctcaatttttttataaatgtgtattttaaaacttgttaagcaaaaaaaaaactctttaatcattagctgtcattataaacttaggaggtcagaaatctgctttaaaatttttatttttatggctaataatgtgtgcttttatcacaaatgctttaattagaacatgaaaatttgtattttaaactatttttatcataaagtttgtattatatattacactttaaaataaatcagtatgtaaaacaa

SEQ ID NO: 703481 - DNA, 1032 bp, Homo sapiens
  misc_feature (375)..(376): n is a, c, g, or t
  misc_feature (522)..(522): n is a, c, g, or t
  misc_feature (526)..(526): n is a, c, g, or t
  misc_feature (536)..(536): n is a, c, g, or t
  misc_feature (545)..(545): n is a, c, g, or t
  misc_feature (566)..(566): n is a, c, g, or t
agcgggtgtctcccggggtcgggtgcgagtgtgcggcgcgctcttggcacctcccgcgcccctcgggtgtcagcgttccggcgcccctcccggccctttccccacggggacgcctcccgagccaccgggggagttacgccaagttggagggaaaaaggtggggcggggcctgcccgcctccgcagcccccaggcagcgccccaaagttggtgctgcaggtgcagcaaccctcctgccgccctcctccccggctggcccggccgtggcaggcgggaacccccaagggctcggttcgggggctcccgatgatctgccgcaacttggagggtgccttgctgcacagaagccacctgagctgggggcggccgggggcgnncgaggcccaggcggaagccgggctagccggctggccgtggggagagcttagcggccgtggcaccgagccggggtgcccatgtgactgcggtgtgcttgggaagaggaagctgcagaggtactgtctgatgagcgtgaaaggttgtntcancgacttccanatcgacttnggaggcacttccgtttggtancatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggtttggatccatgccagtctacaccccctgtagactctatagggtgttcggcggaaacatcctgacacaggctttaacgtgcccatgcaagtgcggatctacgagatcgaggacaggaccgcgggagaaaaaccaaacttgtaggacactttccaccccactctcacaatttggaccttttcaagtccttgagaccgggcgttctagattccatccgggaaacctttggttgcatctcctgaggtccactcagttacaaagacattggcctccgaagaaggtgaggcagtc

SEQ ID NO: 703482 - DNA, 170 bp, Homo sapiens
cacgctggtcaccgatgaaggcctgggcggtccgcattgctcagcgtcagggaagtacgccggcgaagtacagcctcaagcccaatcttcgcaattcgatcccgccaaggctggagacactgcgaattggcggacgcctctgacgccacactcgcctccttcaggatttg

SEQ ID NO: 703483 - DNA, 554 bp, Homo sapiens
tgagacaaacccgtgggtgtagggaactgactgactaacacatgaaatcctcaccgagcgtggctatagtgttcaccaccacaggcgagacaggaaattgtgtgtgacatcaaagagaagctgtgctatgttgcccatggacttcgagcaggagatggccatggcagcctccagctcctccgtagagaagagctacgagctgcccgatggtcaggtcatcaccatcggcaacgagcggttccgctgccccgaggcgctcttccagccttgcttcctgggcatggaatcctgtggcatccacaaaactacctccaactccatagtgaagtctgatgtggacatccgcaaagacctgtacaccaacacagtgctgtctggcggcaccaccatgtaccctggcatcgcccacaggatgcagaaggagatcactgccctggcgcctagcacgatgaagatcaagatcattgctcctcccaagcgcaagtactccgtgtgggtcggtggctccatcctggcctcgctgtccaccttccagcagatgtggatcagcaagg

SEQ ID NO: 703484 - DNA, 360 bp, Homo sapiens
  misc_feature (1)..(1): n is a, c, g, or t
ncagtagggtttttggactgtacagtgtttatatgatctgaactccttatacataagaaggtgtgtatattaatcccaattatggacttaaatattttaaaagtatgaatacccttatttgctgcaaaggccagtgtgtagacatttgctttttagcaatatttttaagtgctccgttttcgtgctggagaagaagtctttggcacacagactggtcagtaataggtgatgcaggtatgtccaggttaagccaacaatgttttgcatttctatgcttcttttctgtcaacactaatgaaatcaacattgcctgaatgtctgaatactgaaacacagccctgtttaaaagtatgtaactga

SEQ ID NO: 703485 - DNA, 442 bp, Homo sapiens
gtatcatctctgaatccccgcgtagccgctgcctcctcctaccctcgcatgtatctaacccggtctgagatacgacaggggcttgaatactttttctcccgaagaaagattacttcaacgtggaatatgccattgtaggctatcacagcttggttctaccagccattgggatccagacatcagagggtgtgtgcctagctgtggagaagagcatatccttccccaactgatggagcccgaagtagcaattggagaaaatggtagagcattgatgctcacataggtggtgcccatgagtgggctaatggctgatgctaagactttaattgatcaacgccaggagtggagacacagaaccattggttcacctacaatgagacaatgacagtggagagtgtacccaagctgtgtccaatctggctttgcagttgggatacagaag

SEQ ID NO: 703486 - DNA, 137 bp, Homo sapiens
tgaggtcgacctaagactctcttttgataggcaataaacacagagcatgaactgtctgaacacaactattctactgtaatacttaatacagaagacatgatccagacaacataatgcagttacttgcaatgaagaaa

SEQ ID NO: 703487 - DNA, 411 bp, Homo sapiens
tgggcggatctcctgaggtcaggagttcaagaccagcctgaccaacatggagaaaccccgtctgtactaaaaatacaaaattagctgggcatagtggtgcatgcctgtaatcccagctacatgggaggcttaggcaggagaatcgcttgaacccaggaggcggaggttgcagtgagccgaaattgcaccgagctgagattgcgccattgcactccagcctgggcaataagagcaaaactccatctcaaaacaaaaaaaaaaaatggtgattaattttagacttagagatgaaaatagagatagagtagaaggaaagggcctcaagtcaaagggggatgttcaagatcattagtcataagggaattgcacttcaaaaccaccaagagatgccatttcacacccactaggata

SEQ ID NO: 703488 - DNA, 843 bp, Homo sapiens
  misc_feature (640)..(640): n is a, c, g, or t
ggggctgaggcgagcctgagcgcgctgttggccgtgagggaagccggaggagaccgggtcgactgggcagagcggcagagggtcgatggagcctgctctgcacgcccagtgaatttagaaggtgggcaggcagcagggtcacgtgagggagcgcgccgtgactgagcttgggtcctgacgtgatgctcaggctcgctgacccaagacgtggtgtgtgccaggcctccaaagccgggcttacacccaatccaatgtgaggacgggaccgggacacagagggactggagcgatgcaaaggagacatggcttcatcattcctgccctgctggggggccaatcaccgggcggacagctggtggatgagctgagctcagggggacgactccgggggaggtggatgttcccccatagccctgagatcgaggagaccagttgccttggcctgagcctgtttgaggagagggcttgccgcgcatccttgaagggcctgattcaggtggccagcagggagcagctcttgtacctgttattgccgtggttacaagcgggtcacccgttggacacttgtattactccttaaaccaagcttctttgattttgagggaacctgcacacaattgggaagctttggaaatgcacnttgggtgattcaatgccccaggccaagctattgccggaataatatcgcagtagtttacaaaaattcgatccaggttggaatcctcaggataccagagaagaacggaaacgaggcaaatcgggttttgggggccagtataagtctctatttatgaaaacccttgcgagcacgccccatattttgatactgcggacaaccacctt

SEQ ID NO: 703489 - DNA, 979 bp, Homo sapiens
  misc_feature (93)..(93): n is a, c, g, or t
ccgacaaggtgcccggcggctggacctcgtgtcgcgagctgccatggcccagtggaggaagaagaaagggctccggaagcgccgaggcgcggnctcccaggcccgcggagtgactcggaggacggcgagtttgagatccaggcggaagatgacgcccggtcccggaagctgggacctggaagacccctgtcctaccttccccactccggaatgcaccctcgtaatgtgtgagccggacacccaggggagatgggtgcgtgcccgagagaactaagaagcaaatcaatcacattctggaggcttccagtccatgtggcctgagctacccggttgttcaacggcctcatgaaggaaggcgtacaaggtgcctagacaccgcatccagatgaatgaccatcccggtgatcttgggatggcaaggacgtgttggccattggcccttggactgttgtgttggcgccagacagcgctgctttcgcgtctctcccgaattgttcgaggcgggcgtcaagaccctaccagtgctccctgacctggtggcccgcgccctctatccttctcgcctgacgtctgatgagcttggccctgcagaacccttggaatgttcggctacgcgagctaggcacagtttcactggcccttcatagatttgcctgatcctgggtgtacgacgcggcttgcatgaccatgttttgcagcccttgcactgaaataatctcgacgtcttcatttccttgcgcacagcccggacgggttgggtgcactgtttgcttgtggcatatgcagccttgaatctgcagcaggtgttggacaccgtgggtggttcgggtggacgcttaccgggctttcttgagctggggtttcgcagaaacacgcttccgggagattctatctgcgccgccgtcccggggggccccccacaggggtggttcccggcgggctgccaaaatggggggggcattgcccgggcggcctcgag

SEQ ID NO: 703490 - DNA, 711 bp, Homo sapiens
  misc_feature (93)..(93): n is a, c, g, or t
ccgacaaggtgcccggcggctggacctcgtgtcgcgagctgccatggcccagtggaggaagaagaaagggctccggaagcgccgaggcgcggnctccctagtgccctgctgtgcatgcatgactctgtgatgtgactgtgctgatgttttgatgatcctagtgctgtgatagatttgagctgccctgtgtgccctggatatgcattgtgtgatcctgtgtaatgaaccccgtgaccctaccgtttcccacagcctctgtgataattgcatccgtctgtgtatttgttgtgactgcctgtgatctacgcctgtgtgagtgaattgtgttgcgtgttgtccgcatgatgacagatgatagtgagacgatagacagtgtccttgtgatgtgtcgttccgatgttccgattggtgaccttgatcggctgtacctcgcgtgtgcttgtctctgcatgcttgttgcgtgttcgagttggagactcgcagactgtggtggtgtatctatcactgtgggtttgcctccacatccttccccctcctatgtacccgattggagtgtggatattgatccccatgttcgctccttgttgtttcgacgctccgttcttgctgcactttgtggcgcctactgggcaccgttgttgtgggtttgtggcccgagcttgtggcgcctccttgtggatcctcgtggggtccacggctgcgtggccgtcg

SEQ ID NO: 703491 - DNA, 222 bp, Homo sapiens
gcaattctcctactcagcctcccaagtagcggggcattacaagcgtgcaccaccacgcccagctaattttttggtacttttagtgggagacgaggttttaccacatgggcagggctgggtctcaaacttctgacctgaagtgatctgcccacttcagtctcccaaagtcctgagattacaggtgtgagccaccatgccgggcctcatcttatgtaaggatgc

SEQ ID NO: 703492 - DNA, 483 bp, Homo sapiens
  misc_feature (385)..(385): n is a, c, g, or t
agaataatatggcatatatataatggtgatagtgttaaatcttctgtattgtggttatccaatatagtgtaaccatctgtaccgtggttatcacttttaaaatttctactaaatcttgtaaatgatacccatatgtgtctttaaatactgctaacatagctccttgtatattgtttacttttaacaagttcttttaatagtgctatggtacattgtggatttacattttctatattgctattgttacttgtaccgtctgcactgctgttgttgccctctgtgcccccgttgtctatagcctccgtactgccgccactacatacattgccgccatgttcgccatttgtagttacctgaatctgtgtagcttccacttcagaacagncatagccactatctgatattgtaaacagccgccttattgcctttttctgcccactatttaaagatatttcttgtaaccgtggacttaactctggttac

SEQ ID NO: 703493 - DNA, 506 bp, Homo sapiens
acaacattttaagtaacaatatttttacacactacctctctctaatattttttattataaaagttaaaacatcagaacttttggggggaaaactactatcagggcttgacttttggtccaattttaacctgtaaaatacagatttatctatgtacgctatcatggaaatggaaatcaaagctgctatagctttttatttaaataatcctgtaaagggttatctatcaatggttatttcaagtaagatctctgtattcttaaatttatgggtgaaataatttgattactagatattattgtaaaaccaatagatcctggttataacgataaatttatcagtctacattggtaggctagaatcaatttatttcaagtgccccttattaaacaaaagttatcagtggatccaactataaaattttatagtaactaaattgtacaagcctaaaactgtgattttggtcctgtatcttaggtaaatttatgataatgttctcgagctatca

SEQ ID NO: 703494 - DNA, 156 bp, Homo sapiens
atcagctgttacctaccgttgctgtggttgaccgtggttatgtgttgctctctcggtcaagagtttgtctaagatcttcttaagcttggctggtcgtccttgtaagtgatcattagtgctaaagcacggtcaacccacaagccacggtcaacccac

SEQ ID NO: 703495 - DNA, 238 bp, Homo sapiens
ctccgcactggagagtcatgataattcgacaggtacaagtctagtgcgcacgcctccctggcaccgaggggagtgcacgccccacctgcaggctgtcaggcgttggagggagcagccccgtgcctcacaggcatgggcagctaccttactgctcatccccgggccatcctgcactgtgttcctcccatggtccagaagcctcctaggcttgggcagcgaaacacgtggtaacgcctcc

SEQ ID NO: 703496 - DNA, 633 bp, Homo sapiens
  misc_feature (172)..(172): n is a, c, g, or t
  misc_feature (348)..(348): n is a, c, g, or t
  misc_feature (561)..(561): n is a, c, g, or t
  misc_feature (625)..(625): n is a, c, g, or t
gtgaccacaggttctgggccagtccccatgtagagcaagaagggggtttcaatatcctgcaagccccacaaggtaaagtttttttgtccctttagccccagcctcccccccttctcccaccctgtacctcatcccatgagacccgggtgccggctcttttgtcacccttggncaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggccganatgggaaggcacagggagaagggataaccctacacccagaccccagggtggacatgttgactgtcctctcccctccagcctttggccttggcttttttagcctatttacctgcagggtgagccccttttttccctttccccagcatccctccccaaggaaaagccaatgttttccccccataatcctttttgccgacccctagttccctttgntcagccaagcttgttatcagctttcagggccatggttcccattaaaataaaaggtagtaattanaaaaaaaa

SEQ ID NO: 703497 - DNA, 990 bp, Homo sapiens
aatgatgcctttataaatctttctctcactgtctatttaagtgcaattaacatatgtcaccgaacttgaaagttgtctaaattcaataaggtaatgaccagttgttattttacagtcatctgtaagggctcccgttgcgtcaagttccttaaatcgaagatttatgtgacttgcaactaaagttattcagaatcagataatgacaatatatatatgtgatgatggatggatggtagaacgttgtggtgggcgcgttggcgtgaccatgatgataggagtttttaaagcaatttgtgttgggatgggggggcgcctctaggagataatggtactagagtggaccaataggtgttgacttgtaatggtaactacccttgggtgcgtcaaaatacaagggcggggagaggagattttttcactcaataatatcaaagacacggccggggtggggacgcacaagagatttttctggtaacaagcatgtcacaaagagcgaagggttcaaaggagtggcacatagcaaggggggtgttccatttgaaaacgtggagtgttggtaattgcggaagtactacatacaataatttcacgacccgggcggctatgtaggaacgagtgaaattacatttatcaatcaaagtagaacttactgtacagcgttcttattttccatgaccctgcctgtatatcaccctctaaacgaaattgaagctttcttaagaaatattccccaactatcgtgactctattaacccaatgtaccaagtggtgacttacaaatggtgtcgcgtggattgtactcattttatctcaagacctttctgcccccacaaatctggccccaaattctacgaagatcagcaaaatcgcaaatggatatggataagggccatgtcaaaaagacatcaattaaccctaaggtgggggtagacatccattgaaatcaatatctgacggcacacggagttcgcacactttattatttacata

SEQ ID NO: 703498 - DNA, 108 bp, Homo sapiens
  misc_feature (100)..(100): n is a, c, g, or t
ctgataacaagcttggctgagcagagggaactaggggtcggccaagcttgttatcagctttcagggccatggttccattaaaataaaaggtagtaattanaaaaaaaa

SEQ ID NO: 703499 - DNA, 219 bp, Homo sapiens
  misc_feature (18)..(18): n is a, c, g, or t
gaggcgggaggatcactntgatgcacgagttgagacagcgtggcaacgtagcaaaaccctgtctctacaaaaaattttaaaaattaaccagacatggtggcacatgcctgtaatcccagctacttgggaggctgaggtgaggggatagcttgagcccaggagttgcaggcttcagtgagccaagatcacaccactgaacttcatccagcctgggcacaa

SEQ ID NO: 703500 - DNA, 118 bp, Homo sapiens
  misc_feature (46)..(46): n is a, c, g, or t
  misc_feature (110)..(110): n is a, c, g, or t
tctaattactaccttttattctaatgtgaaccctagttccctttgntcagccaagcttgttatcagctttcagggccatggttcccattaaaataaaaggtagtaattanaaaaaaaa

SEQ ID NO: 703501 - DNA, 246 bp, Homo sapiens
ttttttaaccggtttttttttttggctccccaaatatttttttcccccaaagaaaagttttctccttttaaccaaaacccccccatagggggggggattttgggggggggggggggtttttttttaaaatttaaccccccatgttttttttttcgggtgtggttttgggaccggggaaaaccttttttttttcccccttgggggcccccaaaagggtttttttttaaattttttttaatccgggga

SEQ ID NO: 703502 - DNA, 169 bp, Homo sapiens
caggctggagcacccaggcttgcaagtcagcggtactcacccggcaaaatctgtcatagcgaacgtttgggggccaaggaagctcgacggcgtcgtcaaagccgttgccacaacggttcatgaacaccagcgcgcactcggctttcaagtagaccaggtctgcggcacc

SEQ ID NO: 703503 - DNA, 911 bp, Homo sapiens
gggtgatatggctcgatgttgtgtgacagcctacaatgtcagcatatcgacacctgttgttcagccggggtgtcgcagcgttagtgtgtgtgccgattcagcgcggcttggacagcccagtgatcgagcggtccgtccctcgccccccggtcttataggcgcgcccgaggtgtttacgcgcgctctttaaattctctacgtaggaagcccgttgcaacaatgatggggggttggccagaataaatgcagtggccgaatgtggtaaaattcgttaaggtattctcccgcggaaactgcttgtatatgcccgccgtagcgccgttgttcgtcacatgaggtcccttctcggtgctaattacccacggaggggcccgcctgccgtttttgacctccagtagaaatatatgtcccgttgtgactaatatagatacttgggaaagtcctcgccatacaggactctgacccgggcgtgccccaatcaggggtaaatatggtaggcggtacatggtgagggctggccacgcgcacacggcaagtaataattcagaacccctggtgtagaattacaaaccctacccttgtgtgtggagtaattgtacataattacttggaggcgtgatgttcctccaaagccggtgtgcaccgccaggtctctttttaatagtgaacacgcagcccatgttagtgcgaagccaacccttaatggtggatgtgcatttggatacaagacgccgtgacttggcgccggggtgccgtgaccacctaataagagtgcgcataaaagagacgcaccaatacaaagccccctcctgttaacggccactgaagaacaaataccccctgtgggtgtgggcaggaaaaaacttttcacacctctttcaaagcaaaaaattatattcgcccatcataac

SEQ ID NO: 703504 - DNA, 957 bp, Homo sapiens
atgcacttcctcctggattggtgttggacaaagataaagagaatgaagagaacgaaggtatgaaatatcattagaatgatctaatggagagagagcgtactgccctaggtccacaatgtgtagccatagaaatcactctatgaatcttgtgtctatgcctggagtgaaaaggaccaagacgagtaaaacgatgtatcataacttgagaactagagtagtatggacaagaaaggagacagactgagcttgcaaatgcagtgggaaaggcgaactcagtgattcagcttggtcggttgaaagtgttttgaactttctgtccgtagaatcctgtgtccagagtggtagttgatagattagatggggaaagcatgcatagagtgattcccggcttagcaacgctcaaggagtaaccaaggattgtggtgagtgcaggttatgaatgcatttcgaggtagagtgttacatagttgagcaggtatgatgttaagggacctggttacaatactccaaaagaagagtagtatgaattaagaacaagggtatgtacgtgtatgggctaagtctttgagaaaagaattcaagggagctagtagtaactttgcagattgaaagagtgagttagacatagattaatgtgaacgcttgcttggagggtaggggctgaataataggtgagaagaaggtgagttggatagaggacaactgatgagggcagggaagggaacaatggcgccaatgtgatgtctgttcgctgttgactgaaatatctgtttctactggggagaggattcggatgaactagaatgaagaattatatatacgcttgatttcatacctgaatgtgatcggaacgatcgtttgaaataaagtaagttcaagtcagtggagtggagttcgctacatttaggttctttgcacctagaatcaaagggtgtaatacgtatgctgaatgctggg

SEQ ID NO: 703505 - DNA, 813 bp, Homo sapiens
  misc_feature (216)..(216): n is a, c, g, or t
  misc_feature (518)..(518): n is a, c, g, or t
gggaaaatcactgacagaatcaagatgtaaattcacgtggtctgcatcagacatttatgaagtcccagacaagcagctaggaaaataacatggtcgaagtgaattaaatataatcatactgccattccagatagaactaagtagctatcaaggaactggagtaactaaaagcgttcaccaagacggctaaaagaacccgcaacaacagcttccgcnttagtctgagcgaacatgttaaatgttcatgccaaagatcaagtcttcacgaagaatcatggtcacgaagcaaagttgggaaaggactttactgaaggaaacgatgcagtcaaagtttaggaagcgaagagtgtctgtaccgatatgcactctatggacgtcccaggtatcgagagacacagtgacactacacttctcgcaagatgtagcatcgaagggatgctaaggaatacttgcgtggaacctttcctgggctagaaggcaacttagacaccagggaagagagtccacttcggagaagntcggcgtcgtggagacacctgttcgagtctcgcggctgtgccaaaatcaccaagcgcctctgtgggtgcaacctctcttaattgttccctaaccaatgtcggttccttccttgcgtgggggccaccttgcgggtcttttggagcttcaaggttaaggcaattagaagtgccggaaaagtgttcaaagtgtcccaattactctacgtatatgcggttagtttgaacactagaaagcaagcgacatatttataaggcgccaaacgaaaggtgtttagccccgaaatggcacaatttg

SEQ ID NO: 703506 - DNA, 920 bp, Homo sapiens
  misc_feature (281)..(281): n is a, c, g, or t
  misc_feature (390)..(390): n is a, c, g, or t
  misc_feature (403)..(403): n is a, c, g, or t
  misc_feature (444)..(444): n is a, c, g, or t
  misc_feature (448)..(448): n is a, c, g, or t
  misc_feature (469)..(470): n is a, c, g, or t
  misc_feature (574)..(574): n is a, c, g, or t
  misc_feature (618)..(618): n is a, c, g, or t
  misc_feature (631)..(632): n is a, c, g, or t
  misc_feature (657)..(657): n is a, c, g, or t
  misc_feature (665)..(665): n is a, c, g, or t
  misc_feature (676)..(677): n is a, c, g, or t
  misc_feature (682)..(682): n is a, c, g, or t
  misc_feature (689)..(689): n is a, c, g, or t
  misc_feature (691)..(691): n is a, c, g, or t
  misc_feature (697)..(697): n is a, c, g, or t
  misc_feature (707)..(707): n is a, c, g, or t
  misc_feature (709)..(709): n is a, c, g, or t
  misc_feature (716)..(716): n is a, c, g, or t
  misc_feature (725)..(725): n is a, c, g, or t
  misc_feature (733)..(733): n is a, c, g, or t
  misc_feature (736)..(736): n is a, c, g, or t
aaaaccaatgtccagctactcttttgacacttgaagaaatggagatcgatttgattgtttataagcagacacactgcaatttacaaagatctctttacggttttataaaattatcttccagttgtacatttatatggaatgttctttatcaagggtagctaatgacatgaaaataattgtgaaatatggaattatttctgacacatgaagcccactaaactatgctttcttataatgcatatttcttctcagtttattttttattttattttttttttttngagacggagtctcgctctgtcgcccaggctggagtgcagtggcgggatctcggctcactgcaagctccgcctcccgggttcacgccattctcctgcctcagcctcccangtagctgggactncaggcacccgccattacgcccggctaatttttggtattttnagtngagacggggtttcaccgtttnngccgggatggtctcgatctcctgacctcgtgatccgcccgcctcggctcccaaagtgctgggattacaggcgtgagccaccggcccggcctcagtttaattgtntgtaaatatcgaagctatatggtatgattataaagataatggcncaaagtgtacatnnagactggcagcatctatggtaacantgaaaccntgaccagaaanngtggnttgctgngnacaccnagctgccttngnttctgcnttaaaccanttttgatnccnatttgaccaggtagtcccattaaaaaggagacttcttaaaaagggttttaaacttcacggtgggactctaagggacgctggttaacgtgtcttaacaccgttgctcggtttcacatcttctcggggtgaaagcgttacggatataagctttcgccatgttggaacccaaaatcgattcgaatgt

SEQ ID NO: 703507 - DNA, 262 bp, Homo sapiens
ccccccggggggggggcccggttgggggccggttttttcccggggggaggggggggggaacccggtttcccaacccccccccggggccgggggggggtttgggggcccccccttgggggccgccccccccccctttgggtttttgccgttggccaaaaattttttcacgggtggggtttttggggggggggggggggggcccctttttttttagtttccccatttacccctttttcccccaaggttggttgggcccccccca

SEQ ID NO: 703508 - DNA, 280 bp, Homo sapiens
tgtggtgagacagacagagagaggaaagaggtccacagccttttaaactactagatctcatgagaactcactcactatcaggaggatggcataagggcttagggctttgccattggtgaaggatccactcccacccctttatgataaaagatttttccacctaggccccgactctaacatgagggagtgtactttcacatgagcttgggaaggggcatagagaagaaccgtattatcctgtccctgaccccacaaatctcatgtcctcattacatgccat

SEQ ID NO: 703509 - DNA, 119 bp, Homo sapiens
attttccaagcctccagtaagagaactatggcaatcatctttctttttcaccatatcccagcttacctgccctaggttgggccacagtcagatttctttgaaagcccctagggctgggg

SEQ ID NO: 703510 - DNA, 390 bp, Homo sapiens
tagacttactcaaacagagaatgctgtgaaccatagtgctcaccagtaaaagaaattcatctggcactttcatcgtgttaattagaagagttgatggtaattcagatataaaggtttacatgcacagagagcaggcatatcaggcagccatagttcacaatgtcgattctgatgacctcattagcatgggatccaacgacactgtacggctactaaagaaaagtgacataccatactggtctttactaggtgaatcatcagctaattctctgaaagatgtaacttcacactatgaaacagggggccaccccttatcttagcgccagcaattatagctcttcctttggaatactaccctaattccctatccttatcatagcgggcatcatg

SEQ ID NO: 703511 - DNA, 185 bp, Homo sapiens
  misc_feature (175)..(175): n is a, c, g, or t
attctagaggatccctccggtttgcgaacactgcttgcgcccggaggaggacgaggaagagctaggtgcttcccattggtcaaacctaacccgaagccagagggcaagggagcctgttgatgccatccacacagagtcacgcctaccagcggtacaagcgggtaccgacgctcgnaattcagtaa

SEQ ID NO: 703512 - DNA, 509 bp, Homo sapiens
atgagctcagctatctggttctggtagaccatgtggatcgccatgtttcctgtttcattttcagctcgcagaagggtaggtccaaatacaatccccaagctttgcgtggacatgaggttcttggaggctttggccactatcttagttagatgtccaaagaggactttcatggtgtcacgatttggcggaaggagtttttgtacaaagagattttacagcttcaattcttgtgttggtggcttgctttttgatcgctttcacaaacagctcaaaaaaactgttaaggaagaagggctcatgcaagctcccggaaaaacatctttagtgcttcgggggacaacaaggatgtccttcccctgggctggtcgtccaaattaaaattcttttttttgggtggcaaaaaaaattaacctcttgtttgttgcaaaaagccccctacctgaatttttccataacaactaaaacttttttttaacaggttaaggcattgttttccaaacacggacttt

SEQ ID NO: 703513 - DNA, 130 bp, Homo sapiens
catcgacccgctggccaccctgtcttgactgggataacctggcgcgtgggctatgcgcgtcttcgccatcatgctggtgggccttgcgatcctcatgccgtgcgcggcgagcatcactcagccccagaag

SEQ ID NO: 703514 - DNA, 828 bp, Homo sapiens
agttcaactgcaaatttgccgcagaaccctctaaatccccttgtatattaaactgtcagtccacccatgaggatagcagctctctctgtgcactactaggttaaacacttcttgtggtagccgtagtacctagattgaccactcccatagataggtctaaaagcagctaccatattaagaaagctgttcaaagctgcacaagccattacctacgacttgaacatatccatgccaagacaatacaatcctagtcgctcgatcgccgctcccatcccctactgcatccattaaacaatagtcaggacggagggtcgacccgatcccctcccgttaccatcgagatcaatgtggtccacccaagggtaacctggggctaacgagtagacgggagtactcggctgcgacataatacataaaagtcggtaggatacatatgccgcccattaattaccctaagaaacccaggggaccttggaagttccttgacggtgggacaaatacgagtagtacttccggatggaagccccacaatatcgtatacccgctttacggtgtcacaaagacgtctgtgcacctcattgagcttgtcccccacaattaggctttaacaaacagattgcaattccccggaggttctaaagccaaaaacattttcaccgtacaacgaccgggggtatactacgggtcaagtgttctggaatctgtggaggcaaacacagttcatgcccatggtcctagaattaattcccgtaaaaatctttgaaatagggccgtattaacctatagaccctttacccctctagagcggaaaaacaaaaaaacaaacaa

SEQ ID NO: 703515 - DNA, 905 bp, Homo sapiens
tctgtacaaggctgctcgtttgttatgccaaagtcaaataaacgggagatgtcatgctcatgctttgatagaatttagtcaaatacaaaatttggtcataggtacaggactttctctctctctctctctctctttcagatttatggacacaggttgcgccctgtggccggggtgggaattaaccgggtgttacagatctcgaactcatgggaatgatgccgccatgccagttttcaaggaggaggtcacccctgacgagggttgcccgggggattgaggttggcagtgtcgtggaacaccagattgactaacaaagggcaggccaataaatgtctcgatggggacttgggatgagatgttgtgtacagaacaagggcaacccattggcggaggttgaaataacgacaaaagtgtttcttacaggatagacagtgtgagacagggccagtgcataattagtggaccagcatttagtaagctgcgggaggaagatgcagagtcagaagatgaagaggaggaaagaatgtgacacgctaaaagtatgtctggaaagcggtattgcacatgaaggtgcgaaaccgaggttccacattaaaatagttaaaactgttggtggatggaagatgcgtgacatgatgctggagcagatgatgcatgaagaatgagactggagaatgacaattgtggttgatgaaacagaaggaaaaggggcgggtaacaaacacataagagatcttccaggcagtgtggaaagtcaataaaagtgacgactaacacttgtgacaggatgggagaacctcacaggggaaaattaacgcagggcagtttgtgagattgaaagtgagaataaaaggtaacttgtggaacagaaattttaaaaaaaatggggtggataaaaaatgtgg

SEQ ID NO: 703516 - DNA, 218 bp, Homo sapiens
cattcctaatctgctcctcagaccgagtacaggtattcgatgattattattggtctgtacttcatctagtgccagagtctccagcagtacagggacatcctcaacttctttcaggagagcgagttcgatgctcgttatcacagacctagccttaccctgtgtgatgattgttgattcagaatacagggcctaccagtctgtgtacctcttcaggggtt

SEQ ID NO: 703517 - DNA, 233 bp, Homo sapiens
ctcaacttagattacaagcttcttgcaaggcaaaggattcagactcctactaattttgacttctctttaaaccacgggtctaaagttggctcatttctccaatggtcatattaaccctgaaaatccctataggcaaggcatgccacgagtggatatcaacataccgttctctaagtgcaacacagctatttactttctctaggccgggcatagtggctcatgcctgtaatccc

SEQ ID NO: 703518 - DNA, 325 bp, Homo sapiens
ttctcagcctcttggaaggcagaggtaggaggatgcttgagcctgggaggtacaggctgcagtgagccctgattatgccactgcactccagcctggacaatagggtgagatcctgtctcaaaaaaaaaaaaaaaacaaaaccccaccataaagggtgacatttatggcttgtaatttaaaaaaaaaaattaccagtgtggtaaagtctatggataaggagaagcagcataaaacagtcttgtcacacagacaactctgtactggcaaattatttgcacacagaccttttgtgaccaacatccggagaccggtgtcacacaccaat

SEQ ID NO: 703519 - DNA, 314 bp, Homo sapiens
  misc_feature (19)..(19): n is a, c, g, or t
  misc_feature (101)..(101): n is a, c, g, or t
  misc_feature (105)..(105): n is a, c, g, or t
  misc_feature (314)..(314): n is a, c, g, or t
gccttagaaagaagacagnaggatgaaggaaagttttggagcttccctagagacttgttaaattgttgtgacccaaaatgctgatagtgatattgacaatnaagnccaggctgagatggtctcagatgaagatggggtgctttttgggaactggagcaaagatgtttgaggcattgtgcccctgcccttgggatctgtggaactttgaacttgagagtgatgatttggggcatctggcagaagaaatttctgtgcagcagtgttgaagatgtagcctgacctgcttctagcaacctcagctcatattcatgagn

SEQ ID NO: 703520 - DNA, 355 bp, Homo sapiens
ggttatcattaggaggtgatcattcaggaggtgctgtggcgttttcttaaaataagacaacaatgaagtttgcaacatcaatggattctcatgcaagatttctctctagcatgcaatgcttttagatagcattttttttttttataaaacaaggtctcattctctcacccaggttggaatgcagtggtgtaatcatggctcactgcaacctcaaactcctggcctcaagtgatcctcccaccttggtctcccaaatcactgggattacaggcatgagcccacacaccttgcctgatagcattttacccacattagaacttctctcaaaactggagtcaatcctctcaaatcctcc

SEQ ID NO: 703521 - DNA, 811 bp, Homo sapiens
gaggagactatggagatagtactcgcgtaggcgcggtcaatgcacatacactctgtagctcgagaggcggtcgcgttgcccgggcgcgttcgatgtgtcctagcagagcacagacctgtccgcgctcgcctggcttcactctgcccctgcagcgattacactggttcgattctcccgcgccgcccctcgcgccacagtcaaaccttgcgagggctgccatcgaaggaacgcgccgcatctaggcaacgtaaggggctctgcctctggcggctctgcgtgcgtcctgtgctatcggggcccgtcgcgctgtccgcaggaaccgtcctgcgtggcgcgtaggttcgtgcggcagcttcgtagcgcgcgagccggccgtctgcgtggcgggaaccaggcgcgggcgagtggcgccagctgtaggagcactcacgcggtggagcgactcgtcctgggcgcacacggtggcagcctcgcacggaagcttccaccctcacctcgtgaagggcattgcggacacgtccgttctcgtgaagaggtctctagtacgtggactcaggtacgtcgcggggaacgtacatcagttgaggtaccatgctcagttcacattttgtgcatgtgtttacacgaagagcatccgcagaggatgcgcattggggacgaatgcgctcatggggtcgtgtggcttcggtcagtgccgtccgcggggcccttgcagggaaaagcagcccccaggcttccctgggccgtcgaagggaatcccttaacctaggtccctgatcccacaatcatctacgcgaaagtcccgccgaga

SEQ ID NO: 703522 - DNA, 680 bp, Homo sapiens
  misc_feature (8)..(8): n is a, c, g, or t
  misc_feature (81)..(81): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (102)..(102): n is a, c, g, or t
  misc_feature (113)..(113): n is a, c, g, or t
  misc_feature (119)..(119): n is a, c, g, or t
  misc_feature (121)..(121): n is a, c, g, or t
  misc_feature (162)..(162): n is a, c, g, or t
  misc_feature (174)..(174): n is a, c, g, or t
  misc_feature (186)..(186): n is a, c, g, or t
  misc_feature (195)..(195): n is a, c, g, or t
  misc_feature (204)..(204): n is a, c, g, or t
  misc_feature (207)..(207): n is a, c, g, or t
  misc_feature (231)..(231): n is a, c, g, or t
  misc_feature (261)..(261): n is a, c, g, or t
  misc_feature (282)..(282): n is a, c, g, or t
  misc_feature (287)..(287): n is a, c, g, or t
  misc_feature (307)..(307): n is a, c, g, or t
  misc_feature (331)..(331): n is a, c, g, or t
  misc_feature (381)..(381): n is a, c, g, or t
  misc_feature (434)..(434): n is a, c, g, or t
  misc_feature (457)..(457): n is a, c, g, or t
  misc_feature (480)..(480): n is a, c, g, or t
  misc_feature (487)..(487): n is a, c, g, or t
  misc_feature (507)..(507): n is a, c, g, or t
  misc_feature (519)..(519): n is a, c, g, or t
  misc_feature (542)..(542): n is a, c, g, or t
  misc_feature (552)..(552): n is a, c, g, or t
  misc_feature (554)..(554): n is a, c, g, or t
  misc_feature (561)..(561): n is a, c, g, or t
  misc_feature (567)..(567): n is a, c, g, or t
  misc_feature (580)..(580): n is a, c, g, or t
  misc_feature (589)..(589): n is a, c, g, or t
  misc_feature (600)..(600): n is a, c, g, or t
  misc_feature (602)..(602): n is a, c, g, or t
  misc_feature (607)..(607): n is a, c, g, or t
  misc_feature (628)..(628): n is a, c, g, or t
  misc_feature (649)..(649): n is a, c, g, or t
  misc_feature (660)..(660): n is a, c, g, or t
  misc_feature (666)..(666): n is a, c, g, or t
  misc_feature (678)..(678): n is a, c, g, or t
ataatggntttcccattaaccttccgcattagcacaccaaaagtcccttcagcccggatatattgggcaccccggcctggntcattttccacnttnttnaanagggtccccanaggcananccccaaaaggatgcgcatccccttcccgagcagcaacttcnattcggcctatntggttaaagtanaaaattttntttccagcnttnatttttttttttgcgatgatccancttttccgcgcttcccccaccaaccaaaanaattttttctgacctaaaggnataanagcggacttggataaccttntcctcaaagggtcctgatttggtntcctcaggccggaaacgcagaaagtaaataattcgataacgttgcttgtngcccccgccaataccatgcacccggattcggcctgttttgtctcggcccccanatttcctcatcttcactggtgtnatggtgttcttggtacgactttnccagganaaaaagttggcattaagggncacaaaagtaanaactggggcggcaggggagcaanaacaaggcananggctgtnggaggnggccatttttcancatctgggnggggggggaananactcnggggcaggggcggcgacggtngggggcgccaagttcaaaaancccaaacccgnggttanttcccacagggncc

SEQ ID NO: 703523 - DNA, 679 bp, Homo sapiens
  misc_feature (73)..(73): n is a, c, g, or t
  misc_feature (92)..(92): n is a, c, g, or t
  misc_feature (114)..(114): n is a, c, g, or t
  misc_feature (123)..(123): n is a, c, g, or t
  misc_feature (128)..(128): n is a, c, g, or t
  misc_feature (135)..(135): n is a, c, g, or t
  misc_feature (145)..(145): n is a, c, g, or t
  misc_feature (148)..(148): n is a, c, g, or t
  misc_feature (178)..(178): n is a, c, g, or t
  misc_feature (263)..(263): n is a, c, g, or t
cttatatatatgttgaaagtcacccataaagtaaaatctgaaaatatcaagaaaaaaactcatcacatacaangaagctgcattaatacaantagtggcagattgtcatttganacaatgtangccanaaggcantgaagacatnaanagtgctgaaagaaaaaaaaaaatctgtcanctaacaattttatatccagcaaaatctgcttttaaaatggtgaaataaagtcctgtcttacaagaaatactgaagaaatttattnaggctaataggaaataacaccagatggtaactcaaaaagcagaaatggtaaatgtgtgagttaacataaaaagactttaatagttttcctaatttctcttttcaatgtctttaaaagatatagcattgtgaaaaagcaataattatgatgatatatagttgggtttaaaaaatatggatgtaataatgtgacaagaacagtacagagaagaaagaattccattatattggagcaaagttgctatattttaccagaaataagtattaatctaaagtaaatcatgatagttaagatatattataatacctggatcaccacaaagaaaataagtagtaaaaatagcaaaatattgagtatcaatccaatcatattaatacctatatttgatgccaatgatctagcaatccaaacaaaaa

SEQ ID NO: 703524 - DNA, 1027 bp, Homo sapiens
gcgccagtggtggcgcaacggctctcgtccccgccctcctgctacctgtagtcgcctgggcctgccccggcccagccctgaccttgctgccaacctgcgctgtaccagactgaggggtcaggcggagagccagggaccgcgcccttcgtgtcagcttctctccctttcaccctgcgcctcctcgctgagaccctggtggctggtgcctgtgcccgtacgccgctgcagcagtgactgggagcggatgccactggaataactgcctggaccggactggtagtggcttggctgtgccctgccatgtgtgcgctggagtgtgcggcgcgtgtgcaggtggccacctgctggaccttctctcagacttcactttctcgctcacgcacggactccaacagtcctggagccctggcggagccctggaccttggcgcgcggagacgctgcctccacggaccgggccacaccagaaacacacaccgtcggcagtcgaccaacacagactacagtccataccttggataccaggaaatgggctacgtatcctccagtgcacttgtaactgacttggacacggaattactaagaaactcacttcatgtcactcatcaccaagatcgacgccggacaggatgaccaatctcggctactatagggcttaactgccagctccttctggactctgtactgactattggggggcaccaatggaccacaagtgggaattggcacgacattcctgtgtgaccctcaatcattacaagcacgcgaagtcagacaaataccagttgacacaagactacttaaggctggcttcttgaaactgggaaccgagggcgaaacacgtcaacaaaagggcaatctaatcataaacggataaacccgtaagcaacaccagtgtgacgacaggcatccagcagattggggtattcacgggaaggcacatgcgtttccccgaatcaatcttgaagcttgacagcacattcttcagaaacaacaggatgaggtatcatcatgttcaaaccggaagg

SEQ ID NO: 703525 - DNA, 1224 bp, Homo sapiens
gagacgttcttcgccgagagtcgtcggggtttcctgcttcaacagtgcttggacggaacccggcgctcgttccccaccccggccggccgcccatagccagcacctccgatcacctcttcacacgcacccatcggactgcacccaaggacccccgaccgaccgatccagcgccgcgcagacaccgccgacgaccgaccgccctctccttagtcgccgcacatgacgaccgcagtccaccatcgcaggtgccgccagaactacacaccaggacctcaagacggccagccatcaacccgccagatcaccctggacgctctacgcctcactacgttatcccctagtccatgctctatacctactttcgcaccgcgactgaatgtggcactttgaacgaacttaggcacaaaatactgtacttcaccaatctccatgacggcagagggaacatgctgagaaaacctcgatgaagctgacagaacccaacggacgtggccggcactcttcctttcacggatactcaccacaccccagactgtgactgacctgggagacgcgggcctgactgcaactgcacagtgagcataacatttgcgacaacaccatgtgcacttcaagacactacttggaaacttggcaccaaactggaccactggacacacaaatgaccccacataaggtgtacccttccttgagcacacaatcaccttgacatgcagcaggcgtgaacagccaatccaagaatggcggtgacacgtagaacaaactggcagccaccgcaatgggcacgcgcccgacaattagtgatatggcaggaaaattacttcctatggaccaagcgcacacctggagaacaactagtggaattactggaaaggttaacattcagggcaatatcacacattagtcgtgggcagaattcccggtgaccccagggccggtcaggcaacggttggagggatcccgcaacgagctacacaaaaggggaacaaagacatcacgactaggtccaggcggatggaacacgccagaacaaagacacatggactccccgacactaggaacaaccaagagcggaagcagcgaccacacactacacaagggacgggcgacaagactgaagtaaggcagaagcgaagggctaacacacagggcggaaacagtggacacaacgaacgcgcaaacgaccgaagcagagcaagccgccgccactcagcacgcccaaag

SEQ ID NO: 703526 - DNA, 314 bp, Homo sapiens
gggcgaacgcgcgctatgggctgaacacaggagacgtgaacaccgtggtgcaggctgccttgtcgggctcgcaggccaccaccatcctggaaggtgatcggcagtttgccctgacggtgcggctggccccggagtaccgcgccactatcgatgcggtgcgcaacatccgcgtcgcctacacaaacgctaacggcggcaactcatacattccgctatcggccctggctgatatcacgctggatacgggtgcgtcgtacatctatcacgaaaagaatgcccgctatattccggtcaagttcagcgcacctccgcct

SEQ ID NO: 703527 - DNA, 169 bp, Homo sapiens
gtaggtgaagctggacagtccaatatttgccccacaaccattagcttatgcagctaggattaaaaggtgctcaggaacggatagatagcttcgtcgaactagggtgatccatgaaaaacagacagctgtgtcagtagaaacttcattgcagaattgctgcctgacaaat

SEQ ID NO: 703528 - DNA, 913 bp, Homo sapiens
agattgacctggacacgctggatggctgtcctgagagcgcgacacactgggtcatcgtgaggtgcggctgtacaatgccgttgtccagcgtggatccgaggccgagtgtagcggtagcagctgcaggtgacgccagagaacaggcggaaggttctagggcaaggccctgggcctcattcgcttcccggtcatgaccatcgagggagttcgctgcagtgtcccagctaacagagtacggagcataccctgggtagggaccgcgagggtggtcacgcgctctatcgctgcacgttcaccgtcagacctccaatgaccatcgacatggagttcattgaccggcgcccgctgccatggctgcgtgggaaggagtgcaggcatcaaaccggcttccagcaggtggagagtcgctggaggctacagcgggaccaggtgaccgcatcaggtgctcagtcaacaagcgcatcttcgtggtgggatttagggctgtaatggatccgtccacgggcccaccgactaccaagtgaacatccagatgattgcacaccgatagcaacagcgtcttgagccataacgagactggacttcagacttagcagacgtggtcaggccgaacaccttccggcgatcgatgcttcaaaggaggcccgtgtgcgagtgtgcttgcctccaaacgttcaatctatcatcggggcctgtggacacacccgccttcaaggtgctcgataaatcccacctacgggcacctagagggcactgtgacaagggtgacccacacggagtcggccgacacatggttggccaaagacactgcttcaaccttatgctacgcggctggaaccaacagtgggacattcgttcgaggacaggcagaatccccgaagatcatcttcataaccggaaggttgcccgaacc

SEQ ID NO: 703529 - DNA, 490 bp, Homo sapiens
  misc_feature (350)..(350): n is a, c, g, or t
  misc_feature (456)..(456): n is a, c, g, or t
ggcggggataacaggcgtgagccaccacgtcgggctcaagacactcttatcatttaatctgaaagacgggctcaggtcatgacgggaacatggggagtgggacatgccccattatacctctccagcattaacatcaacacggactttaagtctgaggagaaacattttacaccttattctctctcaggcctacaaccggaaggcttcctcggcaaataggaacttggatctccacagttctttctcctaaccccgccattcatttctatggatcccaggtctttagataaactcaaccaatggtcaaccagaaaaaatttaaatctacctataatctgggaagacccggntttgaggtgtcccacctttctgggaccaaaccgttatatttcctaaatgtatttgattgacgtctgatgcctccctgaaatgtgtaaaaccaaagtggacctcgancaacgtgggcacgtgttctcaggatctcatgagg

SEQ ID NO: 703530 - DNA, 478 bp, Homo sapiens
tgactgttttatttgctggactggtgccttttattagattcaggggttgtgcatgtctggttaccacaaaatattttgcattagacggtctggccggagggaggtggacaaactgagtttgaatgtcacctaacccctttggttgcagaggatccttgcacctcgcgcttacagtgagtgggagttactgggttgccttatagcccccttgtgaggaaagaattttttttcaaaaaccggctctctttttgttgcccaggcgggtctaaactgggtgggtgaaagcctttgtgcttgctgcacctccaaaagtggttgaatgtttgggggggacccccctgcgagcttggaaagtatattcttagggggaaaaaacctttggtgtcagctgaggagataacaccttatgcttttattccaacctgaaagagtttttggatacccaattttttttgcaaggggcaggggaagaaagtcc

SEQ ID NO: 703531 - DNA, 1086 bp, Homo sapiens
  misc_feature (1)..(1): n is a, c, g, or t
  misc_feature (108)..(108): n is a, c, g, or t
  misc_feature (171)..(171): n is a, c, g, or t
  misc_feature (274)..(274): n is a, c, g, or t
  misc_feature (277)..(277): n is a, c, g, or t
  misc_feature (310)..(310): n is a, c, g, or t
  misc_feature (637)..(637): n is a, c, g, or t
  misc_feature (700)..(700): n is a, c, g, or t
  misc_feature (716)..(716): n is a, c, g, or t
  misc_feature (749)..(749): n is a, c, g, or t
  misc_feature (827)..(827): n is a, c, g, or t
  misc_feature (837)..(837): n is a, c, g, or t
  misc_feature (842)..(842): n is a, c, g, or t
  misc_feature (866)..(866): n is a, c, g, or t
  misc_feature (908)..(908): n is a, c, g, or t
  misc_feature (915)..(915): n is a, c, g, or t
  misc_feature (925)..(925): n is a, c, g, or t
  misc_feature (929)..(929): n is a, c, g, or t
  misc_feature (932)..(932): n is a, c, g, or t
  misc_feature (964)..(964): n is a, c, g, or t
  misc_feature (969)..(969): n is a, c, g, or t
  misc_feature (973)..(973): n is a, c, g, or t
  misc_feature (986)..(986): n is a, c, g, or t
  misc_feature (991)..(991): n is a, c, g, or t
  misc_feature (996)..(996): n is a, c, g, or t
  misc_feature (1079)..(1079): n is a, c, g, or t
nggcctgccagtgtccccctccctcttggtgacccccccatctggagtgaaggctccaagcagctagtgacagaggagggtgcctggctccagcagcctgggcttggnggcgactcccccaaaaacacccctgcggggtgggtgcctgggggcctaggtgaggctggggtnggagcggctggtagcactgcctcgcttttgcaggcagcgcacagcactggggacctgcaggcctgtggtcacctggaagctgccacaccataccgtgaaagcnggnagcggcggctgtgtgaacctggtcttgaaagtntgcggcccttgtttggtgcgggcgttgtagagggacaggggggctgcggccaatggtggaggtgcaggcaccaggggggggccgttttgcccagtggctcgaagcggcccaggctgcggtaggccacgcccacgccgaacgcctggctgtccggctcgtagcgcacctcccagttatgctccccgccgtcgatcagcgtgtgctccagaactgtgtgggacttagcggtgaagcggtcccgtcccccacgacctgagggcatcctcttgggagagggagtccctctggctggggagtggatgggagaggccgtccgcgcctggccanctttctcgcgagccttgaaatcctgcaccttcccgcccatagcgtcccacttcacggagagancatccacccgcaggtnctggtgggatgtggacgcatccaggcggaacangaacgctggtgttttcagagttaccggctcagagaactcttctgcaactgccttgttacaggccttcacacggaagtncatgtatttnatgtnaaacttgagacctgtcagggtgtnctctgtttgccgggatgccctcgatgaccatccagggctggncctcctngaggcggggngggnccncgaagttggtccgccggtacttcagcccgtgngttcnaatnttgctgttctcanccggnatgcncaaaccagggtaaaaagttatttccaacagggactaagcaaggccgatcacgggtccccgggcacaggagggacttgagttcntgttgcc

SEQ ID NO: 703532 - DNA, 97 bp, Homo sapiens
aagaaataccctagacttgtaatttataaatacaagaaggttaattagctcacagttttgcaggctagcaggagcatagtgccgcatcttctcagct

SEQ ID NO: 703533 - DNA, 154 bp, Homo sapiens
tcagagcgttgcaacgaaatcctatatccggtttcctgtaatttaattgaagaaaaatacatccaggataaagagctttattattaacagaccagatagcatcagaaatcaggtgagctgttcctagttttagaagtgtcaatagcaggggtac

SEQ ID NO: 703534 - DNA, 1311 bp, Homo sapiens
  misc_feature (201)..(201): n is a, c, g, or t
  misc_feature (392)..(392): n is a, c, g, or t
  misc_feature (568)..(568): n is a, c, g, or t
  misc_feature (678)..(678): n is a, c, g, or t
cagcagcagctgccgagacggccacccggttgtggtcaacctcctcattgggaggacggacttccgcgagtggctccattgctgtactagggccttgtgggtcaggacgcttggctgccttcctgcccctggcactgtgtccatgcatggtttggagtctcatcattgctctgccctgggccgtatcccatgaggcccatntgacgtccgacgaaccgtccctgtagagtagggtgatggagagcggtcaaaatctctagaagaggcgtctccttgtgagctcttggaccctccttcttcacggacccagctggttgcctgtattggtaccgccgtcatctttatggagcactagaattaataccaccctctgggcccattgtcagtgcccnaagttactccatgcatacataatagacatacagacaatagattagatagaagccagatcatagataagtacacacgaggggagcgccggcgcaaaagctagatccgtcgcccagggatgcgcgccctagaagcccttgcgcacgaggccacgcacagttttgcttccttgacgtcnaggggatcgcgctcgccaaacgtggcggtgtgcgcgagtccttgtggccaaccaggagcccgaggaccgtctttgttctccaaacaaactggagagaggaggaggtgcancatgcaggggggtggctacacgtgggcgtgggacccttgttgagtggggcgggctgctggcaccaatttcggggggagcgggggggggcgtccctggttttatttggggctggcctattttccttctcaccccacggttaactttattggggacggcccgctctagggtgcgcacaccatttttcccatccctcttccactggtgggcctctctccgtgtgtgtgtaacccccacaacactgccacggtttataaatgcaacggcccttggtaagagcaggtggatcaaacactgctgcgcagccttcacagcgcaacaggggctcccatgggcaactcacatgggggacgataaccactttttccttaacggcccctggggcggtacacacacctgtcgtggtgtgtatatatcacaaggacgtcttcttcccccgtatatactgtgggccctcccagtcaagaacaccaaaaagagccaaggttaagtgtaaccccaacccccttgtgaggtaaaccacattttaatgtgaccccagggaacacacttttaagcccaacagggcttaccctccaacaaagtttatacattaaacgttcctggggttctgtaaccgttccacagggttccca

SEQ ID NO: 703535 - DNA, 1186 bp, Homo sapiens
ttacataatgtatacacccaaagatattttatgtactagactccagattaccctttcttaataaatatctccagggtcaaggcacaagaacagcaaactgtataagcatcatcatttacaacatcagcagcaatacttatccaagccaatacatgatcaacttttcctaaaagactctaaaagcaacacacagcattcttgtaaactctcttttcagcaccgaaaattatggtttcatctatgctggcatattttatatgaacagtgttaatttagatgcactaaagcaaaggtaggcaaactacaaccatgagtcaaacatggccacacccattcatgtgcatattgtctaagctggtttcgcactacaactgcagagttgcatcgatgcagcagatcctttacagaaaaagtatatcatgagctcaagttataaagtaattgtaagtagggagctggaggacatatactgattcgccttttatggtaaattaaataggagctaccaaaaggcaggcatttgcagaacatgggatgaaaggggataaatgctttaataaaaaataaaatgctataattattaaggaaaaataagaagaatattagaagagaccaaggttaaccaaaggtaaatatcagtgaaaaagcatggataagtgattaagtgccagcggagaattcattgaaatgtcaaaatgggataacaagacatgaacagtattataagaacgaaaaacgagattagcatgagaactcaactaggaagtacttacactaaaggcatcctgcacaacagggagccagaaataatagccaaatgtagatactcttgaatacacaaagaggatacacaatagtaatacaacaaaacagagtaggaaatacaggcatacatatgaaacaaaaaagccacaaacagtgacacacaactacaaaacataatacgacaatgaaacagaactgaacacaaaacacagaacaatcagcaaaggcaagaagcgcacaccaagaaacgacaggcagagcggagaagggacacacaaacgagagtagtaaccacaaagccaaacaacaagcagaatgaaccaaaacagaagagtgacgagaccaccaaagcgcacaacgaacacaaccagccacgaagcacaaaccaagatagccacagcagacaacagaaaaacacgag

SEQ ID NO: 703536 - DNA, 1316 bp, Homo sapiens
ccacgcgtcggctccccctcccaaagtcccctccccggaagcggagcgcacctagggtaccctacttccgtccccccaccccagctacccgttcagaccaagcagcactacggcgggagcacccccgcacgtacagccaagcctcccatacaccgcgtcgagaccctggcgagggttaaccgcgcgagaccgagtgaaatacgtactatccagaattgccatggcgaggaccatctacgccacctctctcgccaactcagtcgttgactaccttgcatcgcaaactcctggaagtgtcctcggtcgtcgatgtcgctccggaactttacacggcgaagagacgaggatccatagtatggcactgctgacgagcttcacctggccccggtactactcatgcgaccctatcatagcaaccaaatattacaaaattccctcaaccattcattactataccatcggggtgctagttgacaggcagtgcgaacataccgagtaagcccctggcatacgcatacaactccatccgagaacactggagctatccagttcacaattaacacgaaaacgagattcaaaacaaaggctaacgcctcgtacccgaagtaggccgcgaacacccaaaatacgaagaaagcggagtatccagagcactgttgggcaccgataccccataggggacgcgataaccaccctcgcaatgtacccaatatgctttggagcagtatcaccgtcaatgggaccccccaagcagtacgacgaggagaccagtgatccggccgcaccgccatccaatggcgaatcgacacccagatcaatggcgaaccccctaccatcccgaaacacgataccccggtggcacagctccaacgcatgagccacaacaaacatagggcccgaagaaggcatgcgctcccaacgaggttgcaaggcacaaggtacacggatgacgaaacgcaacagaaacacccccaagtacaaccccaagacacaaccaaaccattggcatataagcacagcagaagagcccagcaatacaaaaccaacaaaagcaaaccataacacatccaaacaaaccaaggcagatctgggaacgacttaacccacaaccccgcacgggtgcaacgcacgctcgaacacataccaatacccagacaaaggacaaccaaacgcaccggcagatccaacaaaacacgcacatgagaagactagcgacatatatcaacaataacgccaataaaaaatacagccctcaaagttcgccaaaaaacgggacgaacaaagacacagcagacaaagcacaggataagagcact

SEQ ID NO: 703537 - DNA, 1503 bp, Homo sapiens
  misc_feature (259)..(259): n is a, c, g, or t
  misc_feature (403)..(403): n is a, c, g, or t
  misc_feature (631)..(631): n is a, c, g, or t
  misc_feature (719)..(719): n is a, c, g, or t
  misc_feature (1261)..(1261): n is a, c, g, or t
gctcgagtcttagcttgtgggggcactcgtagatctgcgtgacccgtgtgtctgctcctgtctgaccttcgtgctcctatttctctagccctactatgccgttagtgcatctccagtccaccgttaggccagggtctgagtgtccagcattttggtcaagtgcctgcttgggagactctagctgacctgggaacagctggattccacgcccgatttgccaggactgccaatgtgatcataggacctcactgtggggganggatgagtgagctccgttcagcaggcttcttcagtttgacgcaggcgcgccgcatgagccatgcatggttgccccctgggacttgctggtaaggtacaatctgttgggaaccctcaatatgtctagtcgaatggaagagtctcngcgatcttgggaggaccccataactcggcgctatgacgtaccattcgcaaccccattgatgccgattgtattcaatccaacaagcgccaccaggaatatggaatgcgtcgcactacattgaactgatatcgcacggagtggcgaatttacaaacgcatatgtccgggcgaaggcatgctactgatccgcacactttggtatgtttggcgaccctgtagattacggttnaaggctggcgcattgcattcgagtagcagccccaggttctgttccaagccgggttgtactatagggtgtttctccaagcgagggcctnatttggtttgacggcgggacatcctagcgctctacctggggggtctatcaacgcattcacctcattggctgtcaaggttgtggaccccagatccgtcgtcaattcgatgtgaccctccaagtgggctgagagatagaggtccgcaagggccaatagggaacggtatcctttcccaaactctttacccccgaaggggaaaccccaccaaggagggtttttcccagcgaaagccgtaggtagaggtattggagagcccggcctaattggaattttcccaggttccttttcaacacgatcaccaattagggctaggccttcgttgtggagagccccaacttcccttggtagtctctgtgtggcccctttttctagtagggggttaagaaacgcaccttggaagagggccgagtcctttgttggaccctattcctttggttcccgttaagggaatagccctttcggaggtaatcccggaatggccgggcgcgaccgaagacccttagtcgaaagttaaaagcccttgttacacgccaggccgcttntatgttagggcgccacgaatgtagagtggtgcctttcccaagttggaccttgcggtatatcccgcctttgtaccgaatgttgtggagtagagcaagggcccttggcaaaatggtcttggagccctctgagacaagagaacatcacacaaggaagcaaagacccttgggtttggcccctacattgcgcgccgggaatttccactctgtgtcctgcgtctttgggggccagcataatatatacc

SEQ ID NO: 703538 - DNA, 383 bp, Homo sapiens
aagctttgctcagcagatgatcctacaactgcgacactatcatgcgcgctcgctactagataagtcactcgacagtgctatattgactgacgtacgatcgacatcgttggactatccagagtcattgaagatatgtatggagtgatttcatctgaagaatgacatatcttttatggatcggacacattggtacagagactaccggatacgacgacagactgataattaggagccttcgatactactacgacgtatcgataccagtcagtcatcaggacaacgagctgcgacgttggtcgcttgcatgtctgcctatgtgtctcatcaaggcaccggtacggcaccgcagtatcaccgatattggagtacaggacttaatcacg

SEQ ID NO: 703539 - DNA, 133 bp, Homo sapiens
gtctggaacaggtgtctcgtggctctgcgctcgcggcggcggcaggaacagagggagaaccacagcagtggaggacgcctggggatctggggtgctagagagtgtgggacggggggtacaacagagaagagag

SEQ ID NO: 703540 - DNA, 148 bp, Homo sapiens
gctcgacttaacataatggcctccactcctatcgatgttaagtgaaataacccaggcacagaaaggcaaatatcacatgtttttactcatgtgtgggagctaaaaaagtggatcccatggaggtagagaatagcatgagaggtcgacg

SEQ ID NO: 703541 - DNA, 1072 bp, Homo sapiens
  misc_feature (1072)..(1072): n is a, c, g, or t
ggggtctgtctctttgagggtcctgctagtcgcgggggcggggggcgtctgcgggctgcgaggttaacccagcgaggatgccccggttctgcaggaagctgaagtgagagcgcccgcgagatgtggcccagcgcctgaccgtgggcacggagtgaccaattgcccgtgcatgttccggttgttggctggtgcaaggggatctggcagttgcatgaatcctgctgatcatcgtagtactggggacaggcgcaggggccagctgcatattactagctatgcaacaaagatccatttctcttatgtgcgcgcgggcactgtgtggctcggagtgctttgacacaccagcctccgggggggccctgaggatcaagcgtgaccatgcggaaggactcaacgaggccgggacctacgtgagtgtccggaccgaggtttactggacaccgaagtgtattctccacggtagcattggtcgttgaaatgccatgagacggacacttatacggcgatggaaacatcgggacgaaccggggaaggcaatgagccctggcactttggcgcctcggagggacagaggcacttagtgcagggcatgaaggtcaggtggaagaaagggccttaacaggaacgtttgagttccgccatcgcgcggccgaaacagggccccggggtgcccggtcaagcacccaaagaaacacaagtggggcccggtgctacagcatagcgccaggacatgccggaacgcaggaagtgccagtttgacattagagtagagggcggacatttgacgtaaggccagccccagaagacgttaccgccaaagtcacttggagcgccatttcgccccaactaaccaagaggggaatcgccgggcggctatgtttcaggaggagaaaaacgattcaccccggcgaagagttttcaggcagagcggacactaggaaagacaccgacaggtccgtagaaaatcctggttggaggcaaccgagaagcctagtgatcaatcactgagaggacacacacattcatgtacactgtagcatatcactggtaggcagaccaacaggtgtttggn

SEQ ID NO: 703542 - DNA, 389 bp, Homo sapiens
tgtgcgcgtgcgtagctgtatccagcatttagaagcgagccgttggatcactgagtcagagttcaagaacaactggcaacatggcaaaaccccgtctctactaaaaatacaaaaattagggcagatgcgctggctctcaactttcccgacactttgggaggtcaaaacggtcggatcaattgaggtcaggagtttgagaacagcctggccagcatggtgaaaccctggttgtctctactaaaaatacaaaaattagctggacatagtggggatgcctataattccagctatttgggatgctgaggctggagaatcgcttgaaccctggaggcagaggtagcagtgagccgagaccatgccattgcactccagcctgggtgacaagagag

SEQ ID NO: 703543 - DNA, 124 bp, Homo sapiens
cacaggttgacatggctggtagatgcggagaaatggccgacatcctcctttagactcaaagttggggatgccgtccaagagcgagtgaccggacaagagcgagtgacagggggtaccgagctcg

SEQ ID NO: 703544 - DNA, 176 bp, Homo sapiens
  misc_feature (158)..(158): n is a, c, g, or t
gccaagaagctagaaagaattagaagacagatgagtcagaatggaagagacggggttttgccatgtttcccaggctggtcttgaactcctgggctcaagtgatccaccagcctcagcctcccaaagtgctgaaattacaggcatgagcaccctcaccntggcctgagtgctgaaaa

SEQ ID NO: 703545 - DNA, 333 bp, Homo sapiens
gagaaggagtttcgctcttgtcacccaggctggagtgcaatggtgcgggctcggctcactgcaacctctgcctcccccgggttcaagggattctcctgcctcagcctcctgaggagctgggattacaggcacccgccacacacccagctaattttctatttccagtagagatggggtttcaccatgttggccaggctggttttgaactcctgacctcagttgatctgcctgcctcggcctcccaaagtgctgggattacaggcgtgagccattggcacacagccttatctgcattttcaaacgggccagtatggatgggttttacacttatac

SEQ ID NO: 703546 - DNA, 155 bp, Homo sapiens
taataggcgggtgcaagagaggggagggtgatcaggacaccagcacaggcttcagcatggcagagagcgaggtttcatgacattgaatccaggattgcagccctgagggccgcaggggatcaacggtgaagccctacgggaaagccccggaggaa

SEQ ID NO: 703547 - DNA, 314 bp, Homo sapiens
agatagtatgaaagtagcaaagcccagcaaaggttaaagctgaaagtgcgaaaagccctgcttgggaggtttctgcaaggattccccatgaaacatagtcagttaacaacttgtccaaggcccaatgctgtctcggagacaagtgtatgtgctgcactccacaccattctgggataggtcggtcctgaagaaatgctgagatatgagcaggtctgaccactggagttcgaagcaccagagctcgggctcctagggcacctgaaacggcactcagcctcgagagaaccgccatctcgtacccagcttgttcagat

SEQ ID NO: 703548 - DNA, 322 bp, Homo sapiens
tgacctacttgtaaattactgttctcctgtttgtttactgtgtgcaccgaggtcggatcctgcctcttttgctggaggctgcctctgtcctctgctgtgttggtcaggaagctcggaacgtctcagggccatattcatgttagtcatagtgagtacgctctgtgcatgcctcggtgtgcagcgctgatctgcaagtcagactccccacccctcctttgtgcgagctgggcgggggctctgccgggactggtggtgttcatggagagggcttctgtgtgatgaagagatgacagtgacctgctggggccgaaggctgtgagtg

SEQ ID NO: 703549 - DNA, 326 bp, Homo sapiens
tagcctgggcaacagagtgagactctatctcaaaaaaataaataaaataaaataaaatcagtgtagagccatatacatctccccaccaagtgtcctccagaagcagtagcctagataggatgggaacccggatgtgtccacatctgggtcttgtgggtctcacaaagagaagcccgtgttacgggcttgaacatccttcagggggccaggggccatatgatatcccgcgtgtaatagggtcccatcttcatgcgcggagtaaagtcagggtatatattccatccaaggaccaattaaaagaacaccagtgtgttcaagacacagaa

SEQ ID NO: 703550 - DNA, 643 bp, Homo sapiens
caataaaaggtttctccaacttgaaaaaaaaaaaaaaaaaaaaaaaaaaaaaaagaaaaaaaaaaaaaaaaaaaaaaaaaaaaaccaaaaaaaaaaaaaaaaaaaaaaaaaaaaaccttgtggcccgcttggcccaagcggattttagattgggccaggtttaggcttggggccgaatttggggttaattgggcaatttccccttatggggggccgtttaacatttaatggcccgcggtttaacaccgtgggaatgggaaaaccctgggggttcccaatttaaatcgcttggaagaaaatccccttttcccaagtgggggaaataccaaaggggccggaccggatggcctttccaaacggtggccaaccctaaagggcaaaggaaattggaaggcggaaatatttggtaaaaattcgggtaaaattttggtaaaatcggttattttttaacccaatgggccaaattgggaaaaaccctttataattaaaaggattcccccgaaaagggtttgagggtggtcccagttggaaccaggagccccttttaaaagacggggacttcaaaggtaagaggccgcccgtttttaagggcaagggccaattagggggacctttccccttggtttttggggttcgggcccct

SEQ ID NO: 703551 - DNA, 835 bp, Homo sapiens
tgtgagttggggattgttgcgtcccatatctggagccagaagggacttccctgctcggtggctctcggttctctgctttcctccggagaaataacaggtcttccgtgcgcgcatggagcctcccggccgccgagagtgtcccttgccttcctgcggctttcctgggtgggcttctggcggccatggtgtagctgctgtactccttctccgatgcctgtggaggagccaccaaaatttggaagctatggagctcatttggtaaaaccaaaaccttattatgagattgggtgaaccgaggtagatccatacgtgtcacacacaaggattcacttctatataccttcttcttgtgcaccgcatacaatttgtagatcggactcatcacatggttaccgtgtctcagatgacggccttgttataagagaaacatgtccaatatatacgggcatcctttaaagtgggcaagcagtccctgcaaatggacttaccagagttgggttatcagattgcccttaattgtactggaggggtcatcacatcaatggtcgaagacaatcctataatgtgtggacctttaagcgcaatcaagacagcaatttgaggcggaaagcccccattatagtgcacacggttggtgtaccaccacttcaaacattcaacaatggaaccacacctttagtggaagtaaaaggatgggcactctggggcaggaccttatagtgtggatccgtgaactggacagatcatttgcattcatggagagaggcgcatcacgcggggccaaccaggggagcggcggccaagatgaagggcacaggcatccgaacgggaagga

SEQ ID NO: 703552 - DNA, 305 bp, Homo sapiens
  misc_feature (24)..(24): n is a, c, g, or t
cctcgcatttggacacgaggttgnaatttcgtaactcctgggcaccctggctactgccctctcctaggccctgcattaccctcttcctccatttagcacttggcccatgtctcttacatctccttacccagtttttacagggccgtgttagagccttcacccatggaacagtacaagacatgatgctactccgagaataccgacagctccagggaacagcagtccctacttacccagccttcttccccccaaccattcgcccctattccagcaagaaggcagccagagggacaacgggcggcccc

SEQ ID NO: 703553 - DNA, 1021 bp, Homo sapiens
cattgttgactcatgtgctatccattttctttcatgagatctcgagatgctcatacaccgattcacttaaaatagtgagggactacacagtgggtgagccaacagtctctagttagtctccgtctgcttagttctaaaattgttgcggtgtgtggtatgcgatcgatgctcttcgatgttcctgaaactcacgtgactctgactttctatggggttcccatatggactgcgagattagatgcgccgctcgagcaacctatgccacgcgtactggtaatactctttctatgagagcgcgcgagtactactgaattaatggcgcttgagttatcttaattagtaatagtctttcgatgcatatatactacgtaggtctaatgtctagaatgacgagttctgcccaaggtaccatcggctttgttttactatgtggcaagcccaattggtttccctgcttttcctgcattctagcctacagtctttgtcggtcggtgtcccgtctcccgcgtaaactacatctcgtcgccttcggatgcttgacctgtcctcagcttttcttcgatgtgggctgcctgatgtctcctttttagtagacggttcccttatatgctatcttgtggacaggtctggtggtcttgactgtgattgctggccttctggctgcgctgctctgttcgcacgagcccggagactgtctacccctggtgtgcacggtgactcccagtctctggtccaattcaacaatactagttcccaattcttgtgttccatccctcggtagaaagagagtgaaaaaacggttgtagggggccgacagaacatcaatttgttcaatataaccgaggcgcgtttgggactgtgaccacaaaaatgccgcgtcccaagagtgaaacatcttggggcgcaggaaaagagccagctaaatgacgtatgtgtgtcacaccatgggcgtgagccacactctagcaacgacgcacacagtagccaggagactatagttcactactcactccttcattta

SEQ ID NO: 703554 - DNA, 265 bp, Homo sapiens
actcgctaacaagctgcccagcgtttgaggaaatctgaaataggagtatctatgctagtgttggctagaggcggtgtccatcactacaggggcactacagtatgaactgggcacagcatgcggtaaaatactacagagatgtgcacactgggctatcattgatccaggtgactctgacatcattagaagcatgccagaacagactggtgaaaagtaaaccttttcacctacaaaatttcatctgcaacaatctgtcgatcataat

SEQ ID NO: 703555 - DNA, 167 bp, Homo sapiens
ctttttcgtccttttccccggttgctgcttgctgtgagtgtctctagggtgatacgtgggtgagaaaggtcctggtccgcgccagagcccagcgcgcctcgtcgccatgtccccgtacatcgttagaagcttgaattcgagcagtagtagtagtagtaggcggccgc

SEQ ID NO: 703556 - DNA, 370 bp, Homo sapiens
ctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaa

SEQ ID NO: 703557 - DNA, 422 bp, Homo sapiens
ctcctttccgacggggtggccagaggccactgggaccgaggccagtgcttctttgagattgctcctagcgataggcggcctagaatgtgagtgcaattgattggttccttagagccccgcagaagacacttcgtgactgtgtctgggctgccaatgacgcagtgtccctgtgatcatttctagggcaatgtgaagaaaacaagacaccaaaggcaccacatgaaagccacacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccaccccgtcgggtggag

SEQ ID NO: 703558 - DNA, 967 bp, Homo sapiens
  misc_feature (487)..(487): n is a, c, g, or t
  misc_feature (500)..(500): n is a, c, g, or t
  misc_feature (509)..(509): n is a, c, g, or t
  misc_feature (552)..(552): n is a, c, g, or t
  misc_feature (574)..(574): n is a, c, g, or t
  misc_feature (582)..(582): n is a, c, g, or t
  misc_feature (588)..(588): n is a, c, g, or t
  misc_feature (590)..(590): n is a, c, g, or t
  misc_feature (609)..(609): n is a, c, g, or t
ctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttncttccttggaganggagtctgnctcgggggctcatccgggagccaggggggcgatatcagctcantaccacctccgcctccggggtncaagcganggtccngnctcagcctcccgaggggcngggattacgggcccacttcaccacgccgggccaattttcggctttgtcgtcagagccggggttccctgcctgcctcagcctcccatagggctgggataacgggcatgagcctccgtgccggtgcatccctaatcttggagcatgatctcagcgggaaatgaggccatctgtttcaccctgttggaaactagcaggtcggggcgccaggtggcaatgccggggggtaacctcctggcggttgggcgcgggggcttccctcaaggccccacggtgcccggttcgttccctcgctgcgtgcggacgcacttgcctcccaggaaacttacccttgtccgcgtcgaggcgcgccgcggcccgc

SEQ ID NO: 703559 - DNA, 1515 bp, Homo sapiens
ctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaaaaaaaaaaaaaaaaaaaaaaaaaaaaaaaaaaaaaaaaaaaaaaaaaaaaaaaaaaaaacaaagaacaaaaaaaaaaaaaaaaaaaaaacaaacaaaaaagaaaaaaacaacaacaaaaaaagaaacagagaggcggaggcgcggagggcaacgcacaaacgacacaaaaacgaggcagccgaagccatatcgaagacaccaacgaacaaagtaagaacagagaggaagggcagacatacaacaagagagagaaggcagaaaagagcagaaaggaaagaacaccgaaagaagagaagagaaaacaaccagggaaaaagagaaaaaagggacagagagcgccgacgagaagcaaaaacaacacaaagaagaaacaagaacacaacaacgtacagagcaagagacacaagagcaaagacgagaagagagcacgcgacagaaagaaacaaaaaccaacagggacaaaaaagaaagagaaaaagacagaaagcgcgaaagaaacaagaaacaacgaaacagaaggagaagacagaaaaaacaaggccgaaggagagaacgaaagaagagagaaacagaaacaagaaacaacaagaagaccgccacgcgagcagaacacgcaaggcgacgaatcaagagagcaccagagagagaagagaaaaacaaaggaagaaggcaagatagagcaacacacgaaagaagcaagcgaggacagagaaacagacaagagaaaaaaacgaagaccgaaaggcaaggacgcacgcgggggaaaaggggaagatgcaacagaggaagagggaagaacgaacaaaggagacccgagacacgcgaagcggagggaagagcagagaccacagccggacagggcaaagggcacagcagagaggaccgcggagagagaacggagggaaacggacgagagcgaaaagaaagggggacgggaagaacaacagaaacggagaaaaagaaaagaaaaaaaaacgaaaagaacaagaggaaaaaagaaggaaaaaaacaacgagagaaaaaaagagaaaaaaacaagaaagaaggacaacaaagagaaaggaaaacagaagcagaaagaacaagagagacaagaacaagaaccacgacagacaagagagaagaacgaaacacaagggaaagg

SEQ ID NO: 703560 - DNA, 1415 bp, Homo sapiens
aaaaagggtggggggggggtaaaaatttatggggcccccccccaaaaaaaggaatttttttcttttgtgcagagtatacaagaaagaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaaaaaaaaaaaaaaaaaaaaaaaaaaaaaaaaaaaaaaaaaaaaaaaaaaaaaaaaaaaaacaaagaacaaaaaaaaaaaaaaaaaaaaaacaaacaaaaaagaaaaaaacaacaacaaaaaaagaaacagagaggcggaggcgcggagggcaacgcacaaacgacacaaaaacgaggcagccgaagccatatcgaagacaccaacgaacaaagtaagaacagagaggaagggcagacatacaacaagagagagaaggcagaaaagagcagaaaggaaagaacaccgaaagaagagaagagaaaacaaccagggaaaaagagaaaaaagggacagagagcgccgacgagaagcaaaaacaacacaaagaagaaacaagaacacaacaacgtacagagcaagagacacaagagcaaagacgagaagagagcacgcgacagaaagaaacaaaaaccaacagggacaaaaaagaaagagaaaaagacagaaagcgcgaaagaaacaagaaacaacgaaacagaaggagaagacagaaaaaacaaggccgaaggagagaacgaaagaagagagaaacagaaacaagaaacaacaagaagaccgccacgcgagcagaacacgcaaggcgacgaatcaagagagcaccagagagagaagagaaaaacaaaggaagaaggcaagatagagcaacacacgaaagaagcaagcgaggacagagaaacagacaagagaaaaaaacgaagaccgaaaggcaaggacgcacgcgggggaaaaggggaagatgcaacagaggaagagggaagaacgaacaaaggagacccgagacacgcgaagcggagggaagagcagagaccacagccggacagggcaaagggcacagcagagaggaccgcggagagagaacggagggaaacggacgagagcgaaaagaaagggggacgggaagaacaacagaaacggagaaaaagaaaagaaaaaaaaacgaaaagaacaagaggaaaaaagaaggaaaaaaacaacgagagaaaaaaagagaaaaaaacaagaaagaaggacaacaaagagaaaggaaaacagaagcagaaagaacaagagagacaagaacaagaaccacgacagacaagagagaagaacgaaacacaagggaaagg

SEQ ID NO: 703561 - DNA, 851 bp, Homo sapiens
  misc_feature (176)..(176): n is a, c, g, or t
  misc_feature (307)..(307): n is a, c, g, or t
  misc_feature (311)..(311): n is a, c, g, or t
  misc_feature (321)..(321): n is a, c, g, or t
  misc_feature (339)..(339): n is a, c, g, or t
  misc_feature (358)..(358): n is a, c, g, or t
  misc_feature (361)..(361): n is a, c, g, or t
  misc_feature (407)..(407): n is a, c, g, or t
  misc_feature (413)..(413): n is a, c, g, or t
  misc_feature (423)..(423): n is a, c, g, or t
  misc_feature (470)..(470): n is a, c, g, or t
  misc_feature (497)..(497): n is a, c, g, or t
  misc_feature (507)..(507): n is a, c, g, or t
  misc_feature (520)..(520): n is a, c, g, or t
  misc_feature (524)..(524): n is a, c, g, or t
  misc_feature (535)..(536): n is a, c, g, or t
  misc_feature (540)..(540): n is a, c, g, or t
  misc_feature (544)..(544): n is a, c, g, or t
  misc_feature (560)..(560): n is a, c, g, or t
  misc_feature (563)..(564): n is a, c, g, or t
  misc_feature (566)..(566): n is a, c, g, or t
  misc_feature (570)..(570): n is a, c, g, or t
  misc_feature (583)..(583): n is a, c, g, or t
  misc_feature (605)..(605): n is a, c, g, or t
gggatcggcgccagcggagtaggggctgcgcttggggtttgctgaagctggctgcctctcccactccccttttgggtgcaaagcgccgctagcgggaagacgggggccgggcggggacaggggcacctgcgtagctggactgagagcctgcgcccagcttacatcgaccccacccnggccccggcccgagccgacgcgacccgatccgatccgatcccattccatccgttcctcgtctcctcccgtctgacccgttgcccggccgtggttcgacacaccaggcatccaaagctgaggtcgctcctanggcntgggctcgcnttcgctttagagatgttnggcctcttccctcccaaanagnccatcttcaaaacctggactcttggactggcacctggcacctttcnctctancaagatccanttccgtcttacccacttcttcctcagattcttggtaccccctgggtnggagactgctcattttccttccaaatnaatcccagancccctaaaatatngacnaccttgacaanncccncaancgaggagccagacttngtnntnggantaacttccatagncctatcatggaggcagtgtacntggtagtgaatgggtaggagccatggtgctggacgtgctgaacatgagagataggacctacaacttcctgaaggagtactacactcacagagacattcccctgcgccatgtgcatcctgagacaacagacataacaaacatgacagcaacaaaagaaatgaataaacacatatttgcactatgggcagcgagagaaattgctaaaatagatggacctatgaagaaagacagagaacaaacaacaag

SEQ ID NO: 703562 - DNA, 411 bp, Homo sapiens
agctgcggaggtagaaaacaggctccctcctcccccgccaggagtggtatgtccccatcatcctcgttgttggactccagctcaacgtagaactcggagaagttggcgatggaggcgaacattagcgccatacactcacaggactgatagtagagctcatcattgcgccgctcgagggccaggaagtgagcggacacgtacttagaaaggatgttgtgcagcaagccggcggttgtaggcatgcaggatcctccatctcctctttctcctctgtggcctgagagaaaagcgactgcaagtcacccagatgccaatgtgagcccaagatatcggaccctccagctcctcctctccgtggcctggagaaaaagcaccagcatgaattcccttagaaccagcgcgaattccctt

SEQ ID NO: 703563 - DNA, 423 bp, Homo sapiens
  misc_feature (1)..(1): n is a, c, g, or t
  misc_feature (11)..(11): n is a, c, g, or t
  misc_feature (61)..(62): n is a, c, g, or t
  misc_feature (91)..(91): n is a, c, g, or t
  misc_feature (294)..(294): n is a, c, g, or t
  misc_feature (321)..(321): n is a, c, g, or t
  misc_feature (372)..(372): n is a, c, g, or t
  misc_feature (379)..(379): n is a, c, g, or t
  misc_feature (411)..(411): n is a, c, g, or t
nctcctgatantgtgtttactcgacctgccccgaatagttccacgcagaatcacaccatcnngttttaggttccatcaaaaatgaatgacngagaggccaggtgcagtggctcatgccagttaatcccagcacgttaggaggctgaggtaggagaattgcttgagcccaggaggcaaaggttgcagtgagctgagaatcaggcccctgcactccagcctgggtgacacagtgagacactgcctcaaacaatgaggagagtaaatggttacatgcatgctattgttatatgtacntgcccttatgttatcccataagggatnaatggcaacaggatctgttgcattattggaacagaatggaatattaagtgngggtaanacattgtttcagttattgaaacatttcctttntcataaatggta

SEQ ID NO: 703564 - DNA, 652 bp, Homo sapiens
gtgacgcgtgggtcgacccacgcgttcggtggcgtagacgaggttaagtcctggtctgcgtggaggtcgacgacgtccgtcgcacgactacggacctgtctgggtctcagccgccaaagaccccgatccggtaggtgagtaggctcactttgagggcgaagccttctcggactcgaggcttcttcatggccgcctcagatcgtgagactggcccggggcatgctctcatttgcggacggattggcgtctaatgacgcgcagttgattcgacgcgaagtactagccggacatcatgacgctggctgtcgggctattcatcgggagactaacatccagacggccaagggcacgaacggcccgctggacaccgaattctatcaagggactatgcgacggcatacacgcagactactcgactcttgacaaacgcacggccctttggccactcacgtggcacactccgagggactccaacgggaatcgccagcatgatcgctgcgacgtatcgacgctctgcacggcaaacagacactctgctagctgacaacgggtatacctatcggaacacaatcgctagtggctatcggtcacacgagcgtggacacgcaggttccacgcgaccgatcctctgacccgttttcacgtagtcgca

SEQ ID NO: 703565 - DNA, 394 bp, Homo sapiens
  misc_feature (18)..(18): n is a, c, g, or t
  misc_feature (109)..(109): n is a, c, g, or t
  misc_feature (130)..(130): n is a, c, g, or t
  misc_feature (210)..(210): n is a, c, g, or t
  misc_feature (319)..(319): n is a, c, g, or t
  misc_feature (387)..(387): n is a, c, g, or t
caagcaactcaactttgncttatagcatccatggcttttttctgccttccttggaacccacttcccagaatcactctgtgtggaccctgtggtgttattcaaggtttantagggctgggcgcggtggctnatgcctgtaatcccagcactttgggaggccaaggtgggcagatcacttgaggccaggagttcaagaccagcctagccaanaagatgaaacctcgtccctactaaaaatacaaaaattagctgggtgtggtggcacaagcacctgtaatcccagctactcaggaggttgaggaacgagaatcacttcagnccaggaggcagagctagtgagccaagatcatgccactgtattccagcctgggcaacagaccacctacnccatctc

SEQ ID NO: 703566 - DNA, 317 bp, Homo sapiens
cttttggggcctttgctcttttggagtttgctcaaattcgcgtaaaaaaaaattttcccacgaactggccatgtactatttctcgaggacttggaagcctgccctcaaatgctccagccaagacacaggggtataggcctgaaaaagagagacttacaacacccggaaatcggccaacggcccaatataaatccctttacacgtcagtacgaaactcccccattatattggaaaataaataaaggctttccataagtaagttcaagaaaacaaacatattgccagcctaacggagttttaccaaccagtcgctttcc

SEQ ID NO: 703567 - DNA, 435 bp, Homo sapiens
  misc_feature (27)..(27): n is a, c, g, or t
  misc_feature (421)..(421): n is a, c, g, or t
attgccatccatggctgggagtctgtnagggacagatagaaggggagttttgaggaagaatcacgtgatttggccattgatggccctgggtggccaggaaatgggaggagctggagatgtcaccacccgtgcctggtagaatggtgggtcaatgaacagccaaggaaaccacaggatgagagggctctggggaaagatgaagaatctcgatttgaacatctgagttgaagcccacagcttccttcagggacccttccaggtcactccccagcgtggggccttcatcttccctggactcacccacccaggacaaaactcagcgtttcaaagttcaaccccgcagaaagaccgagaatagaatgggaagccaactttctttcctcccccactccccatttctttctgttcatgattccagttnaaaattccaaggtc

SEQ ID NO: 703568 - DNA, 315 bp, Homo sapiens
gaactttgactaccataaaaaatttaaaacatacttaaaacaaacttattagggagaaaaaacacaagtagagagattaaggtttgcaagtactgaaagcacggcattccaggaggcagagtggacacagctctttatctgaggcatgtttagctgaaaaaaagtcattttttcctctttctactccttctctggaaattcacttcagatgagattctccggacaaattacacctggatctggagaatatgcctttaaaggtgtcagcaccacatgttcacaaactaccacctacctccctcaccaaagcccata

SEQ ID NO: 703569 - DNA, 439 bp, Homo sapiens
  misc_feature (273)..(273): n is a, c, g, or t
  misc_feature (291)..(291): n is a, c, g, or t
  misc_feature (349)..(349): n is a, c, g, or t
gaattctggatcctcagatggaagatcaaatgaatgaaatgaagcaagaagagaagtttagaaaaaaaagcataaaaagaaatgaacaaatcctccaagaaatataggactatgtgaaaagaccaaatctacgtctcattggtgtacctgaaagtgacagggagaatggaaccaagttggaaaacactctgaaggatactatccaggagaacttcccccagtcctagccaaggcaggccaacattccagattcaggagatacagagaatgccnccaaagatctccctcccnagaaagagccaactccccaagacacataattcctcccgattccacccaaagttttganaatgaaaaggaaaaatgttttaagggccgccccagaaaaaaaggttccaggtttgccccccccaagggaacccctcccgactaacactga

SEQ ID NO: 703570 - DNA, 331 bp, Homo sapiens
  misc_feature (11)..(11): n is a, c, g, or t
  misc_feature (13)..(13): n is a, c, g, or t
  misc_feature (21)..(22): n is a, c, g, or t
  misc_feature (207)..(208): n is a, c, g, or t
ccgggcggagnanaggatctnncggaactttctagaccataaactgaaatgcttccggtttagtgacgttatgaacagtgcacctcgacctttcagttgtgacgatttgtaagaatcacccaacagacaagggtggttttccaagtctgagtggtagatattgtatcgaaagcttaccgactggatcttttagagtcggttcgactnncctcaaacagtgttagttacacgttaaactgaagagtgacattctcttttggagtctgagaaacgattttattttccctaagacggtgtctcacctatttctcattgttccagacgactactt

SEQ ID NO: 703571 - DNA, 602 bp, Homo sapiens
ttccaaattcaaccaacgtctccatcatctgttccatactttgcaatgtcctaggtgtactgtcccctacagtagattatcccgtttgcatggactgcataacatcatttatccaccatccagctccgtcttctttagaccactgtatcatgggctctgatgttactcaaccgtcattgtctctgtcatacgtgctgaagatcatgcagttgtacatggtcatggtcctgtagtctcccatcagctgacatgctccatccatgagggcattacgaactgttcctctatcgttattcactcagatctggtatctgtcggcttcaatatgtacagtgaatcctccatagtgagcctttactttgtctccttgccagtcctccatttctatccaaagttctgtgggtcccatcctggttagctggctaattggatcatttccaatgcaatactcacctggtagtccacagtaattcgtcccatctgtgtgagctcatcatttccaaatcactgaatcactgtccatcctacatcttctgtaatcatgtcacagtatactcgatacggtttgacatgtctgtcaggttgaataagatacatctcag

SEQ ID NO: 703572 - DNA, 356 bp, Homo sapiens
aacgccgccagggagtccctttgtctctgtttgcgggggtcctgagtggtataactagcaaaccccatcgtctcagcccaaaatttccttaagctgagaagcaacttcagaaaagtctcaggatacaaaatcaatgtgcaaaaatcacaagcattcttatacaccaataacagacaaacagtgagccaaatcatgagtgaactcccattcacaattgcttcaaagagaataaaatacctaggaatccaacttataagggacgtgaaggacctcttcaaggagaactacaagccactgctcaatgaaataaaagaggatacaaacaaatagaagaacattccatgcgggtaccgagc

SEQ ID NO: 703573 - DNA, 113 bp, Homo sapiens
cgtatacagagccggtggtgggacttatgaatgattttctcctttcgctgtttgtatttctatattcctaaaattaacacacattattattgctagaataataaaagttttat

SEQ ID NO: 703574 - DNA, 416 bp, Homo sapiens
aagcttttaccgcagatagatgcacttcacgccttaagtcagagcgccgatcgtcgctggaatcgcgttttacatcattttcaaacggtgatgttttggggtgcattgattggacttgctttgatcggcgcggttttgagtacatccgaaatgccttgggtatggattgtgcaactggccataatcgcaatgtccgttatcgtcgttgctttaggcggtcgtacctatctgatctggcctgatttcaagggccatcacgacgactacaagtaggtcggaatgagttagttgattactggtgtagtttggagagacttcttgcctgtgccttagcctactatgttgcccctgccgcgctctacgcggctgcggcactgaaagtgtccgcacagtgcccggccaaaaaaaaaagctta

SEQ ID NO: 703575 - DNA, 235 bp, Homo sapiens
ggagtagagaattgacgtaaatagaaatcgaactggatttactccgagtctgaactcagaattcacgtaagactttaactcgttgaacaaactaacctttaatagcggctgaccatcgggatgtcctgcatccaacatcgagcgtcgtgaatcgtatagacgctgtcggactctagaataggattgcgctgttatccctagggtaacttgttccgttggtcaagttattggatca

SEQ ID NO: 703576 - DNA, 289 bp, Homo sapiens
ggtcctggagtcgaaaccagacagctgtcggaactggacgaccgtgtcagatgcacgccaggcgggtgtgccccccagtttgaaccaagcgcagccacgctcaagcgcaaatcactgatgcaaaacactcaagatgatgatcatcttgggcagtgctcagcgccatcatcctcactcatcatcataggtgagtagggtgagcactggccgcggcccttaccctggagaggtaaccccagtggatcctaggtaaagaaggtcattaatctagtctttactcttcagccaa

SEQ ID NO: 703577 - DNA, 157 bp, Homo sapiens
ccagccattccatgggccagcagcccttggcagcacagtcagtctattttcgggctattcccatctgtgcccgtacgtatcgggtaagcagggagtgggcaaggctatgcccaggccagggcagctctttagtcactgctcagggaggcaagggcct

SEQ ID NO: 703578 - DNA, 152 bp, Homo sapiens
gttttttgaagggttttttttgggcttttaacccgcttatttttgtttttgtttagtttttttattcttattttattttggaaaaatatgattgttttttgtgcccccccgttgcttcccttataaccccaaaatatttttgggttcctgga

SEQ ID NO: 703579 - DNA, 135 bp, Homo sapiens
atctagaggatcccttcgattggcgggcacttacaaccgcatcatttcctgttgctccaagaagaataaaggtgattctcatctaaatgttcaagttagcaactttaaatctggaaaaaggagattctaacactt

SEQ ID NO: 703580 - DNA, 1022 bp, Homo sapiens
ctggcgacaaaatgtgctgcccgagtggagacgggcggagcctcagtgaccgggatgtgctccgtggccccgcggtctggtggctggtggcgggagctgttgggctgagtcgggatcggggacgtcgcccgagagcggggacgaggaggtgtcgggcgcgggtgttcgatgccctggtgtctgtggctggctgtgaacttgttctgccaacgacgtgcagcttcctggtagctgttcaatgctggaagatggatggaggagcagctggcagctggcagtgagtgagcctgcccactgtgtgtcctgcagctgaccctgaccgagtctggctctgccgcctgctggccccggggatccgaagaggaagggctggtccgggctccacacttagcttacgtgggcaaacagcagaggcgggaacaaactagccctcaagacggggaatagtaggccaagaagcacgaagacgggaggatgaggtagttaacaagtaaaggtgacagcgtgggccaaggtacatggcagaagtgaaaaagtacaaagcgtcacacagtgcggtgacgattgagtgaaacgtcgggaccatgggtgaaatgacggcccgctcgcgccaacctgcccagtgggcctgggactctctgcgatgtacgagtcagctatgtacatgcagcggcagcgtgagaccagcctaccctgcagaggacttacaagcagagaggagagccgacgaatgcgttcccaggaaggccgatggaacgcagttcgtccagagactcgtattagtgatagcccgagtgggaggcagcgtttggcgctagcgggtggggaaaggtactattaatgaaaccacgggggggttgaagcgtatgtacggcaacggggatttggagaaaagcgaacacttagagtccaaccgttccaggggcctacgagttacgcgtggaggttcgagatcgtatgcattgaagcccgcgtacgttgccgagttacgcgcgttaaagcgccagtcgaggagcactggg

SEQ ID NO: 703581 - DNA, 1362 bp, Homo sapiens
  misc_feature (535)..(535): n is a, c, g, or t
  misc_feature (707)..(707): n is a, c, g, or t
actctattctttcttttcctcccccataatcatctgcttgttgttaatgctcttcacagtatactttcgctgtgtctcatccaatagccctgctcgtctcatttatattcacccctgctttcgtcatcaccatatttttccccgtcctatttatttctgactcttcctacacatcactcgttctttgtttttccccctcgttctcttgtttcactcccctctaacaacacggcacatgatctcataaaaaaaggataaggcggtttcataaacaataatttgtataaagggatcatccccgcgcgcaccatattctgtttacccccccccccccctgttgtgcccaccccgaatatccctactccaccccttggttagccattccccccccccttatttttaagaggggcccccccgcccttgtgccccccgggtgaccacacacgtggtgtaaacccggctcccccgtgtcgtccccttacgcccgggcgccaaaaaggttaaggcactaatgaccaccgtgggtctccgcctnataaaaatagggggaccacctgtgtattgaattgggctccccacagaaaggggtttcacgcctgtgccgtttgaccacttgttaacccccggtgaagagttgacccctgcccccgtgaaagaggcccgggccatgaccacccacgccgatgtaccgtatgagagcacccctnatgtgtgagcctttagagtgtgtagttaaatgccacaccgagttacctgttcaccgaaccccacccaggtctctctataacattcacccgaacaccgtgcgcactttacaatattttccggtttgtgggcggaccctcggagcgccagagaacacccatacactctccgtacgccagtaccaatgcgtcaagactctcgcacccaagtcccaaacgcgcgaacattacttataacatcccacatatgtgataccccaatagacacattgtgagcccacaccgggcaccaagtgtcacacctctaggggatatacaccagcgcgccaatccctgatatttatagagtgcccataatccacaccaattagggtttacagacctccgatagttggatccaggacaatccccgatggtgccacgcccgcttattaaaggttctcgtttgttccacacacgatataaagtcctacacgtggatctgagttcagaccggagtaatcccaggtcggtttcttatctacattccaaattcctccctgtacgaaaggaccagagaaataaggcctacttccaccaaagcgcccttccccccgtaaatgataaccatctcaacttagtattatacccacacccaccccagaaccgggtttgttta

SEQ ID NO: 703582 - DNA, 466 bp, Homo sapiens
ctccagtactattttaaccccatcatatacaccctcgcgtgactctaatatgaacgcgggatccttcatcattgtcatagctatgtcctgaaacaccttgttcaatgagtgcttcacatatcaatctgtgcccttcaacagctgccatgtgcaaaggtgtccatccagcatcatctctgtgatttacatctaaccctctatccagtaaagcacgtaccacctcaacatatccttgttctgaagctatactgaggactgtcctaacttcactatcaatactatccacagccgcaccccaaaacaaaagtgtatttccaactgatgcatgacccatagacgctgctgctaagaggcgtgtatggccatcgttatctgtgtgatctacatccggtcccccttctagaagcaagtcaaccacatcaacatgtccctcataggcaggtaccagcagtggagtcatgccatc

SEQ ID NO: 703583 - DNA, 132 bp, Homo sapiens
gttgaggtcttggcgcgtgttctagtggggttagcgatggcggtaggcttgggagctgtgggtgaaagcgtatgatggggtggtggttgtggtaccctttaatagtgtcggcagctgcctcgtttctgctgt

SEQ ID NO: 703584 - DNA, 301 bp, Homo sapiens
tggagctgcgcacccaagtcttgcctcttacttcatgtgccctatctcggtgggggtctgtcttctcctactgtgtctgaccttctcttctgcgtctgacttctcttctgtgtctgtcttctcctctgtgtgtctctgatatctcttaaaaagacacttgtcattggatttcgggcccaaccagataatccatgatggtcttgactcgagatccttaacttcatcggaaaagaccatttttccaaatacggtcacattcacaggtcccaggcattaggacatggacttatcttttcaatgc

SEQ ID NO: 703585 - DNA, 303 bp, Homo sapiens
ggcactctacggcactcatcgtaagctctggtactcctcatggggcttgccattatcacacaggtgggcgcttggagctgcaggtgaccaggtccgtcttagaggggatatagacttagggcacgtttcggtcctcacacatgactgggagatggcagtatacctcactgggcagtgtgtctcctgccaaaagcatgatccctttttctcctttgttgacaaatatctgaacctctatcaccccgcgccgaatctgctactgcatcaccgctttcttgatgcagttaccacggtcgaattcga

SEQ ID NO: 703586 - DNA, 502 bp, Homo sapiens
  misc_feature (4)..(4): n is a, c, g, or t
  misc_feature (58)..(58): n is a, c, g, or t
  misc_feature (63)..(63): n is a, c, g, or t
  misc_feature (111)..(111): n is a, c, g, or t
tatncaaatatttccccaggtaaattaattttttttccaaatttccgatgatgtgttnggatngatttatgactagctaattgagggaactttaaaaatgttagtcctgcnttacgggtctgaatccagtgctactcaaaagtgtggtttgccccacttatctcccaaactatgtgtttgtgtttgttataccattaagttcaaaaaatgagtaattggccgggcgcaagttgcacgcctgtaatccccacactctaagaggctgaggtgggtggatcacctgaggtcaggagttcaagaccagcctggccaacatggtgcaaccccatctctgctaaaaatacaaaaattagccaggtatggtgacgcacacctgtaattccagctactcaggaggctgaggcaggagagttgctccaacccaggaggcagaggttgcagtgagccaagattgcgccactgcactgctccagtctgggtgacagagtgagactctgtctcc

SEQ ID NO: 703587 - DNA, 173 bp, Homo sapiens
ggcttcttctgccgccccccctccctctgcggtgctggccgccgccgcgtctgtggcgcgccgcgacggctccgtgccccccaccgacgcgacccgtggcgctttgcccgcggcacgcaccacccctgttcctcctgactgtgtcgtggacgcacccttgtggcatgctgtgt

SEQ ID NO: 703588 - DNA, 140 bp, Homo sapiens
tacatgaaatcactcacagggacacttgaagaacagagaccagaaagagtaacaacttatatgacaggggctagaagaacaacatcaagcacatccttgcttacttacaaacaactaccagatacaatataaggatgaaa

SEQ ID NO: 703589 - DNA, 144 bp, Homo sapiens
tagaggatccccgcgcctggggtcaggtgtcagacccgcccgccaggggggagttccttaaatcagccccagcgccttgaaaacaaatgcatattcgagtgctacgtcacgtaatccctgataacgcccactcatgccgccgtg

SEQ ID NO: 703590 - DNA, 989 bp, Homo sapiens
  misc_feature (141)..(141): n is a, c, g, or t
  misc_feature (147)..(147): n is a, c, g, or t
  misc_feature (206)..(206): n is a, c, g, or t
  misc_feature (267)..(267): n is a, c, g, or t
  misc_feature (280)..(280): n is a, c, g, or t
  misc_feature (528)..(528): n is a, c, g, or t
  misc_feature (735)..(735): n is a, c, g, or t
tctgagaaaaataagatggaatcttggaattgggttttggtttttgggtgcatactggtgaggatgtctgaggataatatgatagatatggtgacttatatgcttgattgctataagattgtggagacactgatctagcanttagantggttctttagtgatgaagaggataagggagagagaacccttgtgggtgacaaggagcntcaggcagtgcccaacattgagtacctcttgcccaacattggcaggacagtgccccctggngaccggggtcagnggacctgttggagatttaaaggattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcnggggccgctgcctggcgccgtcgcccccgaggcccccggacgcctcagtcccccggcggcgccggaggagcggccggccgcggacacgcgctccattgtgtcgggctactccaccctgtccaccatggaccgcagcgtgtgctcgggcgctagcggtcggcgggcaggggcgggggacgaggcggacgacgagcgtagcgagctganccacgtggagacggacactgagggcgcggcgggcgcggggcctggggggcgcctgacacgccggccgtccttcagctcgcaccacctcatgccctgcgacactctggcgcgccgccgcctggcccggggccgcccagacggcgagggcgcgggccggggcggtccccgcgccccggagccgcccggctcggcgtcgtccagcagccaggagtcgctgcggcccccggcggcggcgctggcctcccggccctcgc

SEQ ID NO: 703591 - DNA, 196 bp, Homo sapiens
cttatctagaggatcccgaccgcaactactcggcaatcacatagctagttcatatcaccagggcaaagcacgctttacccaaatgtcaccaacaagacattgggagcgtcgtggttgcaacttatattcaactcagtgaaaagacacgagcccaaatgcatctatgctcagtaaagcaacccttgcctcccccccc

SEQ ID NO: 703592 - DNA, 369 bp, Homo sapiens
atcagctcggtaccctggtacgggagtggaaaacgcctgatgaacttcgcgatacgcattgaaaatgaaagctgcagatgttcgtgacatcagtattggtttaaaaggtttttttgatggcaaaaaagttgaagactacgtaaatcagcaagtaaataacttgccgctcgaaaaaatgaaaattccgatgtatgtagtggcaacagagctaaagcatggcaccaaaaccgtatttaattatggcaatacgggacaggcggtgagagcatcagcctcaataccagcatgtttgtaccgactaaaattggtaaatctgaatatgtagatggccggtttactcacgtccggtacctccactcccgtaccatg

SEQ ID NO: 703593 - DNA, 153 bp, Homo sapiens
cccggcaacagcgcgttacttcctgacagaccgttcagccaggcggtaagcgagttattgatccaggcgacaggactgcgggcacctgcacgacgacgagaccgacgggcggcacaccgaatacgaccatgaaagcatgcactgacaattatt

SEQ ID NO: 703594 - DNA, 196 bp, Homo sapiens
tgagtgagtcggtacctcataggtcgcaggcacgactttggcttttacgattttttcataaatcaatctccacaaaacccggtgccctgaccagattcaaaattgtcttctgccccacaacatcgtgccgggcacgtgcaatcacataaacaccgcgctgaatgatcagccctggcaataccctgcgaacctatga

SEQ ID NO: 703595 - DNA, 228 bp, Homo sapiens
aataaattttttttgggtaaacccccccccccccaaataaaaatggccgggagggcccctttttagggaaaactttttttaccttttgggggcaaggggccaagggagggaaagggtttttttttttttaaaaaggggggggttcaaccaaactttttgaaacccggttttttaaatttattttggggccaagggggccccctttaataaatccaattttttttctta

SEQ ID NO: 703596 - DNA, 105 bp, Homo sapiens
ttttctgtgtggtcactgtcctcatctctttgggctctgtgtttcctgccttttctctgtgtctctgtccccgtctctcttggtctctgtctctgtctctctagg

SEQ ID NO: 703597 - DNA, 132 bp, Homo sapiens
agaattgcacatcagccccacagccccatgacactctaggttgttaccccttctacaaaactgacccgttcatcattcccagagtgcccgcatgtctacttttgtggcaaaaacccaagagcccacaatgcg

SEQ ID NO: 703598 - DNA, 85 bp, Homo sapiens
gtccaggcgggtggtgctcatttgaggtcaggagtcagacagcttgccacatggtacaaccctgtctctactaaaaatacataag

SEQ ID NO: 703599 - DNA, 240 bp, Homo sapiens
gcaagaaagtttgtacccatccaaggaaaaaatgggtgcaaaaatacatttttttactgaaaactccgaaacaattgtgaatcagttgaattttcatccgaggaggcttggaccccgcttttgggtttgcagccctttggggagcctgcggaattttttttgaagggtacaaggacccgctggggaggaaagggtgtttcctcccaaagttactttaaaaaaggttgttcataaagttga

SEQ ID NO: 703600 - DNA, 244 bp, Homo sapiens
atagctcggaccgctagcaagtgggcacctcgctctgttgcccaggctggagtgcagtggtgcagtcacaactcacctcagcctcctgagtggctggggccacgggcatgcaccaccatgcccaggtaattttttgtagagacaaggtttcacagtgtttcccagtctggtatcgaactcctgagctcaagccatctacctaccccagcctctcaaagtgctaggattacaggcgtgagccctt

SEQ ID NO: 703601 - DNA, 257 bp, Homo sapiens
  misc_feature (16)..(16): n is a, c, g, or t
  misc_feature (220)..(220): n is a, c, g, or t
  misc_feature (222)..(222): n is a, c, g, or t
tcacgggcctatgccntgacacttgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccagggcccagccctgtggattgaaaccacagcctangncctgctgcacctcctgcttcacgagggcaaagcag

SEQ ID NO: 703602 - DNA, 295 bp, Homo sapiens
  misc_feature (42)..(42): n is a, c, g, or t
ggctttacaacgcctgggaagctttgaggtttgcaataaatntaaatacttgtctgtttcggtctgcactgcctttatgggcggtaacactcacggggtaggtttgcagcctcactcctgaagccagtaggacaacgaacccactgggagaaacaaacaactccagacgagccgacttaagagctataatactcgctgtgacggtctgcagcttcatttttttgccagcgagaccacgaacccaccagtaagggaggaaactccgaacacatctgaacatcaggaaggagcagac

SEQ ID NO: 703603 - DNA, 232 bp, Homo sapiens
  misc_feature (22)..(23): n is a, c, g, or t
ccaaaatgcatttctatatttnntctggcctctgggtccctaccactttaatttcatacccaagtcggctggtcaggtagaggactcttgtggcatgaaagtggtttctggcactgcccattgtgacgtcatggaaaccggaaaggaagaaggtgttggttttcctgcttcttttcccatggcttcgagagttacactgtgtgatccagcagtctgactccatgattgaaat

SEQ ID NO: 703604 - DNA, 598 bp, Homo sapiens
  misc_feature (145)..(145): n is a, c, g, or t
  misc_feature (493)..(493): n is a, c, g, or t
agaagcttgctacaccattcgttcggcgctgcggctccagataggtaagtgaactctggtcatagtctgtttcctaggatgatctctggtccatgactagtgctagtgattctccacccaatatgaaataggcccaggatggaanaacggagcggttctggagaagaatatcctaatattggcagcttgctggagcgtcattacgggcatcttatctagcaggtaggtccgcagtcgagctcagcattatcaaaatgacgccgccgagcgctgtatgtcatatctaaggaactgggctcatccacaaatgccttgagacagcttacaagggatttccattttatggtaaaccaatgcgaatacagtatgcaaaaacagattcggatatatatcaaaaatgcgtggaacttttgctgacaaagaacaagaacaaagcaacaagaaaaaagccaaaactgtggaacagactgcaaaacacaaacaaaaagcctgngcagggaactccaaattcagctaatacccaaggaaattcaacacaaatcctcaggtccctgatttaccctccaaactatattttattccttaataacttaccaga

SEQ ID NO: 703605 - DNA, 246 bp, Homo sapiens
ggtcgactcattccattccattccattgcattccattccattccattccattccattccattccgttgcattccattccattacattcggattgattctattcaactcccttactctccattacattccattccattcgggttgttccattccattccattccattccactccattgcattgcactcgggttgattccattccattccattccattccattccattccggatgattccagtcgacg

SEQ ID NO: 703606 - DNA, 375 bp, Homo sapiens
attattctcaagcgtcatctgcttacataccctgaggtcacttgtgggcctctacactcagctcatctaaggatctgtagattactcaggttatgctcatctatctcattcctatatcaaactgttaccctcaattgaatcaccagcttcaggataccaaagtgctaggatatctcttgatactcacaatactgtgtctgcattgtggcatgactgtactaagcagatactaccttatgatattactatattcttacataactgttaccctgtctattgtctactctatacagctctcctacctgatattacgtacttcccttcactcacgtgtcttcacataccagagatcctcatacaggttggcatgccgtt

SEQ ID NO: 703607 - DNA, 394 bp, Homo sapiens
cgaatgtaaccccccgtgcgtactttccacttgtgagaagtttctttcagcagaggcacaagtgcaatgctattgctcagtggggaagtcttgcagctctatcccaacagtcagacagccctgaggctcatgagtgagaactggcagaagtgagacttcttacccctgcacgtcaccacttgcagcacacagcttggtggttctccctacaggtaaccttatcattgggtgcatcttgtagaccagactttcagacatgcattcttttcagaacggagtgccccacaggtttaatgcttgtgacaagaggtagcagtgacaataccctgttctccggtgcaaacatacagcattaccatgcagcatgaaaagaggtgcctgtactgatctgaat

SEQ ID NO: 703608 - DNA, 730 bp, Homo sapiens
tcatgtcctgaatacaagcccactcgccagttcttaccaatacaatgaagacgtatgagaagagtaaaggacattaacacagacataacacgataatctggagcagttaatattaataaagaggcccgcgagaattacaagagatatatgtgagaatacttaagataggtatgaaataggagcgagtgaaaatctgatgtatgtgaatttgaatacaacatggtagagtcagtgggaaacgaagtgttaagagatgcgaagtgggaagaggaatatcaggagaagatgatgaagagtcgattacgggtatgtacccagaatggtgggaaaggtcagagatctaggtgacatgtcaaatgtgcgagtgagattacgtgggcgagaaagattaaaggtagagatctaagatggaaagtatgcgtgggaagggtcttatggcccacttggtcgagttaactgggaatgttaagagaggaagaaggtctctgaaatgttaagagaagagaacgagtatagggagtacctggatattggaagtatagggaagagtgctgaattgcagtggataatgaaaagctgcggatctcatgagggcctagcatggtacatgcgatgctaagacatgtgacggcttaagccgtcggggcagtggtgacacgctaatgacgaacggggtgggatcgtgaatgatcatgcctctcagggaaactggcagcaagaaacgttaagg

SEQ ID NO: 703609 - DNA, 173 bp, Homo sapiens
gggacccagaccgtcaattatgtgcccagcctgataagggccctaacagcatctcagtactgtctggacgatgaagcaggtaccccggagccccttcaaggtcaaggtgctgcctactcatgatgccagcaggcgcgcaaattacccactcccgacccggggaggtagtgacg

SEQ ID NO: 703610 - DNA, 821 bp, Homo sapiens
  misc_feature (10)..(10): n is a, c, g, or t
  misc_feature (12)..(12): n is a, c, g, or t
  misc_feature (17)..(17): n is a, c, g, or t
  misc_feature (36)..(36): n is a, c, g, or t
  misc_feature (42)..(42): n is a, c, g, or t
  misc_feature (50)..(50): n is a, c, g, or t
  misc_feature (58)..(58): n is a, c, g, or t
  misc_feature (66)..(66): n is a, c, g, or t
  misc_feature (69)..(69): n is a, c, g, or t
  misc_feature (81)..(81): n is a, c, g, or t
  misc_feature (83)..(83): n is a, c, g, or t
  misc_feature (96)..(96): n is a, c, g, or t
tgggaaacanantttantcttgttccccaggcggangtgcangggcaaantctgggcncagggcanccnccgcctccgggntncaggcaatttccntgcctcagcctcccaagtagcggggattacgggcacccaccaccagtgcccagctaattttggtatttttaactagagagctaataatggtatatttaataaagagcgggttccaccagttgtgggccaggcgggttctgaactccggacctcaggtgatcctccggcatgggcctcccaaagtgcgggaattccaggcatgagccatggggcccagtctacacactatttctggtttagcccaacagctggttctggttctatcatacccctcatttcacgctcagggaagtcatacctagaatagttaccccaagagggaaccttggaaggccaacattggtacagtttggtgtagaagtcccctcccttactccttttatttaccattgagtggctgcatgtgttgtggcaaaatgaagcctttttcacttgtaaggcctgtatgggacatagggatataccctgggaagagaacagtaacccaggtttttatgcagggctacatactctatagggtctcgaaaaatggtggcactggctttgctgtggaacccactcattctttgtaacatgtaattgctgtgcccaggatatccacagggcgctgtgtaacctatatgacaccgagagggggtacacactttatatatttcccagagggtgcaagacgtggggacaaccacttctgggttgtgaccacccactccgtgagagggtatcac

SEQ ID NO: 703611 - DNA, 408 bp, Homo sapiens
ttaaataaccaaaccatggggaaagaaaacaaagccctcccatccaaaaaaataaatttagcaaaaaacagtgttaaactcaatggtgccggcaggccacaataaaataaaagatatttagaaaatcacaattttgaattcggatgattttaaattttaacaaatgacggaattggttaaataaaaatagtttaaatgctttccgcaataaactaaccatcaatctttgagggttctttaattaactcaaaaacttttatcagtccaaaggattcccaatttggaaatattcatcccctaaaaaaaaaacttaaaaataactaacaaaactctgaatgatcttaacgttaaaacctattttttgctaagataaaaaaatttcatatacttttataaaatgttatgact

SEQ ID NO: 703612 - DNA, 849 bp, Homo sapiens
aacagaacagacccccatccctgggctggaggacccgcctcttgggcagccagctgagaaggcgccccggggtagggggaaactgacatcccatctagagccgtccctcctcttcctcccctcccgactctctgctcctttccgcgccccagtaagttcaagggcccccgggctcctgcgctcctgccggtccagggacgcctcgcaactcacatcaagagcaggccggctggcacggctccacgggagagatggctgaggacgcgagccgcacacacggctcgtcccgtccatgcttggctgcttgcgcatacgcttggatggtctgcgcctgggcctatcgatagaggccgtatgtggttttctcgccccaaaaagaatcaactagagtagtctacgagcagtagagtaacaagaggctatattttagcctgaaaaatcgcaaagaagatcgtgtttcctcgcagattatgagtggaagaaactgggatcggaggtgtctccttggtctactatcaacagactcttcaagggtgatgttatgaaagtcgagctgagatgatagatttcaagtatccggatcaaaatgtgtgacaagaagtgaatgcgggggaaaagtatcgtgtgttgaatgtgagtgcctgcgatactgtagcaaggtgcaaaagctggaagaggatacagtcactctggaagtattagtggtgcagtagttccatcatgtgaagtacgctgcttctgtctgagtggaaactgtgggtagagctacgatgtcagcacaaagaaggggattcaggttctgaatttactggtttaaggtggctcgtttggtagaaaattccagattgg

SEQ ID NO: 703613 - DNA, 498 bp, Homo sapiens
  misc_feature (39)..(39): n is a, c, g, or t
cgggcggagaagagcgcgcgccaagcccttcctgggtantcagtattctcccttcctgggaacagcctgccctctgaggcctgggcacccgggttcccgagcgccgggtcccagccccgcgggggcgcctccgcaccccatctccgcgcccggcgcagagccgccagtctccgccgcggggccccgtgccccgcagcgccacctaggggccgggcgccgcctcccgccctcaggggcaccccccttactccgcaaggactccgggtctccccagttctcccggcagccggaccctcccagcctcggccgccgggccgccctccgcatcccaagcccgcctcccgtgcctccccgggggcgcaccggcagcgaggagcggctcggcgagggcgcgcagcggcggcccaggcccaggccttggggctggggctgagggggtgagagcaggcgcggccggcgggcaaggggaaccgggcgatggcagcggcgggcggccgc

SEQ ID NO: 703614 - DNA, 163 bp, Homo sapiens
gctctacgaggatcccccgttattgacacttcaacacaccacaatactatcggggttggtgtacaataggctgtaaatagaagtagagcttaatggagggctgatgcgtggctgtgatcagtggggtttgtaagggctaccgacgctcgaacttccgtaatca

SEQ ID NO: 703615 - DNA, 1289 bp, Homo sapiens
gttctgtgttgagcttctttggcgtgaggtccgccgttttctatgatgcgctccgctgtcccttggttgcgcggggtgcatttatttccgagcttgctacctcgtgtcgttttgggaggctctatcatactgttgtccactatacgtcgggtgttgcccgctctcgctgtttccgtgtgttgtttttgtacgcacgtcgtccgcgcggtggctgcttctattgttgtgcttccggccataattttttgtggtgcatttttactcctcttgcatcaatgggccccgacgcggtgtttgggcccccgtctgggggtgtttaccccccctgttggctccccatgagttttgttcctctaggctccccttttatccccgccacgtgtgtccttcactcgtgttgtacagtcacctcgctccttgccgtttgtgtgctttgactccccgtccgtgttgtttcgtgcgttttgggccccccccttgcccgatgtgcctcgtaactaccgccctgggtcaaaccgctgcaaacgcttttggtctcttccctatgttagtctgacccacctgttaggccttaccccgtttactccaatccttctgattcagggtgagcaatcaaactcccaattacgcccctgatcggccgcaactgcgagcatgttggccccgacccatctcatatgaagtcacccctagcccatcaattcgtactattcaacacttactaataagtggctcctttaaccttgtccaccccttagtcccacacacccaggacaccctttgagttactcctgccatcatgacccttggccactaaatatgatttatctccaccacctagccacgagagccctaccgaatcccccttcgacccttgccgaaggggagtccgaagctagttctcacggcttctaacactcgaattaacgcccccacggcccctttcgccctatttcttcactattgccgcgatatcacccaacacttatatttataataattaaacacccctctccacccctaaccaattctttccctagggaccacaccactatgaacgccaccttctcccctgaaactttaacaccacaacaataatttttgtcacccagaccctactttctaacctccctgtttttatgaattcgaacagcatacccccgattccgctacgaccacactcatacaccctcctatgaaaaaacttcctaccacctcaccctagcacttacttatatgatatgtctccatacccccttaccatttccagcattccccctcaaacctta

SEQ ID NO: 703616 - DNA, 918 bp, Homo sapiens
  misc_feature (918)..(918): n is a, c, g, or t
tataatcagaatctttatgacaatttagttcaacaaggtcagaagagatgagtttgctaaaaccagctgtgatacctcagcttggaaagggaattcaacggtatgctttgtagaacagaaccgctctagtttcccaaaatgaactttaatcattttctgtgtacccccccccgtcagtacaaaagtgcgtctaatttttacaaacagtagaacttcctccttttctaactgtaaatcttcccactgactttactgcacaggtatgaaatactagtgtattggatcttcaggtaacctttttatttcctagatgattgaaatatagtgtattatacgtccatttaaaccaaggtgataagatgatgtaaatactcagggagggtattaacttgtaactttaagctcgtaagagggtgtaacgtgcattgactgaataatcttcaattcatgattctagagtaacgtttaatttggaaaaaggggcttcacacattgatggtggttgaaacattgaatactttaatacattaacaagatgaaatgtttgtgcacatgatacatataatctttactggatatcactcggtatatgtatctctaggtcaaatacctttgggcaagtcaggaagaaacagggtcagtacaccaataggcaattagaaacacaggaatttaatcccgtaggagggaagtggacagaatatacatgggggggaaccaatttaaacagaagaagaaagggtgtgaccgagacaaaacaggaagtgaggggacaaatgaaatggaagatgaggagagagagtgttgaaaggagcagtgtgagaagaagaaaaaaagaagtgttaatgcgaaagatgtgaatatgagaagagaaatagatcgattaaacgatggaaatagaggacgtactaattgttn

SEQ ID NO: 703617 - DNA, 1114 bp, Homo sapiens
  misc_feature (155)..(155): n is a, c, g, or t
  misc_feature (170)..(171): n is a, c, g, or t
  misc_feature (178)..(179): n is a, c, g, or t
  misc_feature (219)..(220): n is a, c, g, or t
  misc_feature (227)..(227): n is a, c, g, or t
  misc_feature (250)..(250): n is a, c, g, or t
  misc_feature (260)..(260): n is a, c, g, or t
  misc_feature (318)..(318): n is a, c, g, or t
  misc_feature (321)..(322): n is a, c, g, or t
  misc_feature (335)..(335): n is a, c, g, or t
gatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggcgncgccgcgggcccganntctgggnncctgcgcgccagtgaggcaggggcctgcccatgcgcaggnngccccgncgccccgacgtatgactccctgngtctgcagcngctggacgtcatcgagtctgacagtgacgggtgatgccatctaaccctgcccctgccnacnnccgggcggctganactcactgagcagccaagactgttgcccagggcctcactgtatggtgccctctccaaagggtcgggagggtagctctccaggccagagcttgtgtccttcaacagagaggccagcggcaactggtccgttactggccaagggctctgtagaatcacggtgctggtacaggatgcaggaataaattgtatcttcacctggttcctaccctcgtccctacctgtcctgatcctggtcctgaagacccctcggaacaccctctcctggtggcaggacaactgaccactcccaagtgacacagtctgcaaatcacaaccccccaagacgacggcgaacacagcgccgaggattgcggccaatcgttgcgtacacaatcacacttacccatagctcccctcagcacctaggacacctcacttgaaacagcaacgaagcgcatggacggacacagaagacatgtcgacacaggagccactacaacagatcgcaacagcgaaaccaccatggcaaccaagcatgcggccaccgcctggacgtctcagcttcgtgcgccaacgagaaccacagaggtcacgacaagaaccacagcgagcaagcaaacaagaaaaacaaagaacactagaccacacacgccaccgggagacactcacccacaccccgcttcgcgcgtcatcatcggaacacacgcagacgtcgcaccagcacacagcggcaagcacggcgaacacacaccccagcagcacaccgcgggcccccgcacgccacccaccgcccgacacgc

SEQ ID NO: 703618 - DNA, 261 bp, Homo sapiens
gtggtcccccctaacaccccagtgcactgtagggtgggtacaccagtcgggattgttgggtgcagccgtacctcagagcccctgatgaagttggcaggctcgtacatgtcaatccacatgcctgtcgaagggcacctgtgtcatggcactcagccaccatgtcctcccaccaggccatgtactgtggtgtgttggtgatttctgggcaacggacgaggaccctgggcccataacattcccaaatcagatgtgctggcctgg

SEQ ID NO: 703619 - DNA, 194 bp, Homo sapiens
gttcgccaaagtagctgcgattgcacggcctgagccaccactccaggccgaatttttgtattgcttaattgagacgggggttcaccatgctacccagcttggtgtcaaactcctgacctaaggagagacaccagccttgatctcccataatgctaggattacaggtgtgagccactgcacgacacctcagccaa

SEQ ID NO: 703620 - DNA, 353 bp, Homo sapiens
tacaaattgtaggtttatggccattttaccaatggcatgtacttgctttatgtctctgtgtcacattttggtaattcttgcaatattttaaatttcattgttattggatctgtcattgtgatctgtgatcggtcatctttgactttactattgtaattggtggtgccatgaactgcacccatataagacggtgaacttaatcaataaatgttttatgtgttgactgctctatcaacaggtccttcctctgtctctcttcctctccctgagcctgcctattcctggagacatggcagtgttgaaattaggccaattaataaccttatgatgacctgtaagtgttcaagtgaaag

SEQ ID NO: 703621 - DNA, 316 bp, Homo sapiens
tgtcttagcacacctaggtcacttttgcagttgtaagccatttaccaagatagttgtaggtaaagaagggcagatttattagagaaattgtgacaatatgttgcagtgggcagctcagcagagaaggggctacctgcaaagaggcaagggctggaggaaagtttaatagggtcctgctgaagggtgctgcgtgtggaatgaggtcattgtgcccgcaggttgtttgtgattagctgtctctaacaattgttcatacaataattgttcattattgttctcaacttggggctctccccaacctggggacccttcctta

SEQ ID NO: 703622 - DNA, 1095 bp, Homo sapiens
tgatgaagaggaggatgatgacagtgaggaggatgaggaggatgacgaggacgaggatgaggatgacgatgacacttgaaccagcagcgatgaaagcagcagctgctgcccctgcctcagaggatgaggacgactgaggatgacgaagatgatgaggatgacgatgacgatgaggacgcatgactctgcaagacgaagctatggcagactacaccagccaccggcaaagaacgctgcaaacgcttgttcctgtgaaagccaagcaacgtggctcgagcgcatgcaagatgacgaagcaggatgcacgaggacgaggatgacgacgaacgacgaagcatgatgaagatgatgcatgatgaagatgcatgcacgcgacggagcgaagacgcagcgaggcaggacagcagccctgtcacacagcacgcacctgcgaccacgaacgcacacggaaatggtcaccacacgacaagccagcctccctgcaagccaaagcaccccacacacctgcgcaggcacagacaccgactcacggcctttcaatctcttacgctcgcccaacctaaacctctcaccccaaatctgctcctggaatcacacacactgggtatcagcgcatgatcctcgcctaccaccatgcatcctgctgccagcgcgactgtcccgacatgggcactcgactacggacacctcccggccaatcagaggataccgcgacctcctggctgacaaccctcggacagaccaccaacagcgaacctcccctggcccagccacaccctcggcccacttgcaacctacacctccccgccccaccacaaacgcgacacacaagccaaagcaacccgaccccggacacgcccccccaccaccccagcggcctttaactgacctttcccctcacccacgcaccaattcaggaaagacaacttgacacggcaccgtgtcagacgcatgagccacgccaacccagcttatccccgccccgagcccggccaagctcccaggcagctctataggcgacttcgccccgcagcgcactaaaacacatactgcaaccaacagagacgaacacccactggacatcccccagccatg

SEQ ID NO: 703623 - DNA, 473 bp, Homo sapiens
ggcaggcgcggtgtgaagtctagtcgaagtgggagtgggtgatatggttaggatgtttgcctctcacaagatcgttatgttgaagtataatgcctaggtgccggaggtgggcccgtgcgggaggtaactgggtcatgagggtggatccctcatggcttggtgctgtcctggtgacagtgagtgagttcttgagagatctggctgtttaaaagtatgtggcacctccctaccactctctcttgctcctgcttggccatgtgagacgccggctcccccttcaccttctgccatgagtaaaagctccctcaggtctccccagaatccgagcaaatgctggcaccatgctttctgtacaccctgcagaactgtgagtcaattaaacctcttttctttataagttactcagtctcaggtattttttttttcttttaaatttggtttatttttctagtttttctttttttttcaaattc

SEQ ID NO: 703624 - DNA, 461 bp, Homo sapiens
aaataaagaggagagagttaaagagaccagaataggccaggcatggtggctaatgcctgtaattccagcactttgggagccaaggggcgagtggatcacctgaggtcaagagttggataccagcctcgccaacatggtgaaaacctgtctctactaaaaatgcaaaaatcagctgggtgtggtggcacatgcctataattccaactactcgcgaggctgatgcaagagaattgcctgaacccgggtggcggaggttgcactgagctgagatcgcaccattgtactccagcctgtgcaacaagagcaaaacttcatctcgaaaaaatacaaaaattaacaagtaaagagaccagattagaagagagcccaggactgagtccttggggaccagcccagagatcagagagaggagaagactttgaaataggggaaactgaaaaaaatggccctagacggagaaa

SEQ ID NO: 703625 - DNA, 110 bp, Homo sapiens
  misc_feature (70)..(70): n is a, c, g, or t
gatgcgccttcatcatactaccagattaggaattattcctcgggaaggagcatttaaactgaacctggtnaaacaaaaagggtaggtatgatgaaggacgggtaccgagc

SEQ ID NO: 703626 - DNA, 334 bp, Homo sapiens
  misc_feature (148)..(148): n is a, c, g, or t
  misc_feature (208)..(208): n is a, c, g, or t
  misc_feature (234)..(234): n is a, c, g, or t
  misc_feature (265)..(265): n is a, c, g, or t
  misc_feature (289)..(289): n is a, c, g, or t
  misc_feature (312)..(312): n is a, c, g, or t
  misc_feature (325)..(325): n is a, c, g, or t
cccctccaggtgcccatccccgagcccctccctctccagatgcccatccccgagcccctccccctcatttctgtgccccaacctcttatctctgtgccccaaccccttttcccacttttctggaaggtgagagagtagagaaacggangggaggggttcgggggttcttttttctctaggcttgcttccttcactataggcaaccttncaccctctattcctccttctactccnttggcctgtgttctcaaaaacttaaaacctnatcaactcttacctgacctaaaanctaaatgccttatttttttctgnagtgcctcttgancccaataca

SEQ ID NO: 703627 - DNA, 1364 bp, Homo sapiens
gatcaggtacttagtgagtttagtcctgcagttccagcttaccatgaagtccctgatgctaaggagtgcatggcgtatgatgtggtcccactgctgccagatgtgactagtctacctggtccagccaaggcgcgggtgcctacgctcccggaatggtgctgcagtgctggctcctccagtgcccctggcatggatgtgtgcctcgaacgtgacactgcgtcctgccttaccatctgccgctggagttgcccatgcctgcatgcctcaatcgtacgttcctaggccatgttcatccccatgtgcgccttgcacgtgagcgcaatgagagccacgtctatgacatctgtgcgatgtgctctcttggcgccttggccccctgatgctactcaagtgtgtgtcttcctctgtcctggctttgtcctttgcatcacattctttaaccctcttgggaaccgggcgcccagtttctgcaatcccctttgggccttgcatcctcttgcacttcgaattgtgctcttggtacgggccctatgtcgaatctggtcctttggctcggcgcactctggcaacgttactccgatccgcctgtggaatcgatattctcccctgataccgtgggttggcagcgttgcgttggccgtatgtacctcggtaatctgcgtttattttgcccccctggatatcgctgcatccctgctacttttcgtgtgctcattctttttgatgtgctccttctaggcctctgataatatctaaattcctatacctctaaccctgatggcctgtctcctcctcggtactcctcagtatcggtgacattttcccccctttggcctttttggttccgttgtcatgcctcgtcatcatccgtgctttttgcctttaacgcagtttatacgcgccgcccatatcacttccacatccaatgataccccttctgtttaatacccttttatcctgttgcttctttctctccctccataatgtggggtcacctctaacgtcggcttcagtggtcttctgtcggtcacagtcttgcttttcggcgcttccctcccatccgttctttggtcctcagtggatagtactgcaatgtccctactgtcgcttaagtgttcttcaacgtggtgtccctgcgcgtgtagttttccctcttttttactctagtcgggacacttcggcggtatctcctcgatgcgggtgacctccccctttcaattgtccactatccctcgagcgttcggctctaatgtgctcgctctctttggtccgccacttgtgctctgtccctccggtggggtaacggccctcgttgtgcgatctgtgtgcatacgtgttacgtctctcgtctcgtgtcgttgtac

SEQ ID NO: 703628 - DNA, 172 bp, Homo sapiens
cggaggaccacgctccttgaccagctttcatgctggacattttgatttgcttgcagcttagggggctcctgaattcccatggcttggttgagtgtggtcgaatggcacctagaccttgtcatacaagttcaggacttggcctgctcctagctgatgaatgccagtgtgtgga

SEQ ID NO: 703629 - DNA, 162 bp, Homo sapiens
tcccgactagccgacaggcccccgactagcccgacaggtgatggggacggcggcacaaagggctgtcagcagctagggtgccgtgagaggtaggaccacctcaggcattggcagagctggcaggacagcaagaaatctagacggctgtcgggctagtcgggg

SEQ ID NO: 703630 - DNA, 145 bp, Homo sapiens
gtttaacttaatcatctttctgttcgaacagcactccggcaggcttgcattgactaaggcacatgactattacataactggcatttttattccctgccccttctctttagaaagagaagccagtaaatttcattttcccttaaag

SEQ ID NO: 703631 - DNA, 971 bp, Homo sapiens
ctaagtgatgtgaggaccaggggtggtgttaactcgctgttaccaccccccccgtggttgtttcaagggcccaaaaagtgtagaatagggggtttttgataggaagcatattttatcgggagttagacaggaatcttcaatgcgagaaccacatcttggggaggacacaccgtttgtttttaccaaacaatcgtccagagtcccccattccttgaaaaaataggtggtgcagcgcgcattatttgaatgattcgcccccacctgtgaaaatttgggtgtgttcctagccggtgttttttttaaaaaaacatgtgtcccccatgtttcccaggtgtgtcgcccgcgaacaatataaccaagcggttagtgataaaccatgggcggtaacatttaaaccttgtattggggacaaacaaagggaggccccccaaaagcaccaacccacgggttgtttctgaaagacgtctgccccgtgccgacagtccgcaggacgatggaggtctctgcgccttaaagcaacgcccggggaattccagcgcccggaaagacgcagcgccacgcacacccctcttgcccaccaaagggacgcccacacagactgggtcaagggacagttaaccacacggtggcccttttagagcgccagaaacaacattgtccgcatttgcatctggcgttcacacgtggtgagccataattccttccatgccagggtcctagcccccaccacgttgaagacttcccagaggacaacgtagggaggccagaaacgatgtttagcggcaccacggtatttgtgccatgggtccttaactgccgttaaagaaattacgcccttttggaaaatttgtttaacgtgaattttgtaagtgtaaaagaagtttaaaaatttttggggcctcaacagcttttttaaattatacttggggaaaaaatcagcatcttttccaataaactttttggaagaacca

SEQ ID NO: 703632 - DNA, 164 bp, Homo sapiens
agaacctattgtgtgtccccgtccagagagtttacttattggaggcgaaggagaacaggctgcctcctcacccaagaaaagaccctgcacaaccaacctgtgagtgctctggaggccccgggcatccacgaaccccatccccagagaagtcttctgaaggaagg

SEQ ID NO: 703633 - DNA, 341 bp, Homo sapiens
  misc_feature (52)..(53): n is a, c, g, or t
  misc_feature (80)..(80): n is a, c, g, or t
  misc_feature (208)..(208): n is a, c, g, or t
  misc_feature (324)..(324): n is a, c, g, or t
  misc_feature (332)..(332): n is a, c, g, or t
  misc_feature (334)..(334): n is a, c, g, or t
  misc_feature (336)..(336): n is a, c, g, or t
aaagtctcaagttatggtggggcacggtgctcatgcctgtaatcccaccacnnggggaggctgaggtgggaagattgttngagcccaggagtttgagaccagcctaggcaacgtgatgagaccctgcctctacaaaaaaagtttaaaattagctggcttggagaaaacgggagcattaaaaaaaaaaaaaaaaaaaggctggccatgntggcatgcacctgtggtcccaactactcaggaggctgaggcaggaggatcagttgagcctaggaggttaagactacagtgagccttttgttgccactgcactctagcctgggcaanagagatantntntctat

SEQ ID NO: 703634 - DNA, 912 bp, Homo sapiens
  misc_feature (637)..(637): n is a, c, g, or t
  misc_feature (712)..(712): n is a, c, g, or t
  misc_feature (724)..(724): n is a, c, g, or t
ggcacgaggcttggacctggggatgagatggtgacagatcaagccttcgaggatagactataggaagcagaggagggaagttatggacctccttcgtgaggcccaggatgtcaaagatgttgaccgaagaatttgagtggatcgcctacaggagagtgaataacactctgtccagccaaaagttagccgtttacagaatatccggaataccatggaagagacgtggaaacttggctgaagccaagcgcgtgcccatgtagagaacacagagcggttgattgagagatcgcatccagagaacttgagaaagcagaagagtcgctgctgccaagtgtgtcgagtcgactcagccagaatctacgaaggggacccagacaagccatgactctttgggcagaagaggctcgaaagcttgctgaacgtcataaacaggaagctgatgacatgttcgagtggcaaagacagccagatgatgacgtcaactgaggcatacaacctgcgtgtcgtgaggacacggcaggagaaaatcaaacagcattgagattgaagagcttaataggaagtatgaacaagcgaagaacatctcacaggatctggaaaaacaagctgccgagtacatgaggaggccaaaagggcnggtgacaagctgggagatctatgccaggcgtgggcacagctgagcccgttgggactctgagacacggagaatgangcaaataacatnaagatggagctggcaatcggaacaacgatgaccagaattaaaggattctgaggacctcagagaagaattgagaggggagggactggagtccaagaacctctgggaaaggccagaatgaacagagaccgggaccactctagccgagtggtgtgccaggcccgctgagaagggaagagggggggacttcg

SEQ ID NO: 703635 - DNA, 343 bp, Homo sapiens
ggtcaagagggcgaggggctgttagatgaagactcctaggttgccaaaggcttcagaagtcaagacatgtacaaacacaacgcaaccgagaccagttccaaacggcagcgtctgaacctgtcacggaccccagtcgataccatgcatgctggcggccttctatccttaaccaacctaagatgctaaatactactccagggaactagagttgttactcctgtaacaactgaaataacatgacacgatacacagaatatatatgaccatgtacagacggactgtgcaactaatgaggaagctgacagagaggttaacgaagcgacctgatgaccatgtctgcttg

SEQ ID NO: 703636 - DNA, 991 bp, Homo sapiens
  misc_feature (5)..(5): n is a, c, g, or t
  misc_feature (607)..(607): n is a, c, g, or t
  misc_feature (656)..(656): n is a, c, g, or t
  misc_feature (688)..(688): n is a, c, g, or t
  misc_feature (729)..(729): n is a, c, g, or t
gaganaacagcaggaggatagtcttgaggaggagcgtggcgtgctagatgtgtaactacgtcccgaactggttcctgtgtttttctagggcatgtggactagggatgggtacttgagtagaagcctgcaacttgaagagtttgtgcaggagttagctgcagtgtcggaaattagtgtcctgtatgctcaacaaggtattcggactgggtgtgcacaccacagctctcaggactggaaggtggaaatttaatctacgaagttcccttaaactgcataagcttcgggacctcttgattcactgatattttctggtggacccagggcttattcatgttaaaacctggttttcattaccatcagaataaactgacagctccattaatgaaatgcagcatttggtaaataatgttaagtggaatgatagaaacctatctttaacctaccggataaatcatttctaccattaccaagagtattgtagattcttaaagccaaacataccgtctgattcagttgctggatatttgaaaagggtttggcttctggcttttgaggagaggcgcttggtcgctttatagtcaaaatggctaatttgacttatcggctntgctggtcatttgtattgaatggacctttctcattacctacttgccaantgcttgtatgtttgggttctgactctgcaggnaatacgtgagtcttattaaaagttgggtcttctactttaangagcatatgtttgtggatgatatctacattagaacttgaatttaatacttttaattagcaacatttaaagtgaatccactatttcgtgcttgtaggtgaattggcttaataactaatctgatgctaactatgaaggtggcgtaaagccctcttgttaaacgccccttgaaaacataattctggtttttctttttggggagttttggatggctataaacaggggctataacaaatggtggtagacaaattttaatcttgagtt

SEQ ID NO: 703637 - DNA, 422 bp, Homo sapiens
gaggtgaattcaattcaatgaagtagcaaaaatactgtttttattataaaatactaatatcagtcaagtttcacccaaaggatcttgtatttcagaaaattttatgatgctacttatagctttttttctcatctgaatgtttttaatctcaaaatgttaaaacaaaataaatcatgagattttgcagtattcccaagaatatctgactgaatataagatatgaaagttactatataagaaaaaacattaagagcaatttttaagtatctaaatacaaaatgattataattattttgaatttgggttttttttgttaaaatttctcaaatgcattttcatccatttatgattttttaaaacgctaataaaaggacattacaaaatctaccttatggtataaataaacactgattattctccta

SEQ ID NO: 703638 - DNA, 226 bp, Homo sapiens
attcttgttggtcgtctctagcaggatcccccattgatgcccccttatgctgtgttggtctgccactttgtgtgacgtcatgcctcagtcatgactctgtaccatgggggacgctgggccgtgatctgctgtggattggggtcatagcaccagtgtcaggtgtaggtagtgtcagaacatctattttattacgctctttcttgtgcccttctaattttataaacgc

SEQ ID NO: 703639 - DNA, 676 bp, Homo sapiens
  misc_feature (124)..(124): n is a, c, g, or t
  misc_feature (126)..(126): n is a, c, g, or t
  misc_feature (129)..(129): n is a, c, g, or t
  misc_feature (138)..(138): n is a, c, g, or t
  misc_feature (141)..(142): n is a, c, g, or t
  misc_feature (144)..(144): n is a, c, g, or t
  misc_feature (148)..(148): n is a, c, g, or t
  misc_feature (150)..(150): n is a, c, g, or t
  misc_feature (170)..(170): n is a, c, g, or t
  misc_feature (204)..(205): n is a, c, g, or t
  misc_feature (284)..(284): n is a, c, g, or t
  misc_feature (298)..(298): n is a, c, g, or t
  misc_feature (304)..(304): n is a, c, g, or t
  misc_feature (329)..(329): n is a, c, g, or t
  misc_feature (338)..(338): n is a, c, g, or t
  misc_feature (343)..(343): n is a, c, g, or t
  misc_feature (349)..(349): n is a, c, g, or t
  misc_feature (676)..(676): n is a, c, g, or t
caaagacttcgactcccctgagaacggtgcggacagcttccagagctcagactccctccttcagtcctggaacagccagtcgtccttgctggatgtgcaacgggttccttccttcgagagcttngnagntgactgcanccnnantctntncctcaataagccaacatgtntttcaaggattacatccaagagaggagtgacccnntggagcaaggcaaaccagttatacctgcagctgtgctggccggcttcacaggaagtggacctattcagctgtggcagtntctcctggagctgntatcanacaaatcctgccagtcattcatcanctggactgnagacngatggnagtttaagctcgccgaccccgatgaggtggcccgccagtggggaaagaggcttagcccacgatgaactacgagaagctgaaccggggcttacgctactattacgactagaacatcatgcacaagacgtcggagaaagcgctacgtgttctcgattaaatgtgcggacctcagaaacttgcttggggtttcaacgccccgagggaactgtaacgcgcataacctgggcagtaacaaccccgtacaccggaaggtacttgacgttccgcccggggacccaccccttgaacccggctccccaaggcttcgtggtacctgttgggtgcccn

SEQ ID NO: 703640 - DNA, 203 bp, Homo sapiens
  misc_feature (50)..(50): n is a, c, g, or t
  misc_feature (73)..(73): n is a, c, g, or t
  misc_feature (92)..(92): n is a, c, g, or t
gagagtcactgctggtgggcgtcggcgtgcacaatggtgtcgaccaggcngaagtggtggaagaagccgtcgncgggttaccagcgcgttgntcgaggcggtgatcatcgtgctggtggtgagctttatcagcctcggtatgcgcgccgggttggtggtggcgtgctcgattccgttggtgctgtgactctctgaatattcac

SEQ ID NO: 703641 - DNA, 189 bp, Homo sapiens
cacgaggcggcgctggatcgattgtatcgcagccatgtcgggccgggcgaccgctatgcgttgctcgattttcccgaccacgccaatgtcggcgacagcgcgatctggctcggcgagctggcgatgctgcgcgcgatcaccgggcgcgaacccgactatgtttgcacttggcacgatttcgatgagcgg

SEQ ID NO: 703642 - DNA, 206 bp, Homo sapiens
gagatctatctaggagtggaatagagtcatatggtacctcagtgtttaactttagaggaactgccaaatgattttccaaagtagctgcattattttacattgctaccagcagtgaatgagagtttgaatttctgtacatcttcacccaacacttgatattgtctgtctttctagacaaatttggataaatccctccttttctaaac

SEQ ID NO: 703643 - DNA, 326 bp, Homo sapiens
gcgtgaacccgggaggtggagcttgcaagtgagccaagatggcgccactgcactcttggcctgggtgacagagggagactccgtctcaaaaaaaaaaaaaaaaaaaagcatgtgatcatccacattttatctcaggctccttaaaaagaggaaaaggaacttatgtctactaaaaattattgtgtgtgaatgtcctacaagagttctaggagttactctactatcaagatgtttaggaatttgtccatattgaacaacattccttccttaaaatgtctggctatcattccatatcattgttgatttcagattatttaaactccatc

SEQ ID NO: 703644 - DNA, 861 bp, Homo sapiens
caacttttaaaaataaaagtggtagaatttttttttttcttttggagacagggtctggctctgtcactcaggctggagtgcagtggtggggtctcagctcactgcagcctccgcctcccgggcttaagggatcctccctcctcggctcccgggtgtctgggaccacaggctgcaccaccagccttggtaattttggtatttttggtagagatgggtgtctccccatgtggctcaggctgttcttgaacttctgagctcgggtgatctatctgcctcggcttccaaagtgctgggattacggcttgatgagccatgacctggccaaaaggtggcagaaatttggatatggttttataatcagtttctatggtgggggaagatgggccattttaatgaatgattatttctatgtgctaaactaccgagtcacgactgacaaatacacttgaagctttaatcacatgcagtttatatacttctcacaaatcatcaaattatttatctggtcttcacacctaagggatttacttagatagcatcgatgatctcagtgtcaacgtgtggtttttcacacagcatttattcagtgcatcctgatttatttcaacactggaacattgtgaccctttttttcgtgagtaattaagttactttagtgccaggctaagtatacagggtggcccgggtactaaaatcggcaagaggctgtaattttcaaagccctgtttgtggtccatgtgaataaggcggaattgcgttagaccttggtctggacccaccagggccgcaaagctcaccgggggcgtcaccgggggttcgcccccgggaatttttcccaaaagtgcacgcccaaaatattag

SEQ ID NO: 703645 - DNA, 843 bp, Homo sapiens
gtgcaagctccggggtaatagatatctgcagtgcatgatgaagctgtcgcaatcgatcagatccgatgggatgccagaagataaacatttctttgctgccatgggctgatgatgctgctattagatcaagttgtagctgtggcaccaacttcacagtcattgtatcatagaaaagagattgactatgtattgccttaattgtagaaggttatgagctttgggtctggtttcgatgggattgatttagaattgtcggataaaagtaaaagctgggagtcataaagggatgcattgtgttgggtaaatgtgcaatatatgcattgtgagatctgggtaccattgtggattgggtgatactcgggtgttgtgcacacaggcgtcgctgtgaatcgtcgtcgagagagtatgctgccattgtgctaccgtagtagttagaaacttgtatggacataatgcttgacccttcggagagtgacgcctaagaattgccacgaattgggtatgggtgacagggaacaggtccttgcggaattttttgtaaccaggtaataaagacttgagggttgtcccatggggttatccccaaaggtgcggcgaacccaacggggggaccaattggaaatcccggagtaaagtttggtcttaggatcccttgtttgacgctaggatcgaggattgcgcacgaagaggatctcgaggaaagggtcacccattgggcgacaatagtcttgcggtgcgcaacggctccaattgacttaagtttgctatccgaggggctagggtacaccccgggtggggcccggaaaaggcagaggaacaatagtgtttaccattgtgccaatg

SEQ ID NO: 703646 - DNA, 358 bp, Homo sapiens
gatgcaaaggatgctgttgacttgatgaaggctctacagttcaagcaggtctccctcctgggctggagtgatggcggcataactgcgctcatcgctgctgcaaagtacccatcttatatccgcaagatggtgatctggggagcaaatgcctatgtcaccgaggaagacagcaggatttaccagggtatccgagatgtttctaaatggagtgagaaggcaaggaaacccctggaagccctggtatggatatgactaccttgccaaaacctgtgaggactcgggtggatggcataagccagtttaaacaactggccagagggtaacatctgccggcacttgctgcccctggtccagtgcc

SEQ ID NO: 703647 - DNA, 125 bp, Homo sapiens
ggtgtgtctagaggatcccagcgctgcgcaatacatacacggagtagttcttcaacaagggacacttccctctaattcgcaagggtatcccaccattccggagaataccggtggggaatgattta

SEQ ID NO: 703648 - DNA, 254 bp, Homo sapiens
cctcccaggctcaagtaatcctccaacctcagcctcccaggcagctgggactacaagcatgcaccaccatgcccagctaatttctgtaatttggcagagacagggcctcactttgttgcccaggctggtctcaaactcctgacctcaagtgatccgcccacctcggcctcccaaagtgctgggattgcaggtgtgagctaccatgcccagtcagaccttgtcattttgtgctggtaccagcaaagcatagggac

SEQ ID NO: 703649 - DNA, 624 bp, Homo sapiens
  misc_feature (469)..(469): n is a, c, g, or t
  misc_feature (564)..(564): n is a, c, g, or t
cctgttctctctatcacttagagtttgttgtatttaatacctttgctatcattttattgtggttttggttgggagaggaaataaaatggcaatccactacctcgaaaataaattagtacatttatttgcctatcttcatctcctaactagtctgtgagctccttaagggtagggaaggttattattcatttttatatacccaaagtacatcagtcacagcccagccagaaaaatagaaaccacaagaaagatttcaccagagggaatttactagaggaattagtttacacatgtattagaggatagaaaggacaaaagggagcactgggctcacctggagatattactgaggaagctgctaccaacctagccctgggggaaccaaacaggggaaactgggattgtcaaaagctctagaacctcagagtaggggacctatgtagtgggagctcaggccactgaggggtgnttatgaccaggttgtagttggacctctagggcccagtgttgatgtcgtagggatctctgagggccagtgatgaggctagatgtgagttgcaaaantgtcaagcagaagccagctgttgcagctggggctaagtgccactgacaggaacactaagc

SEQ ID NO: 703650 - DNA, 918 bp, Homo sapiens
  misc_feature (265)..(265): n is a, c, g, or t
agcggcttcttttccgacaaaacaccaaatggcggatgactgccggtgcagctgggggtggcccgggggccctggtggccctgcggatgggtgaaccgcggtggtcttccgcggagtgtttcggcagtggcatccggggtccggggtcgctggtcctgtggacggggccgtggtgccgaggtccgctggatgctctgcggatgtgctaggccgaggatagaggagtgtgatgcccgtcagccacagtgtgggccgcttggtctanaggacatagaagatcgatagtccctaggcaggagatcttatgctcgttctccgctgcccgattaacggacatcagacgatcgattagatgtatctatcgctggagggccttcatcgtaccaaggcattgacggtctttgaacgattgattgccagtgccatgaagcaagaccctgtggccggcgcagacgcaccaggttcaatagggcacttctgttgcttatcgggggcactacaataatggccatcgtctggtactgggatgttaacgtgctcctaatggtaggttggcctaccgtctcagtccgtgaggtcgccatctatccgtggccaagcgtcaccatcgtaccccagtgcgcagtaggctactagggggaacatagatcggcaagccccgatcactggtcccttgcataggtgacaggcctgctgcggctctgtgctggtacgcctcatccctgcacccaggggacactggtatcgtcgtccgcagctgtgcctaagaagctgcgtcatgatggctggtattcgatgactggctacagctcagtccggggctgtgattgccacctgggcaacttcgccaaggccacctttgatggcatttctaaagacctacagctacttgaaccccgaactctggaacggaggacg

SEQ ID NO: 703651 - DNA, 711 bp, Homo sapiens
cgccgtggctcatgcctgtaatcccagctgcttgggaggctgaggcgggagagttccttgaacccgggagtcagaggttgcagtgagctgggcaacacagcaagactccatctcaaaaaaataaaataggggaaagataagtcatttatattaaattatgagaaaataatggcaactgttaaacttttaaagtattatttccaactaaattaggaagaactaaatttcacttttacatatgcatgacaatgatgagcagggctcctaaaacagttgtggcttgactaggaaacaaataataatttttttatatcaataagaattacttgcaactttagggggcatttagaattatatttgccttatttgagatttggatttaaactttattttagagcattttttaaaaaataaatagaagtgaggctaatattgctaattattctctttacaaatacagcatttgcttgggctaaaattttctgccccaacatcattatcacgagtcagccatatacaacgataaacttagccattactgtgtgcaggcattgctctaaatactctattcgctatcaccagcgaaccttatgaggaactatcttatccttagctggcagacgatgaacctggcgaccaaggagctaatcaacttgctcataactcggaagctgtagcttaacatcaatttccttgcattcaggccttgat

SEQ ID NO: 703652 - DNA, 1366 bp, Homo sapiens
  misc_feature (885)..(885): n is a, c, g, or t
  misc_feature (1059)..(1059): n is a, c, g, or t
ttttcgcgtgcgctcgtgttgtggccgacttccttgtagcgaagctctgctgggagtgtcttttctcgagtccgaccactctgttcgtctttatggtcatgcgctcgctccctctctgtctatcctcccacttggctccccgtcttttcgcgcggggtgtctcccgtctcttttccagcggcgccgctgtggccccctgtgtgatccacaggggggggggtccccccgagtacaccaaagcgcttttttgtttgggggggatggggtgtttttccgcccagcgagctcacgccgccggtgggttgtttcctcgctgtgtagaagatggtgttgtgttgtgataacgggcgaacaaaaagcatcttggggccgttggcccccgctgtatgacgcccagggccttctgggttcccccaccagagtcgcgttggcggctgttgggggcgttaaggggtcccccgcatggcccccattattgggccgcctctttgttgatttgtagctcttcgcatttgccgccctgtgcgagcgcaccgccctgggtcatccatatgcacacaaacgccctttccaggtaggggggccccctctccagccgcgttcttgccctgggaagcccccctttcttttgtggggccccaagaaactctgttggggaccccatagccccggatgtccccgctctttcggtgtgtcccccataccgcccacccgcttgcccccagaggacttgtaggactctggacctctccctctcttggtggcaccccatgggccctataggggccctcgagcacacttctcgctataagagaggtgtcttttacgccaaagcgcccccccatatatatagcgtcccacagggcggcgccctctggcgccgcnccactcacattggttataattctttgtgcccagcacaagacacacacaccaccgggtataggatttctgtgcctctttgtataggtggtatagggagacaccacgagtgagccgagcctggtcacactcctccctgcgcacacacattcacactttgtgtaatgttcgagaggncctggcgtgtataagcacacgaaactccctcggagagtctaccacgcggaaccagggagagccacttcactttcctcgcctcgaggaatacctcggaagactttcctcgcacggaggtcacgcgtttcacattcttgaacctctgaagatgggaaaggatgtttctttttacgtgacccatttcttttgttcttttgatatttaaaagaagtaacattttccttggtagagaaatttgggaactgttagaagagatatccagaagaaaaatttaaaatcagctgttgttatcttgcctagcccaata

SEQ ID NO: 703653 - DNA, 849 bp, Homo sapiens
  misc_feature (188)..(189): n is a, c, g, or t
  misc_feature (199)..(199): n is a, c, g, or t
  misc_feature (202)..(202): n is a, c, g, or t
  misc_feature (207)..(207): n is a, c, g, or t
  misc_feature (209)..(209): n is a, c, g, or t
  misc_feature (214)..(214): n is a, c, g, or t
  misc_feature (219)..(220): n is a, c, g, or t
  misc_feature (226)..(226): n is a, c, g, or t
  misc_feature (238)..(238): n is a, c, g, or t
  misc_feature (241)..(243): n is a, c, g, or t
  misc_feature (247)..(247): n is a, c, g, or t
  misc_feature (251)..(251): n is a, c, g, or t
  misc_feature (255)..(255): n is a, c, g, or t
  misc_feature (260)..(261): n is a, c, g, or t
  misc_feature (263)..(263): n is a, c, g, or t
  misc_feature (271)..(272): n is a, c, g, or t
  misc_feature (279)..(280): n is a, c, g, or t
  misc_feature (288)..(288): n is a, c, g, or t
  misc_feature (293)..(293): n is a, c, g, or t
  misc_feature (295)..(295): n is a, c, g, or t
  misc_feature (297)..(298): n is a, c, g, or t
  misc_feature (303)..(303): n is a, c, g, or t
  misc_feature (337)..(338): n is a, c, g, or t
  misc_feature (362)..(362): n is a, c, g, or t
  misc_feature (366)..(368): n is a, c, g, or t
  misc_feature (396)..(396): n is a, c, g, or t
  misc_feature (408)..(408): n is a, c, g, or t
  misc_feature (428)..(428): n is a, c, g, or t
  misc_feature (433)..(433): n is a, c, g, or t
  misc_feature (518)..(519): n is a, c, g, or t
  misc_feature (537)..(537): n is a, c, g, or t
  misc_feature (561)..(561): n is a, c, g, or t
gagtcttcatacacgcggcagcagcagacagaggactctcattaaggaaggtgtcctgtgccctgaccctacaagatgccaagagaagatgctcacttcatctatggttaccccaagaaggggcacggcactcttacaccacggctgaagaggccgctgggatcggcatcctgacagtgatcctgggnngtcttactgntcntcggntngtggnattgnngaagangaaatggatacnaannncctntgantggnataannangttcttcnntgtgtgnncactcaangtgtngncnntaacnagaagatgcccacaagaagggtggatcatcgggnnacgcaaagtgtctcttcaagaganaaannngtgaacctgtggttcccaatgctccagntgcttatgaganactctctgcagaacagtcancacancttattcaccttaagagccagcgagacacctgagacatgctgaacattatttctctcacacttttgcttgcatttaatacagacnntctaatgttctcctttgnaatggtgtaggaaaaaatgcaagncatctctaataattaagttcagtgttaaacaatttagtaaggtcacgctaagagtactaatcatgtgaggactgatgagaaattattacattgggaaaatccatcattaatgttgccatgcttataaaaaaaaataaagataagaacaaagtaaaaatataaagagaaaaagtaaaaaaagagaaaagaaattaaagcaaacaaagaaaaaaaaaaaagtgaagagagacaaacaaaagaagagatgaaaaaaaaaaaataagagaaaaacagaagaaaagacgaaaa

SEQ ID NO: 703654 - DNA, 147 bp, Homo sapiens
  misc_feature (23)..(23): n is a, c, g, or t
aaggaggctcgggctcagaagcntgcactctggcgggcataccagcgggccctggccgctcacccgtggaaagtacaggtcctgacagctgggtctctgtatggacctgggttcacattatctcacagcagctggtggacacgtgcg

SEQ ID NO: 703655 - DNA, 366 bp, Homo sapiens
accaggtgctcaccagtacacgcaatcccactccaccgtgagaccaggcgctcgccaatacacgcaatcccactccaccgggagaccaggcgctcgccaatacactcaatcccactccaccgggagaccaggcgctcgccaatacactcaatcccactccaccgggagaccaggcgctagtcaatacacgcaatcccactccaccgggagaccgggcgctcgccaatacacgcaatcccactccaccgggagaccgggcgctcgccaatacacgcaatcccactccaccgggagaccaggcgctcgccaatacacgcaatcccactccaccgggagaccgtgcactcgccaatacacgcaatcccg

SEQ ID NO: 703656 - DNA, 1137 bp, Homo sapiens
tttgtttggttcatttacctataagtgttctttgttggttgtatggtcgctgctggtttgtttatgctctgctgtgtgtttagttctcgttcttcgtgtcctgcgctaccattttgtgttgtgtctggtcggtgtgaacccctcttctgccggtcttgttctttgtgttttaggagcagtttgctccccccgtgggtttgtgtgccagccccgttgtgctccccccccccccaggggccccttgagcgttcaatgttggggcacccctccgcgcctgggattccggggctggagggcgctttgttttcccacccgtggcgcggcggtgagggttggatgtaacatcggggggtttcttctcaggaatgtgcctacctggcaataagagatcttggtaccgacgtggtgtgaaaccagtccccccctgtgtgtgtgttggccacccaaggtggatattaaggacccggaaagtgaaggcgaaatcccttgtcttcccccgaagaagaatcttcagtatctacgacatgttctgcccaaagtaactaccactttgaaaagcccttcctctggcttgctaggaagctcccttggagacccctaacgttggaatttgttgccctgcctgctcctcgcccccacccacgagagttgtcctggagccccgcctttggcacgcccccgtattgagcccgacttagaggttgctccacgaccacctggcttcttcccgcgatgaggatgatgaccctcgtgagaatgaagcctggagccccgcgtcacgaagttctagttttataggcacgctgtcctcgtgatgtcacccggtgcacgcgtgtgtgccaccctcacttatttatctagctataccggaaccactgtgcttcactctgtgggatgcctgaaggagatgagtgggcttcggagtgaaatgtgccacgtttaaaaaataacttcacttgtttggacccgcactatttagctgttttggaacccacgttgagttccttgagtttcaataatataagactgctgcacgtcagcactcccacatattcacgtggtgaaatcttgtttgttactgtcattccccttccttttcgtttagaatccagaataaagttgtatttccaatatcta

SEQ ID NO: 703657 - DNA, 282 bp, Homo sapiens
  misc_feature (17)..(17): n is a, c, g, or t
  misc_feature (29)..(29): n is a, c, g, or t
  misc_feature (45)..(45): n is a, c, g, or t
taatatcactttataangcatgctggtanacttgtgtgtgtgagnccccatggtggctgaaggatgattagaaaaagatttgctaagccaagttcttgtggttcttaacctattctaagaagcggggcaatgcgaaaaatataaaggaaaaacaagagcccacacctgtaaagatactttactttcatatgtgtccttactgtttttaacctataaaggaattttagttgtgccttcttatctctgtgataaggcatttatttgtttctaaatgttgacagt

SEQ ID NO: 703658 - DNA, 257 bp, Homo sapiens
  misc_feature (11)..(11): n is a, c, g, or t
  misc_feature (18)..(18): n is a, c, g, or t
  misc_feature (20)..(24): n is a, c, g, or t
  misc_feature (78)..(78): n is a, c, g, or t
  misc_feature (93)..(93): n is a, c, g, or t
  misc_feature (115)..(115): n is a, c, g, or t
  misc_feature (118)..(119): n is a, c, g, or t
  misc_feature (121)..(121): n is a, c, g, or t
  misc_feature (161)..(161): n is a, c, g, or t
  misc_feature (163)..(163): n is a, c, g, or t
  misc_feature (167)..(167): n is a, c, g, or t
  misc_feature (174)..(175): n is a, c, g, or t
  misc_feature (194)..(195): n is a, c, g, or t
  misc_feature (197)..(197): n is a, c, g, or t
  misc_feature (234)..(235): n is a, c, g, or t
  misc_feature (252)..(253): n is a, c, g, or t
  misc_feature (256)..(256): n is a, c, g, or t
ggacgagaacnttgcaangnnnnnaaaagctaagacccccgaaaccaagacgagctccctaagaacagctaaaagagnacacccgtctatgtncaaaatagtgggaagatttatnggnngnggcgagaaacctaccgagcctggtgataactggttgtccnanatanaatcttnnttcaactttaaatttcccnnanaaccctctaaatccccttgtaaattaactgttagtcnnaggggaacagctcttgnnctng

SEQ ID NO: 703659 - DNA, 359 bp, Homo sapiens
agagtcaaacagtgcccggctggcgtgcacatattggtccttcaggcctgggcgagacggagcaagacttgtgcctagttgggggctcccctggagcttcaatctccagttctactcacccggggttggggctccttaacgctcatcgtgaggtctcttcgagtcaagaatgctgtctactgtgcagtcattttccctgaattttctcatgggagttggctgccatctcccaggctcatgccgtcacctcgcctttcttgttggagacttcagaggaaggatctggccctctcatctcaggctgtgggcccctcaatccttaactttcttccatggacaatcagggccatgggtggccc

SEQ ID NO: 703660 - DNA, 576 bp, Homo sapiens
  misc_feature (11)..(11): n is a, c, g, or t
  misc_feature (77)..(77): n is a, c, g, or t
  misc_feature (101)..(101): n is a, c, g, or t
  misc_feature (128)..(128): n is a, c, g, or t
  misc_feature (130)..(130): n is a, c, g, or t
  misc_feature (200)..(200): n is a, c, g, or t
  misc_feature (222)..(222): n is a, c, g, or t
  misc_feature (397)..(397): n is a, c, g, or t
  misc_feature (427)..(428): n is a, c, g, or t
  misc_feature (457)..(457): n is a, c, g, or t
  misc_feature (498)..(498): n is a, c, g, or t
  misc_feature (524)..(524): n is a, c, g, or t
caagaggtgantagccagtcaagagctaggtttaatcccagtatcagcatgattaagaagtgtattgaagttctaanagacaaacaaaacatagaacgcanccaggcgccggcagatgaaaacagccncnccgcgcgctgccgcccccccccagcgtggtgtgagaagatcattgccatcaccatttggtgtgtccctgngggaaaaagcaggactgtgccnccataatttggtcatttggcagcccctgttttctgctgttaacaacatcaccagtgccacgtcatgagcgtcaaagaaaatgcctagagatatttcaagcccatgccattatgacatttcttaaaactttattaaaagaatgagtgaagtattgctgaaaagtggaaattcggtngggtaccatgctttatctcccccccacgtnngcagttgatgtgtcttttttttttttttnaatgtatcttaaaggacataaaatttaaaaacttaaatatngtaatatgacagataacctaataatngtatcttacatttaaaagtgacaaacattgatacgtgcgtgcttgtcaaatt

SEQ ID NO: 703661 - DNA, 353 bp, Homo sapiens
  misc_feature (21)..(21): n is a, c, g, or t
  misc_feature (23)..(23): n is a, c, g, or t
actccgggggggcccccgggncncccccccccccctctttttttacataatgggtgaagcccaacctgttttgccgatgtagaaattggtgctttgttttttttataaaactgggttttgcccaaaaattggggggggtccccctttgcccccgctaatgtttctaaagaaaaagccctttttttttttttttttgtggaaccttaaatgggggaaagccatttttgtgttaatcctgccagcgcttttattccctttaattcgaaaccccggaagattccatccctgttttgaatgggtaaaaaccccccccttttttttttccttttgtttaattaactgggggcccccga

SEQ ID NO: 703662 - DNA, 257 bp, Homo sapiens
  misc_feature (36)..(36): n is a, c, g, or t
ccgactcaagcactgggggaaaatggttatgctaanaacatttaaaagagaataagcacaataaatctaaaggttgaatgaaatatttaatttagcaattaactttttttttttttggaaatggattcttgctctgtcgcccaggctggagaagtcctccccagttgctttcggattcctccccaagtgctttcaaagtcctcggggaactcctcttaaattcgaccgtgcaggacttgcaagccttggcacgtggc

SEQ ID NO: 703663 - DNA, 190 bp, Homo sapiens
  misc_feature (109)..(109): n is a, c, g, or t
  misc_feature (156)..(156): n is a, c, g, or t
  misc_feature (167)..(167): n is a, c, g, or t
cctcttcctcatcaaagagaagagccagctggtgcggcccctgcagcccgccgaatacctcaacacgcgtggtagtggaccaaggacgtgagccttgcacagccggcgntccacttgggagaccccactgcacttcgataactcacctacatcagnaacccactacnggcaaggtgctgtggggactacc

SEQ ID NO: 703664 - DNA, 1020 bp, Homo sapiens
  misc_feature (239)..(239): n is a, c, g, or t
agcggagtcgtccgtgggtttccctgccagacgcagtgttggaccataatcatggtggacatgatggacttgcccaggctcgcgcactcgaacgccgggcatgctagtctcaattgtcattcgacgaggcctggtctgcttcgctagggaggctggaataagattcagtcccaccggataaaagtgtttagttgctttgcaggatgggagaagggaaaagaactggaaaccactcgagnttgactggagacctccgttggagtgaacgaataatctgcctgggagatgtgtgggacagatggtgtgggagaagagataagccgatctaagtgccacgcatgcgttgtgatagcaatcttttactgttcccacggtgttgacacagaacagcataggccagtgccctttgtgtagtgctgtgggagcttctagcagagtggacacgcgtgtgagacagattgactccaatgaacttgtccacctcgaggttgtgtgatcgctgttacggggattgttgctacacagtgcattgggatctttgatggcgagttttcattaccgagttgctaaactcgagcgtcatattacagagtcctatgtgagaagggacaagccgcttcggttgttctgaagggcaagagaatgtgtcctgtgactcgttctgcactactgctaatgtgtggctgattctcgtaaggaatacttcgcaacgctaagaggtttgtatgactgggaactggactatgattggacaggtgtcgtcaccataaggtccgttgtcaatagaagaaattggcgtacgtccagtagtatgcgtcagacttgagatgcaaggaactaaaagcaggtgagtccgaagtcgtaagttgctatgggattaatcacaaagtaagaatggtacgtacgtatcggtcatatcgatttttcatgcttcttgaagtcatgtattcacggccgaaactttgaagatttcatagggccataagggtcaggaacttgaggccctagccaaataaaagc

SEQ ID NO: 703665 - DNA, 191 bp, Homo sapiens
ttgttggtcgatctctagcaggatccccgcaactcgcgtagtccagagagcgactcgggtgccatgaaggcgggcgtgcccacagatgtagagagaggatgccacgtacacatgcccttacacattcattgcatcacacccagagtcagcgcatctctaatgctgcccagtcttgctctcgaccaggaagg

SEQ ID NO: 703666 - DNA, 974 bp, Homo sapiens
ggatgccaggactgagttgtgggggagggaggcggtttagcgggctttcgcgccttttctggcggcggtagatttgaagcgcttcagaggaccggacccagaggagaggaaaactctcaaccggttgcagagagcagagggaattcaggtgtgccctttggtgatattggggacttgaactatcagtgaagaatgatcatcggtagttgccgccgatgggacatcaaggtttcaacgttccatcgaatgtctttgctggacatttgccaatgaacgaagtcaacctggttgaaagagtggtcttagaggatgaattttcttgattgtgtgccccaagaagaatgctgagaacttacgtttgtcgtttgtaccatggtgacatacgggcaccgggaaatcaaatctcaggaaaccatttacgattaataggagtggtctctgtacacagagttgtcgacgattttattgctcacaaggtggtgacttcagtgaaggacacctggacgacggagtgggacctctatctatggagcgatcgaagaggacgagagtctcgcgtgtatgaaacacacaaggcaagaattactcttgtcatcggccatcagagggaaggataccaatgggttcaccagttctttcattaaccaacggaaaccaatccctcagtttagaatgggcatcatgttgtttttggccagtaacctctggtcagaagtgtaagagagattgcgacgcagacacacgatgcagtaggaaccgggaggaggacgggtaccagtgtggaagctgttccaattaagtagaacgagacggaggattaacatcataatgcgccctagttagtgcacaaatgcagggtcaggccttggtccgtatccagggtccggacaacagaaaaagactggattcaggaaaaaaaaatgccgcagaataattgcgcaaagaatgttgagaggtgtacaacggggacattc

SEQ ID NO: 703667 - DNA, 673 bp, Homo sapiens
gctcactacatgtgtcgccgcctacagactgcgtagccccggacatggctctgtagcctcgacccctttgtgcccccggcccgtacctccgacgctcaccacgcctgcgctctccgcatcccacactatactatatactatacagcacgaggccgccgccgacctctccttgctgcagccatggagtctatccacttatacgcctatggttgcctgtcttcgcccaactgagcatcctacagaaccatacgtgaccagcatgcgtgagtgcacagctcttctctcgtgtgctgacatcatgttgcaccagcatgctgtgcctacacgactcgatatgtatactgcgatggacagatgcgtgcggggcatgggagcatggcacagggtctcattgcatcccagagtagtggggcctgggactgggcctcgtaagcactcatggcgaaactacccccccggcccccttagccccacctaggaactccctaataggagcgtcctctggggcgaagacccctagggaagggacgggcgcttacacaagtaggcgggcggacagagacccactgggaaacggatgacaggcctatcatactgcacttgccgaccgacctgcaacacgacagtcggatatcaccaagctactacctaaccctacatggaaggcactaga

SEQ ID NO: 703668 - DNA, 118 bp, Homo sapiens
gggtaacctaatgtggggcccgctcatgagtagcaagacgtcttgtgatagtaattattatacgaatgtgaggctacagggggggagtactaggacgattgtccacgtcacggcgtcg

SEQ ID NO: 703669 - DNA, 339 bp, Homo sapiens
gtcttgatcagatgactattgatgaagataaattgatagcacaaaatctagaacttaatgaaccataaaattggtttgactaagcttaattgctttctggaacaggatctgaactggatatccaacaggtacgacaccacagaggaaagttatttatacccatcaacactggtaagactgaaccacgtgaccatctccttgatcagctgaaaggaacagcctgagctgttatgatgctaactgttcagagacacaagagagcaattccggatgtgatgtagagagcagtctgggcagtatactgagacctctagtcagagcatcttagatctgtttgat

SEQ ID NO: 703670 - DNA, 641 bp, Homo sapiens
  misc_feature (405)..(405): n is a, c, g, or t
taacaaacccggtcctggggggggtgtgggtataatactaagtggagatgataatcatttacgggggaaggcgcttggtgaagtaggcctttatttcctcttgttccattctcgtacgaggggaggaaattgtgaagttaaatagaaacaccgcaccgctggtttacctccggctcgtgacacctcagaactccacgttaggaacttttaactcgtgtgacacaaacggacacctttataatataagcggggtgtgcgccacatgtgtggagatgtgtctcctgtgtatctccacacacatctcagaggtgtctcagtataaaaccccccactatgtgtgtgtgtgatatatgtggacctctctataagacatataggagatatgtgtggcctgtgtgttatctncccatagggtgtaaatctgtggtgtcccccggtttggggtccaaatgttttatgtggggtatccacattggatgtattaagtatgtccgtctttggactgggtagaatgttcttaagcatggtatctggctccgagaaggttgggtgttctggctcccagaggtgtcgcccacaaccgaaatttttaatggcagggttgggtagtttaaggacctgtggggttggtaacggtacgg

SEQ ID NO: 703671 - DNA, 546 bp, Homo sapiens
gaagtaatactcgcttacatgttaaagaaaataaaatgtagcagttcaaatgaggttataatgaaaacaatagtgctcttccattcctaccccaagtattagtccccagaggaaataattttacctgttaattctagttgttatcactaattaatatgcttttgctcctatttttaaaactgtggctaaaagcataatatttatcattatagtcatttttaagtatacagttcagctagtgttaaggtacacttagctacttttttttttttttggaaaaggaagtctgggtcgtgtcacccaggctgttggggttgccgggggccccacattctcggctcacgtggcacgccctctggcctcccggggttcaaacgcgatcctccctgcctcagcctcccaagttagctgaacatccacacggccacccaaactccgaccaactggcgctacatcccaccctacactactccgactctatcaaccacctcctcacgaccttactccttccgaaccccctcggtccaataccacgcgcatcaccct

SEQ ID NO: 703672 - DNA, 416 bp, Homo sapiens
tatagagaatccccggcgacatggggtctgtagagcctggtgcagggagagacggcgggcagcgctgaggagagaggacacaggtaggcagggcttgcggcatgacagggagggcctaggcaggaatccctgtgcgttcccctactttttggattttgaaagtggagaggcgcggcatgtgctctgtgctgctgttttatcatatactacaccgtgtggtatgctgctcacatcatctctagcttttagaatgagctgaacacatcagtgcatttgaggggctccgtggggaacggagattctgccagggcatacgagtgcatgtttgccactgcatgggttctagagcccctgcttgaaggtttgagacaattaagaatggatcgatgtgttctcaggttcacacaggcagaaga

SEQ ID NO: 703673 - DNA, 157 bp, Homo sapiens
ggcagagatgtttttaaattttttttagagacacggtcacactctgtcacccaggctgcagtacagtggcaaaatcatggttaacggcagctccgaactcctgggctcaaggaattctcaatcctcagcctcccaggtcactccaggcccgaactct

SEQ ID NO: 703674 - DNA, 413 bp, Homo sapiens
  misc_feature (86)..(88): n is a, c, g, or t
  misc_feature (91)..(91): n is a, c, g, or t
  misc_feature (96)..(96): n is a, c, g, or t
  misc_feature (101)..(101): n is a, c, g, or t
  misc_feature (108)..(110): n is a, c, g, or t
  misc_feature (234)..(234): n is a, c, g, or t
  misc_feature (301)..(301): n is a, c, g, or t
  misc_feature (341)..(341): n is a, c, g, or t
attaaattgggaaagaaaaccccaggggtttttatcatttccttttcccccttaaggttcccctgaaattttaaaaatcaggggtnnnttnatcgnggggntcttttnnnttttcggggccccttttttaaaagtttaaaaaaatgttgccaggggggttccgtttttacccaaagacttggggataagccaccaattcccgtggttgggatttaaagggtattagtccccccngtatggggaagtagttttcgggtatcctgttgtgaaattgaacctgtaaaagaaaagggttgaaagncctggtatgttgctctgtatgggaaaaactaattttgttncgtcagggacaaaattactaatccctttttttcccccttccagcccaaaaaaagtttgggtttttaacccca

SEQ ID NO: 703675 - DNA, 1134 bp, Homo sapiens
gaagcagtgctgaaagagaagagatccttaggcaaagactgttgaaacccatgctgccaggaaaacttacctattgaagctgttctatcacagatatatggtacactttgctggagcttggctgtgactctcattgagacgattacgaaacccaccttgaacacaattagcaacatattcctcatcttagcctgcaaactctaacacgcacaaactgcaaccaggctcttagccaacagcactggcactactacttgcgtgactgcagccacagcaagcaactggccagagcaactactacctcaacgtggccgtaccaccaatcaacacaccgcaccagctttcgcctcctctgactactacccccacacaatcatcacgcctgcacccgcaacgcttactcctcttactaaacccactgcatacttatcaactgccctcctctataagccctctctttacccttcctaccaagcttcactgctcccacagaccctcactttcacatgcccaaagctacgctcactccacaaccttctcccatctctcctcggcctcttccactctcactcgttgcttacgctccacttacctgcacacgctcctcatctccccttaagttccgaacctggtcaaaccatcggggcgtcaacctacacaactaacgggtccctactactggccgctcggcctctggcggcttccgatttcaccctcggaaaacaactgcaacaggcccctttgccctctcccaacctaccttccggcgacacgctacattccacaagggaaccttcgttaccaaggcggctatccaactttcacacagacggaaagcgctcaatgaataccgcccctgggaaagcccttcttagtatccccacctcattctcaggcacctgcccctcgtagagccacagcttgacgtctacttttccgtcgtgcgcgtgaaacgttcgtcccctctgaagcccccctttcatcatccccagggcttaatggaccgtcatccgcttaaagagcaaagtgtacacagccctcgttcacacagagacatcaccaagcaaaagtatccgccagatgtgacatacccgataagttgttcgccaatatgttcagattttatctttatca

SEQ ID NO: 703676 - DNA, 327 bp, Homo sapiens
  misc_feature (310)..(310): n is a, c, g, or t
gtcctattgccaccctgattcctgccagaattagttttattgcttacttatttctgatattgttgggtcctaggcgttatagattgtgacccctggaggggtaagagtggccaacgttcattcatgtcagttccaagttttttagatacaagggaaagctattccttaaagaagaggtgactccttagggagttggagtggttacagggtgtgacttcttcccattcatagtcacaaacaaaaatgaacccaactagggcaccaagagaagccctgcggagtgcgatgtttatacttcattgccaggtgngtctatagagatatttt

SEQ ID NO: 703677 - DNA, 1263 bp, Homo sapiens
  misc_feature (660)..(660): n is a, c, g, or t
agcggggctgcgcgccagcggacggtgagacgctggcgcagcgcgatttgtaggctccgagccccgtgcgttccaaaccctcgacgcctgtgttgccaccatgacgtgcggctagcactggtctactccggggctcttcgtgcctcttctgcgtcctgcgcgctggccgtggtgagtctgctacggacctagtttgttgactttgtggcttccgctttgatgtggcatggtttcctgacggccgacttcgtcccttcatgtggtccagcctgggtcacttgggcctagcgtatcttccctgttcctgctgggttgcgagcgcgatgcctgaggtgctatcatattattactctggtctcctcacatcattgtgtaggagtgactgtaagtgcccccaggtatcaagacctaaagtaacctggttcagagtactcattgctttcttggtgaatggccttgttgggctccaattctgatcgtgggcagtactaattctattggggcaagttcgttcatttgacgtcaacaacttggccattgaaggctcgttatcaaggtaggcgcaacatggacccccgaatagaggcctattccgaggcccaatccgggatacgttagccccacttgccttggggccttaccgttcgcgaatgttgtttnggcgagggcctttggctctcttacactcggttatgggccctttgttccgttaaagccttcgttcctgttggtggcagggttcctggcgcgttgcgccgcccatttccggttggtggccccggttgggggtggcattgcgctccttggccccgcattgcttcgagtgaaaacctcccgatggcccatcgtttttggctaaagagcaattccgtcaattcgggttgggcagggaatccttctttgggggcaatgcggcgccaaatttgggaccctttccgtttagggggggcggttcaatcccggagaccgcgcaaaattgcgttttcacgagaaacccttctcgaggaaagtttgcagcacggaccttgcggggctggaaccctaagcaattgtcgctacgctcgttcgttgtcgccctttgtgtgggcccaacgctgtgtcctttgacccttttaaatttttataagttggccgctggcgcttttgttcccgtggcggacccactggttgttgcaaccagtggtgggtgcctccttttagcggctctcctgcggagggcccctgcggggttcaccggcgctccctccctgttgtttctcccct

SEQ ID NO: 703678 - DNA, 110 bp, Homo sapiens
ctcggtacgccatgggcggactgtccgccgatgctgctgatgcagctgggcgaagtggtctacggcggggctcggttccggcctctacggcatgctggcgttcgccaggc

SEQ ID NO: 703679 - DNA, 414 bp, Homo sapiens
ggtgcgcagtgcggagcatggtgctatggtgtcgatggaagccgagctgaactatgtcgtcagcacccgtctagattcagactctgcagggactaaccgacttcgccgtcggagacccgatcggcctgcacatgactatcatgctgacagtgaatatagatgtcagatccttagtaattagcgttgggatgactaaggtgctcaggctacagcgtctctcacacacgcgaaccacggagatagctatgaagatgaacatggacatcagagttatgagctgagagctgtcgtatatcggctgacggtttgagagtgtgaacggcatcagccagtggttactacagggcacgagtaccccccttattcgcatgctagttatcatcgacgacaggactactggactagccgatggcc

SEQ ID NO: 703680 - DNA, 495 bp, Homo sapiens
tgtatatttaacatgggtaaattatgtggtaaagaaattataactcaataaagatgctttaaaaaaaaatgcacatggatgcatggggaagacattgtcaccagggagatgcccagagaaaaacaaaactgggcttataggatagagactggcagtgagggagactgacccgggttcaggctggaactgagacccagatggcgtgaggaagtactcttaaagaccggggcaggccgggcgcggtggctcatgcctgtaatcccagcactttgggaggccgagatgggcagatcacctgaggttgagagttcaagaccagcctgaccaacatggagacaagcatggtggcgcatgcctgtaatcccagctacttgggaggctgaggcaggagaatcgcttgaacccaggaggcagaagttgtggtaagccgagatcgcgccattgcactccagcccgggcaagaagagaagcagagagaaactgtgtctcaaaaaa

SEQ ID NO: 703681 - DNA, 527 bp, Homo sapiens
aacacttacttcatgtatctaaatcacacttcctttctgaatactatatgctttcaaagttgaaatatagtttttcatttatgctgatcaggaatttaagttcaaaagggtcagactggaagcaatctagcttttctaaaaaaaaaaaaaagtattagattttaaattatatgcatacacccaactgactttccttcaactgcctccactctcaaaaaaaacttcaacttgtggcagatctaatggcaaatgaatacaacctggctgacctgctctgcatgttattaaaatacacagtagctctagttccttacaagtcagggattctacttccaaacacaggacaaatgtggaaacttctctcttacaaattgggttgtggtgatcatttaagtatcaataaagacaggaattgccttaaatttatccagataaatgaaatcttattattggctaacgggtgctgattctgacgtctacataatcccacagctgtatcctttatgtgattaaactatgtagaaatt

SEQ ID NO: 703682 - DNA, 481 bp, Homo sapiens
gtccccgtaaaaattaaagttgaagaaaaacccgttataaaatacttcagggtttgtcatgttttaaaagattttttttttagaaaaggggggtttttccggtttttttttttttcaagactgaccttttttaaaaggaccccccagtttctttgccaatttccccccaaatgaatttatttggggttttatcaagaattgattcaaatttgatttttatgtaggaaaaccccccaaaggatgggcttttcaagcttgtcaggaggccccttatgtttatttgtttccaaacctggaaagttaactcaacccccttagttaaggggggatttgctgggttgggtgttttcccaattaattaaaaagttaataaaaattagggaaagatttttttagaccgtaaaaatttttagtttaggatttagggtttaaacctccccgaaaaatttattaaaaaaaaagccttaatttgggttttgga

SEQ ID NO: 703683 - DNA, 1534 bp, Homo sapiens
  misc_feature (446)..(446): n is a, c, g, or t
  misc_feature (564)..(564): n is a, c, g, or t
  misc_feature (675)..(675): n is a, c, g, or t
  misc_feature (748)..(748): n is a, c, g, or t
gtatcccaggctaatgtcagccgaagctgcaaatgctcgtgcgagagattgtgagagccgctggcgggctcccatgagtctaggtgccagtgtctgggactagtagatagctacgtggtagggcagagctgttagttatcccgagaggatgtcaggccgccgtcatgacactatagggagctatctcaagtatcacctgaatcctcagatatctgttgcgagaagcagtttataccattattagcgcctggagatcacctgagggaactgtgacgcgtagagaaattaggctttgaaagacactggacgactgtacatattcgtacactatgactccgtgcagagaggatgcaataagggtaacgagatatcagcccctgtacacggacagatggtgtggtggtatgagtgcatgtacctatacatctgcacagaagtgcgacaantcaatgtatgggtacccaattctgtctcaaatctgtagacgcacagcccattaacacacacaatcagtccaagtctgctacttcgcttcaattttcactgtgaattgacgtctcacanacacaaactgcagacaggccagtcactgtgtgttgccacagactgttatttccaataacaccaactttcctagaaagcagtgcgtgactgaaattgggtctctaaccccantctccattctttgtttcacgagggaaccgcggggacgattctcccacacaattttatccaacatattccaagnggaaggaactggaagttcatacaaaggcggacaacctttaaccatgaacacacttggttaacctttccccgcggagagggcttactttcacttcactggaattacttgcacttgcactacttgtctaaaaggttgggggattacccgcaatcttaaattgggacgaaatataaccagaccctgtgaaacgtggaaagtaagactatggcaactctttcacaaaagagcaattcaggtagaattgggggcttctatttgtcccatttggccagatttgtaaaattaccctccgaggatcttccccttgtgtcgaccaaagctaacctgtggggttccagggaaacagcttttcaattggggagaggttcataaattgttcgttgcgcgggcggggaaaaccaattcgggggctaccatattggtgccaaaccaccctcccatctgtgtgttctggaacgttgcggatataacgaagcgtgcatttgcactccttgcaagaagtattggcgcgggtaattccaactgcgactccaacaccggtgtaccgcacaccagtgggaaatacccctttttaccaacagcggcccccccagttttgtcgacgacaaccattggggctcattggtgttgctcatataccccaagacaaggatctacagaagcggctaacattatttattcccagagggagataacaggcgtactcaccagggcgaggtcaggtaatgtgtttcccataacacaacgagccatcgagtatctccaaagtatacaattattgtaacc

SEQ ID NO: 703684 - DNA, 717 bp, Homo sapiens
  misc_feature (571)..(571): n is a, c, g, or t
  misc_feature (633)..(633): n is a, c, g, or t
ggcagcgggctgaggcaccttcgggcaacacccaatactcggggctccgctcggcttcttcgcgccgaagatgcctaagaaggctggtgcgacgaccaagggtaaaagccagagcaaggaatccagagtagaccacttgcctctccttaggtcctgtggcagttgatcctaacaggatgctgtcaccatagctccatcgctatgcgagaatctggactccaaacaaaatgtctgtaacagattggagcagcagatggctgtaaatgtagctattgcatgcacctccatcatgagggaagaggcgtaatgctgagctctgtcgtgtagtctttccaaggtcctagaactcaggaagagtgatgtggtttgggactaagggtggtaaatctcgtgaaaaggtggtgaagcttttgggttctacaactccagaagagatcttggagaagatttaaaagaaggaagcctaaaaaaaacataaaagcaatgatagatgaggccgggccgcaggtggctcatgcctgtaaatcccagcatcgtttgtggaggccgtggtggagcggatcacctgagngtcaggagtgcgagaccaggcctgagcaatacggttgaaaccccatctctagaaaaatacgnaagattagccaggatgtgatggggcatgcctgtaatcccagttactcaggaggctgaggcaggagaatcactttgaacctgggg

SEQ ID NO: 703685 - DNA, 435 bp, Homo sapiens
cacgatgacgagtcctgggtgaagatctgtgggagagtgttgtggaataccacatatacccacagactggaagggaagagggtcttggctgtgtctggtttcactcataaagtcttctcattccccttttccttaagacacgaagctggaatgcttcttccttgggtgaaaagaaagggctcaggaccagctccctctcccctttgctatgtgggtcagctcgattctctggcccactgtagcggtccaaggatcagctaactctcaaaataggctcagcagccgtgctttgtcacctccagccaagccctgggctggcatgtctgctggctgctggaggggccctaattatatctgtgttgcccccccaggtagaagcagctgggacagagcacggctcctggcaatctgtggtgggctggaaggagtgcctca

SEQ ID NO: 703686 - DNA, 304 bp, Homo sapiens
gccggtttaagtgggttgtaaattttgggggcttaacccttttttgccccctttccgatttttttgactttgccccattttggcttttttgtaaggttgggcccactttttttttacaaacagccccttccccccccccgtttttccaccatccggaagggccctgggttttttgggtttttttttttttccaaggttccctttgtccaagggccctttccggtttttccccttgtttccgtttttttttggaaggggttcctttttgtcctttccggaaattaaaccccacccttttttttga

SEQ ID NO: 703687 - DNA, 602 bp, Homo sapiens
aggttacggcagaatacactcaacacggggtagtttcagcccaactgtaaacatcagtgcacatgtattgatggcgccgtgggctgattcctctgtgttcccaagaactatctctccccaacttgggctgtccaagcctcgggtggtcaaagttaccgggcagtgctgcgaggagtgggtctgtgacgaggatagtatcaaggagcccatggaggaccaggacggcctccttggcaaggagctgggattcgatggctccgaggtggagttgacgagaaacaaatgaattgattgcagttggaaaaggcagctcactgaagcggctccctgtttttggaatggagcctcgcattctatacaaacctttacaaagggcagaaatgtattgttcaaacaacttcatggtcccagtgctcaaagacctgtgggaactggtatcttcacacgagttaccaatgacaaccctgagtggcgccttgtgaaagaaacccggatttgtgaggtgcggccttgtggacaggcagtgtacagcaggctgaaaaagggcacgaaatgcagggagagcaagaaatccgcgaaacagtcaggttacttacgctggg

SEQ ID NO: 703688 - DNA, 406 bp, Homo sapiens
  misc_feature (5)..(5): n is a, c, g, or t
  misc_feature (49)..(49): n is a, c, g, or t
  misc_feature (92)..(92): n is a, c, g, or t
  misc_feature (99)..(99): n is a, c, g, or t
  misc_feature (326)..(326): n is a, c, g, or t
  misc_feature (354)..(354): n is a, c, g, or t
  misc_feature (369)..(369): n is a, c, g, or t
  misc_feature (376)..(376): n is a, c, g, or t
  misc_feature (385)..(385): n is a, c, g, or t
  misc_feature (396)..(396): n is a, c, g, or t
caccnagcatggcacacgtatacatatgtaactaaccctgacattgtgnaaagttaccttactgcataagccagtggttctcagcaaggagnaatgttncccaccaaatttgacaatgtctagagatcttccttgactgtcgtgactaaggagatgctactgacatcgagcaggtagaggccacagatgctgctaaacatcctaccatgcacaggacagcccccacacaaagaattacacacctaaatgtcaacagtccactgctgagaaagcctctataagctaacataagagaagagcttctctggttaagcaagtcaaggtgncggagagaatggagtgccttatgagagnaatacaccttgcagncacatgngcttccatnccatgtggagnccaccacctc

SEQ ID NO: 703689 - DNA, 1400 bp, Homo sapiens
  misc_feature (399)..(399): n is a, c, g, or t
  misc_feature (948)..(948): n is a, c, g, or t
  misc_feature (1108)..(1108): n is a, c, g, or t
gcaaatgaaggagagaagtataaacagatttctcaagcttactgaagttctctcatgatgcaatagaaaagggaattatatgacaataggaggagcaacaggcaagttaaacgacgggatggagcagggtggcgcgttttggcctcccccaatgggacatcttctgatactgtttggactgcgagcgacgcgacggaaggactgcaggaggagaacaggagacggtacaaatgcttgtacatcagctctcagtaaccctagaagacttatataatggatgctagcaagatagaactggcctctgcaatagagaactgttgcactttgctgaccaaaatgctgtaatggtacgaggaaggctacagtagaagcgagccacgtagacgttgtctgctcggncagactgggccgatgggtacctcggcatagtgccaaaattagagcaactttcatcgaagattaacggaccagtggtaattgggtttcaagtcgaacaagtacaggatcctggtgttagctgagtgagaagtgtgctcaagggacactaggctgtgggagcacgccggtattccaagggtcgctatacacaggaccttacgaatgttgatagagagagacgcttgctaaacggggaaaaggaggacagtaactaagaatttccggaatggaagcaagaaggcacaaaccaattttgctaaggaaacgcttatcaagtaacttgggcaacaagacgatgcgtctattggaacaaaaggcattggggactctgcacgaacacgaaattgagagccaattctcctcgattgctgcgttggacacaggggaagcaacgcgaaaagaaataccccctattggcgaactgtgcgcgaaggcccgcgaggggacggttgttaattgtacattccattctggggttggttatgagaaattccaagagagaaggggaancctcaagttgacggtggatccccgtttacctattcctgtaaagcggaacgtgggaagcgaaataggtaaacaaccctctatatgtgcccactgtgacatggtctaatttgggggacccacttaacgtagggctttccgtgtgtttggaacagagcgcacncttggttgggtaggtgccctttgtcccccatgtaccaagcgcccatatagactattgtgccgtaaaggcttgcgtcttggaaaaccagaaaggcccggtagaaacagcgcaattgggttcaaaggtgcgagcgctcttttccaaagtccccaccgcggcataccagcgcaacatttgggtgcccacgaggccattgtgcgcaggaattatgtcgaaaggcggtgtgtgttacctaagatgagtgaacacgggcgagtgtgcgccacaggtgtaatccgtgtataggaaccca

SEQ ID NO: 703690 - DNA, 384 bp, Homo sapiens
tgccctgctgcatgagagcagacctgtctccaaaagcaaaaacacaacaaaaactaaacactgatttgcacctaggcttaagttagtactatatccagttcggccaggccttggaatgagctgcaataacgacgttgtatggtctccttaatacagagctagttcttaaaaaaaaaatagtaatgcagacattcattctatcaagaaatcctggagtagctcttattgcccaggctggagtagctcttattgcccaggcgggagtagctcttattgcccaggctggagtagctcttattgcccaggctgaagtagctcttattgcccaggctgaagtagctcttattgcccaggctgaagtagatcttattgcccaggctggag

SEQ ID NO: 703691 - DNA, 306 bp, Homo sapiens
gcccgggggggacgtgggaggggctgcggtgggtgatgggtcggtgatgggaatgggtatcaggttgccggggagtttccactcttctctggtgatgttccttccgctcccgttcctctcccagccatgctgatgagcactcctttcaggccagctgtctgcagagccttcagttaccagttttgggtttctagagctgcctatcgtgtgctcgtttccgtccctgctgcgtggacttctacttgcgtcttaggagccgtcaccgttcacccaattaccgcatcgcagagtcgctttctcgcccat

SEQ ID NO: 703692 - DNA, 1444 bp, Homo sapiens
gctgccgcccagctgcgcagacagagcccatgtgtgagcaatgagaactggtgctgtgtgctggtgtggtgctcacgtgcctaggtgagtgcgctggagtgcatcttggcagatgtgctgggtctgtggcttggtgcccagctgtgtgtgctgctgtgagcatgtcatgtggctgcagtgtgtgtgcatgctgctgcactgtgcctgccatgccctgcctgcatgccttggagctttccttgctgaacctctgtgtggctgcccagtgatctgtgctgtgctggctgacgtgctacctgtgcttcaatggatggtgctgttgcttggatgaatgctgcatgctgtggctgtgtgctttgctttgcatgctttgttggacagctggaatgctggctgctgtctctcaacctgagactgcgtgtgcttgcatgcttcgttctgatgtgccaatgtgtgcactgtgtgctggcctgtgctccaatgtgatgctcacgcctttctgcgcctgccactcaactgggccctgttggcatgttgctggttgcgcagcgatgcaacactgtgtgtctgtgccggcatacttactttacaactgactttgtgttgaacccggacagtgcgcgtgctgtgcctgcagcgatacgggacatatcacggcttagccgccaccacttgggaacaggaattaccctgtgtctttgggaagacctgccccacggagttcacccgcgtaagggccctttgggtacaaatggttacagaatgataaccactgcaatgtgtcccaattcccaaggaaccatgtagcctgtgtggcgcccggtggcatgaatgccctacgagagaaccagggggagccccgttacggatgttcccttaaaaagcacagcctggggtggcggcaacacaaattcgttattcactttacatttgcccttaacgcgcgaaacaagccattcgatgttagcttgaagggtccaaggggacgaggacgttacggattagataaccccttaccttgggccttagattgaggaggagccacccggcgccttcggttagcctacaccaactagtttggcgaccaaaggtgctttggtgtacaaatgctgtgcccatttgtgggaacaccaggatttgtttgtgggcatcgggaacaagcggacgtgtcatgtgggtcacaggcccgttggtaacacgtgtacacacactttgcgcaaccgcggaaaaggtcccccattgtgggcgtacaatggtgcacaggtggctgcggcaccgagacaaacgcaggtgctatttactcgagcacaagcgatggggcactcctttgaacgccgacaattgtacacacgcacattctcagcagaggagccccaccatgtgtggcaacatttgtcgttccccccacggaacgatcacctccaagcgtgacaaccagttgtgc

SEQ ID NO: 703693 - DNA, 165 bp, Homo sapiens
atgctccgtgtgcaggcctgaggatgcactgagctggcctgcttcccaggacacttagggcacagaggcaggcagcgcctacagttcaggctcagtgagtgttgggagtcgccaaggcacatcccacctgcctgagccccgccctccagcagcgactgacagcgc

SEQ ID NO: 703694 - DNA, 146 bp, Homo sapiens
aggctcggctctccgactctctcctctgaaacctcctccacagctgcagccatcctcccggctcctctagtctggtccggcgtctcggtccccgggtttcagagacaacttcccaaagcacaaagcagtttttccccctaggggtg

SEQ ID NO: 703695 - DNA, 348 bp, Homo sapiens
cgacgacttcccctcccctgcaagccatcgcccgtgatcatcacgtagctcccgcctatgcgtgcccctgagctgtcgcaccgtgcgcgtccttcctccttcctctcccggctgccatgctgcccggtgaggcctggtgaggccacttagcctcttggttggccaggcccaccaggaagtcaccatgacatgctccacccgccctgttggcacactcaagcgggagtccacccctgcctcagtggtggcccagtctcggtttgcattcttttgcttttgggacgtgccctgggaggcaagggctgcgatgctgggacctgttgttgcttgcaaagccagaggtcccag

SEQ ID NO: 703696 - DNA, 149 bp, Homo sapiens
  misc_feature (99)..(99): n is a, c, g, or t
gtagcaagggtagcgatgagccgagtcttcactccggggcaccacctgcagaaatattggcccgacgatccttcgccggaatgaggtcacgtgccggtngcaatagtcagtcgacgcggccgccgaatttagtagtagtaggcggccgc

SEQ ID NO: 703697 - DNA, 614 bp, Homo sapiens
  misc_feature (340)..(340): n is a, c, g, or t
  misc_feature (350)..(350): n is a, c, g, or t
  misc_feature (510)..(510): n is a, c, g, or t
cagcggaacaagcaatcgtcctaccttggcctcccaaagtgccggggttgcaggtgtgaaccaccatgcctggccacctctatgtcttgttccttgcttttcttcttcctagaatgttctgctccaacttagtctcagatcaaagttaacctccttagagaacctccaaggttaaattagcaacccctcccatcattcttcatctcaccactctcttttactttctttttttcctgtttaaaattttctaattaataccaacatttgaaatgatcttgttcatatattaatatgattggattcttcctcagtaaaatgtttgttttttgagtgcagagantttactgtcntgttccctgctgtctctctagtgcctagaatagaagactcaatagacacttgttcagtgaacaaatggactttgcagggagaagattccaatggaattctttagatggtgggcagctttaaaagagtaaagaagtgtaggctctgtccccagggtctctngccaggaaaggatgggggacccctgtggaaagctgggtgagagctgcccctcagggcttatgtgtttcctgggcatttgggtttttaatggtttgcttggtttt

SEQ ID NO: 703698 - DNA, 665 bp, Homo sapiens
ggagagagaactagtctcgagtttttggtgttttttttttggagcctgtgcccaggctggagtgcaatctcagctcactgcaagcgccatctcccgggttcaaaccattctcctgccttcagcctcccaagttagcttgggactacaggcgcccaccaccacgccgtggctaagttgtcttggtattttactagtaaagacggggtttccactggtgtttgtgttagctcaggatggctcttgatctccgtggcctcgcacacgactcaggtgtcctaatacaccacatatttccgaggccgaagccaaatgttgggtgactcaggctaacatgtgacgacctcttaagtgggcgctggcagttgatgttgcaggacaccacggggagatgacgtgtagtgtgtcctgactccatccgtgacttccctggaaaaggatgggcagcaagatacaggacgaagggtctcgtccctccaagaaacagagcgccagacagctccagcagcccacagggggcctctagcccacagccacgcacacacggggttcttcattctacacacaatcataaagggtttgggcgcccctcgtgcctcccagccttgagcacaagccgtgggtaagccttggtacaaggaacccagacgctgagccggaaggggggt

SEQ ID NO: 703699 - DNA, 361 bp, Homo sapiens
tatttcaattcttaaaatagaacagaggaaatgaagtatatctataggctaggggagattgtcacgctcaagtttcacagagtatagatgtatcgacagttatggtccaaggcatatttgtctaagcttttacaaaaatgttctatttagtacaaatacatgtgtctttcactcatgttcttatgttgttaatctacatttcccatttgaagtcaccagatttttgggaattgtgtaccagatatggttctaaaacctttacattattttacatctgatcacaaatgtggtttagattctgttgcctataactagaaataacttcaacttgaacccttttgttatcagattaaaatcatgt

SEQ ID NO: 703700 - DNA, 277 bp, Homo sapiens
gacccttcctgaaaaggccaaaaatagccaagttactggtgcagaacaatgaagtgagtgatttgacctatcataattatgatagagacatgataattaagatggtgtgatatgagtattagaatattccaattcatcaatggaacaaaatggaaagcctagaaataaattcacacatctatagatggctggaataggacacaggttgcactctaggttcagtgggtgaaacatgggctttttaatcaatggtattaaaacaattaggtagccaaat

SEQ ID NO: 703701 - DNA, 128 bp, Homo sapiens
gcatttgagagagtttttgttagggaaaagagagagaaatgtgtagacttgagtttgagacaaatgtggccacttaacagctaaacaaatcagttaacctatttgagtttcccttctgtcgtcttctc

SEQ ID NO: 703702 - DNA, 711 bp, Homo sapiens
agcgggcggaactttccagaaagctcggtgagaggcggaggagcggtaactaccccggctgcgcagcagctcggcagctgattcccggtccctcacactacgcgggctcagctccgcaccggccagtcagaacgctggtgaaacgaaacaacgttaactacgatgtcctcgggcggtcataacccaagtgcgtactacaggacagcaattgacacaaagggctgtatagagaaactggccttgcaagtggaccagtcctggagtaagaacgcaaatgacaggagagaacgtttacatcagactttctctacagctgactgaacgtcctcgtctgatgcaaaagaaacagggacatcactactgacgacaaggacggagcaagcaggcaagttaaacgagggtggagcaggtggcggattcgggctcccccagtggacatcttagatactgtttagtcgggaggagagaggaacggatgcagagagaaaggacgaggtacacaactgttggtacaatcagtgtctgagtaaccctagaagacttactataactggtgcatacaaggacgacctggctctgcaacgagaagtgtgattcgtgagcacactgttgacggtagaggaggtaacgaacaggacgcggtagagttgctgatcccaacttggccgaggtacttggccatgcacataagcaattgcttcacaataggcc

SEQ ID NO: 703703 - DNA, 86 bp, Homo sapiens
gcttggttccgagcgtcccgggagccgggaagggaaggattgtctgcagggattggagcaaatatccagtggggggaactcctcct

SEQ ID NO: 703704 - DNA, 822 bp, Homo sapiens
tgcgacaaggccgacgagtcggtgtccatccgggagttcccccctatgggccccacgtcgagcgggtttcagtaaggccattgagtggcgttgaccacatccccgggtgtcgggaccccagcgaggggtttctggacagccactgtcccgtgttctggccataagtgattatggcgaccacgtgggcagccccagaaagtgctctgaaccctattctggttcttaaggggtgcgctgagtcataacttgatgttttgctccattaaactctgttaaaattagtttttcttttcgttaactattctattcatagcttttttttcttttttcagagaccagtctcactctgttgccccggctggagtaccatggcacgatcatagatccactaccaaccctggactccccggctcaagctagcctccccgcctcagcctctgagtagcaaggactgttgcccatcatgcctgggtaatttttgtatttttttgtagagataagggtctcactttgttgccccgggtggagagccatggctattcagaagtatgatcattgcacagtacagcctggaactcctagcctcaagggatctttcctccttggcctccccaagtcctgagattttaggtgtgagctaccacacgcggccctattcatagcttttactttcgtttgtaattgtgcatttgaacagtgcgttattgaatgactgactttcacactagtctggaagttcctttatggcagacaccttgttttcctagggtttagcaccctgactgtcaccaagaaaacatgccataaatatttaatgaacca

SEQ ID NO: 703705 - DNA, 885 bp, Homo sapiens
gccgtcacgatggggcgtctgtattaaacaccgtgctgaggggttcctatgctatctctcttccgaggttctcacagagttcaggttcccctccagatcttgcaccaaaagctccctctgaggaagcttcttgtcctcagttcccatttctccttataaggatgagccctggcaatctctggaatcagaagcataccaggcgcgatatggttctcgccccgtctgggctgactaccgccgcaccacaagggtggtgtacccccacagcggactcggaagcacatgtattcgtcggactacagttgtgcgaatccctgcccatctgtcgagatcccacgtcgcatgttgactttaggaacgtgaagctctgtggagcaattgtctggcccaaagggtatcatcttctatgctccatacaccggcgtctgtgtgccgcagcacacgcggttgaccaaggccatccagaacgccaggctcatggtctcctcatttaccaaatccccaggttgcccacggccaccttgattcagtacctctcatggggctgtgcgtgctaatccgccacgccccacctgctctcagttgacccgtgtaccatgtaccccctgaccagcaccgccgagacgactggtcgcttccgcggtttcaacgcttctttcacatgagcggcccactgtgtatgccagtgccctataaacaggactgctttcatgcgacagccccaatggctgagactgcttgcaacgcaggtgggtcctctgacccgttgacgacggcgtctgccgatggcactggcggactcttcacagaaccacattggcccatctaacagggcgcaaatcaacatatgacaccggcccctgacacactgcaactcacatcccg

SEQ ID NO: 703706 - DNA, 714 bp, Homo sapiens
  misc_feature (230)..(230): n is a, c, g, or t
  misc_feature (233)..(233): n is a, c, g, or t
  misc_feature (244)..(244): n is a, c, g, or t
  misc_feature (305)..(305): n is a, c, g, or t
ctctcaagtttgtctttctgttttgtcctctttgatttccatcttgatagaaagtttatgatactcaagagaacaaattgccccttgacagggtgtcagaatcgattgtactaagtcacgcacctttggcagttcaaccgtgttcctaatagttaaaaccataacccattcgggaggtgtccacaccgtcccttcccatccttccagtttgccccacacaactggggctntgnatgactggacnggtacagggaagtcagccaacacgatgccttgggtcacttcacctctcaaggagattattntcatcaaccttgtcttactaatgaggaaactgaatcacagagaggttaataaactttcccaagttcaaaaaaaaaaaaaaaaaaaaaaaaaaaaaatttgggggccgccgggggcccggaaaaggtttttaaacccttttcggtggggcgcggggccccagtttagtgtatctggtagacacggggccataacgcggggtcaccaaggagaaccccggggcacagagaccagaaggtgctcgggttttcctacacatattgaaaaaaaagcgccccgggggacaaaacccgagatgtttccgggaacaaatccccaaatgggaagtccagagagacacaataacggggttctaacacacacggggagtcacaaagcaaatccgaattcaatttagccccctctgggcgg

SEQ ID NO: 703707 - DNA, 413 bp, Homo sapiens
aggggggttaggggtgtcttgtttttcagttgtcctgttttgtatgttatttttttttccctttgccttttttccctttaatttgaagggaatgggagaaagtggggacaggaaggtggaagtgtgactttggttaatttttttagctcatttccacgaggggggccggcccccctttggaattgggtgattcacacaattgcaatagtgggtcacggcattttaacctgaaccaaagttaaacccggtgttgccaccatgcacaatggcttgccagatttcaacactgttgctcttgaaaatcggggtctgaaaaaacgcacaagagcccttgccctgccctagctgaggcacacagggagacccagtaaggataagcacagattgatttgtacaatttgcagatgcagatt

SEQ ID NO: 703708 - DNA, 180 bp, Homo sapiens
ggtgcagaggtgctcttgggtgcagaggagcgcgtgcgataatctgcgtgcgatcgtcgataactgtctatgcgaagaccgacgcagccatgagtacctgcggggggttcactctgtgccacaaacgagcgaaccggtttaccaagggagctcgaataactgtcgcaccgtctgcacagg

SEQ ID NO: 703709 - DNA, 195 bp, Homo sapiens
gcggccgcctactactactgctcgaattcaagcttctaacgatgtacggggacatgcctgtaatcccagctacttgggaggctgaggcaggagaatcgcttgaacccgggaggcggaggttgcagtgagccaagacagtgccagtgcactccagcctcggtgacagcgcaaggctccgtctcaataactaaaaaa

SEQ ID NO: 703710 - DNA, 115 bp, Homo sapiens
ctcgagctggtaccctatactgggtccttgaatttccacacgaattttaggatcagtgctaatttctgccaaaaaaaaaaaagcaagctagaaattctgagaaagaaactggctt

SEQ ID NO: 703711 - DNA, 565 bp, Homo sapiens
  misc_feature (11)..(11): n is a, c, g, or t
  misc_feature (44)..(44): n is a, c, g, or t
ttcattccagntccttggaagccagatagaagtttctcttaaanctgaaggacttcttaccatatgatccagtaatgatactccttggtatttacccaaatgagttgaaaacttaacacacacacaaaaaaaacgaacccacacatggatatttttaagagtttcagtcataattgccaaaatttgaaagcaaccaagatgtctttcagtaggtgaatggaaaaataaactgtggtatatccagagagtggaacatttttcattgttaaaaagaaatgagcaggccaggcacagtggctcatgcctgtaatcccagcactttgggagttcgaggtgggtggattgcctaaggtcaggagttcgagaccagcctgaccaacatggtgaaatcccgtctctactaaaaataaaaaaactagccgggcgtggtggtgggtgcctctaatcgcagctactcaggaggctgaggcaggagaatcacttgaacccgggaggcggaggctgcagtgagcagagatcacgccattgcactccagcctgggcaataagagtgaaactccagctc

SEQ ID NO: 703712 - DNA, 847 bp, Homo sapiens
ggtcgtcggggtttcctgcttcaacagtgcttggacggaatcccggtcgctcgttccccaccccggacgcgcgtcgcatagccagccctccgtcacctcttcaccgggacccgtcggacggccccagaggcccccgtgcgagcgacgtcacgagactgcgcggcggctagcccacgcgcgcagcgcgctcgccgcgcatcgtccgtataggtcgccgccatgacgaccgggtccacctcgcaggtgcgccagaataccgaacaggactcacgaggcctgccatcaagccgccagatcaagctggagctctacgcctcctacgtttacctgtccatgtctttactactttgacccgcggatgatgtggctttgaaggaactttgccaagagtactttcttcacccaatctcatgaggcagagggaacatgctgagacacagtggatgaccgctgcagagacctaccgaggtggccgaaatcttccttccaaggatctcaagaaaccaggactggtgatgactggggcagagcgcggctgcaccatgcaatgggccgtgtgtgcactttaacattgtgggacacacatcccattggtgagatcgggctcacttaactgtgacacctggcacaaatcttggggctactgaaccagaaattgacccgccaagtatggttgtagacctaccacttggcagagatccccagtttacccctgcacttgagcggccagggtcaaaaagggcgatcccatagcgaacgttcggcggtggacccaccgcgatggaagcaaactttgccgtcgcgcaatgtgtccctccgccaccgcatgtaaaacaaacaaaccaat

SEQ ID NO: 703713 - DNA, 803 bp, Homo sapiens
agcggaactgctcccagtgtcagtattgccccaggtgagcttttcaaacttgacatgatgcctactcatttctttcctcttgtgctaatagtcctagagcctcaggctgacttctctagtgtcctgtaagtttcagttaatgtaacagaaacctcttctccaccctacacacattccttctcttttctttttctctttctttttttcgttttttttttttttttttctttaaaaaaaagaacactacggcggaatctcaactctaaaaatcttactgggacacacacctggaatcttaagcattagggaacgtcgaatcggggactttttccggtcttacacattcaaagctcctaattcgcatgtacggctaccttcttgggaaataggggacggtcctcttggacactccgtgcaaaattagatgggccgggccaagtctcggatataggggggacgacttggggaagtgcccccagggttgtccgggattgacctgtaaattgaaagggaggcgggaggacgaagaagggatgtggtacccttttcggggcactcatttaacacagtggctctcccgaattggtcagtacggggacactcgtcctgagatacagttatctatcccttttggacacggggcttggacctggggggtctccatcggtgcaacgggggatctgatacccaccaaacagctccatttcgccatgcctgctggtctcgagtatgtctggatgcccacggccacgggggtcccacaaagagggcaaagacctcttgaagcttggcctacagactag

SEQ ID NO: 703714 - DNA, 289 bp, Homo sapiens
tggggtatgtggtgactgtgccctgcccaggtcagagggcaggctggcgagtggggcggggccaccccgtcgtgcctgacactgcgcctgcacccgcgtccccacagggagccgccccttcactcacaccataagtggaccgcgggccgagccccaggaggtggtggtggacaggccaggaggggcgaggcgggggcatggggaagcatgtgctgaccagctcaggccatctctccactccagttccctcaactccacctacccaatctccctcacagtcaccactaca

SEQ ID NO: 703715 - DNA, 818 bp, Homo sapiens
tcttctcctcctcctccttggcattcgctcttcttgctcctgcgtcttccccgctgcctccgctgctcccgacgcggagcccggagcccgcgccgagcccctggctcgcggtgcatgctgcccgggggggctgaaggatgggagccgtgctccgcctccccgggactgcggtgtgcggtgtgtctccggctcgttcgggcgcctgcgtggagcgacgacggcacccggatgtagccgctgtaccgggagcctggactgtgcccagaagaggcggagcaaggtgtcctcctggtgcacatgcctgtgggacatgccttagcccttccaggaggacagcaacggcacatggtgccaggatgcgcagaccatccaggcgggggcagacccagccaactgaagaagagatgacttactggccagagaagttgcaccgaaagggagtctggacatccacacacagacactaacacaaggaacaaaaagcggcatcacggaaagactagcaacaacagggattcaatcggaacggggcgacagggaacttagaagctaggactcccaacaagccaaagaaaccaaggcagaagccaaaaaataaaggaaaacacactgcgacatcagaccagaacaaatgagacacaaagaaaaccggcaagagacctgaaacaacacaaaaacaagaaaaacaggaacaaagagaagacaaagaaaaaaacaaagaaaaagaacagaggaaaacagaaagaacacaacgaacaaaagcaaaaaaagaagcacaaacaagagaaaaaaaacaacaaaaaacaaacagataacac

SEQ ID NO: 703716 - DNA, 370 bp, Homo sapiens
gtaagaccaaggggtatccttgccttcgaagatgtcccagtcttatgtgattagggaggctaggcagggagtgggtatctgcagacattagatgtctgtagatctggcagtatttgtctagggtgccaagtactgctctgtgagggtgggcacgggaggaggagtggaaggtggaaataagtgtttggcaaagtttttggactcccaggttaaggccccaattctagaccctccagctcagcccttcaggtttccctagagttcctgattatatatccttcaggaattcgccagaaatggaatttaaacagttcttaattatcatcagtgatgccaataatttcaatttaaactttccccaatctagaaa

SEQ ID NO: 703717 - DNA, 351 bp, Homo sapiens
gtctgattgagtccaaaactcagatacagaataaatacttgttttctattattcagtttactctctgactgagatcacatcctactataatgacagaaagcatgatctcccctcctcctaggtttcgggtctgggcttgtagcctagtttcaagctgttaaaggtttgtgtcataatccttagtctcattgggcccaaggcttccactgacatcctcagcatctctatgtgcttaatctttcaaattcccattgcttcaaattaaatattcattccactttgggacaaggcccagacatactacaagcgatttccatccagaatatctgtctctctgtcacatatcctggc

SEQ ID NO: 703718 - DNA, 246 bp, Homo sapiens
tgaggatatttaacagttaattctgactgacacccatatggcggggaccttgaaaggtcattggctccacgaaggctgagcccattcctttttatatagtatagagacgcataccctccagactgacttaagactcagtttcctttccagtgaccggaccagattaactttgatatgtctcacggcgattcatattattagatataatcatcctctgatacgttgctatgcctgaatatcctcaca

SEQ ID NO: 703719 - DNA, 192 bp, Homo sapiens
aatggagtttaggccagtcggggtccccaaaaaaaatccccccaaaaaccccccaaaagggagaaacggtccccccccccgtgctggaatgacagcttttttcctgctaggcagttgggccttttccgaattttttccaatgcccataaatttggacttacatcttttaattaaaacccccgccactccgga

SEQ ID NO: 703720 - DNA, 659 bp, Homo sapiens
agaattttgaaaccttttatttatattttgggcctaccaatgggcacttttaaatgggcctttctgtcagaatgttaaactcaaaaatttgcccagtttgttttttatccacacaaaatcctagaaagggtttctgggtagtcttcattaacccaaatctttgggaatgtttcactcttactgtaggatcttgaatatgttttacaataatgaagcttccaagtttttatgccgtgcattcattgtaaactattaattacatttgttttaaaaagaaagctgggttatacaaaaataggagagacttttgggagcaggcaaatctgttgaggctcagtatatcttatttgcttttgagactggtgtcattcctttaaaagagcacacagcacatgaggcatagtaatcatctgtcttggttacctctctaattagaaatttgtgttcgtaaaactggccaattttcacaaactttcatttgcattattaaccgcaggttttttccaaaacattttgttagtggtttcaacaaatgccggagggtgggcatttattaaaaaggggttttggtaagcttgccaccttcttaaatttagggctattctggcttttcccgatttaattagatttttaaggccccaagaaaagacctgtccatg

SEQ ID NO: 703721 - DNA, 209 bp, Homo sapiens
atttttgggtcccgttatattatttaaaaaagggttcctttgtaaaaattgtaaataaagaactgtatagtttcccctgttttcatcttgggggtggttattgcttaaagctttttaaacttggacccccccctatggttaaataaggtcttaaaagaaatgtaaatattctgttaataaagttaaaaattttaatgatttttttttta

SEQ ID NO: 703722 - DNA, 875 bp, Homo sapiens
  misc_feature (1)..(1): n is a, c, g, or t
  misc_feature (176)..(176): n is a, c, g, or t
  misc_feature (243)..(243): n is a, c, g, or t
  misc_feature (286)..(286): n is a, c, g, or t
  misc_feature (296)..(296): n is a, c, g, or t
  misc_feature (299)..(299): n is a, c, g, or t
  misc_feature (323)..(323): n is a, c, g, or t
  misc_feature (336)..(336): n is a, c, g, or t
  misc_feature (369)..(369): n is a, c, g, or t
  misc_feature (382)..(382): n is a, c, g, or t
  misc_feature (384)..(384): n is a, c, g, or t
  misc_feature (386)..(387): n is a, c, g, or t
  misc_feature (389)..(389): n is a, c, g, or t
  misc_feature (433)..(434): n is a, c, g, or t
  misc_feature (437)..(437): n is a, c, g, or t
  misc_feature (444)..(444): n is a, c, g, or t
  misc_feature (464)..(464): n is a, c, g, or t
  misc_feature (471)..(471): n is a, c, g, or t
  misc_feature (482)..(482): n is a, c, g, or t
  misc_feature (499)..(499): n is a, c, g, or t
  misc_feature (503)..(503): n is a, c, g, or t
  misc_feature (507)..(507): n is a, c, g, or t
  misc_feature (709)..(709): n is a, c, g, or t
  misc_feature (867)..(867): n is a, c, g, or t
naaaccaactatttaaaagtatcaaacttttaaacagttctttttccattctgataaaaaatgttataaaatcaccatactccattcatgtaccttagatgccttttaggataagacctcaaaaataattaacctagtctcaaaaatccattcaagtccaataacaaacttttaanaacccacttaaaaagacttgacactagaacaagtatacataatcagaacatatactttatatatttngtaatgtgctaggttttctcttacctttgtgatttgggatttnttggcggggnttncacacacacacacacatatatatnactaagagggggnaaatttcggcgaacaaatgcgaacctgtggggngggtgggtttttnananngnttcggtttatcagatttcgtcttctctgccgttttgggttggcnnctnttggttntttggggggtttgggctgcngggagtncatttcttgcnccttgggtatgtttggnttcngccnggcttccggttgtgcccgtagcttccttgaggtcattttccactttctcctctgtcactagatatcgtgcgtaagatatttatccttgatttggaaaagcctaaataaaaagcttcagttttgaccttttaatttataaaactccactggggaatccatttaatttttatgcatgtccacaaaaatattttctttcttaggnatcaaacacttttattgggataaagatccttcaaagtttttaactcttctattagagttttattttgattttccaggactgcaactcggttttccaggcatttcacatattctttcttcttactgcgacattctcgagcagcttctctgtgtttcatnaccttatt

SEQ ID NO: 703723 - DNA, 607 bp, Homo sapiens
  misc_feature (16)..(16): n is a, c, g, or t
taccgctattaggtancatatagaacccgttgggtttaaacaacggctgtcggtcggaattcgggatgcgcacgcggagacaggtgttgcggccgcagcgccgcgcgctctctcccgagtcggagcctcggcggcgccggccaggaccgctaggagcgcaggagccccagcgcagagacccaacgccgagaccccgcccggcccgcggcttctcccgagcaagcaaaccgccaagtaaaatggattgggcagctgcacatctggggggtgtgaacactccacagtgaaaatctggtcacgcctcttcatttttcgcattatgatcctcgttgtggctgcaaaggaggtgtggggagatgagcaggccgactttgtctgcaacaccctgcagccaggctgcaagaacgtgtgctacgatcactactttcccatctcccacatccggctatgggccctgcagctgatcttcgtgtccacgccagcgctcctagtggcccagcacgttgctaccggagacatgagaagaggaagttcatcaagggggagataaagagtgaatttaaggacatcgaggagattcaaaccaaaggtccgctcgaaggctccg

SEQ ID NO: 703724 - DNA, 102 bp, Homo sapiens
agacatgtagcgaaacaagaacatatggaaagctcgaaccatgaaagtgtaataaatctaaatgaggactgggtgcagtggctcatgcctgtaatcccagca

SEQ ID NO: 703725 - DNA, 565 bp, Homo sapiens
agtcaataaatgtgatataccacataaacagaactaaaaacaaaaatcatgatcatcccaatagacacagaaagagcatttgacaaaatccagcatcactttatgattgaaatcttcagcaaaatcagcctagaggggatgtaccttaaggtaataaaagccatctatgacatacccacagccaacactatactgaacagggaaaagtggaaagcattccccctgagaactggaaaaagacaaggatgctgactttcaccacttctattcaacatagtactggaagtcctagttggagcaagcagagaagagaaagaaataaaggcatccaaattggtaaagcggaagtcaaactgtcactgtttcttgatgatatgatcgtatacatagaaaaccttaaagactcatccaaaaagctcctggaactgatcaatgaattcagtaaagtttcaggatacaaaattaatgtacacaaatcagtagcactgctataacccaacagtgaccaagctgagaatcaaatcaataactcaattccttttacaatagtaccccccaccaaaaa

SEQ ID NO: 703726 - DNA, 222 bp, Homo sapiens
  misc_feature (118)..(118): n is a, c, g, or t
gcttgaggcatgggtggctgggctagacagacagtgttgtcagcaccacccaccctctcaggagacctggatgtcggagagggacagtgagggagatgagagctactctgtgcctgtnagtcaggctgcccacctggcagggaggggctgtgggagcagagctgtgggagccagggtgccggctaccctggggttagaagaggatgttcggagagggagagg

SEQ ID NO: 703727 - DNA, 222 bp, Homo sapiens
ttcaagtcgagattctgttcctgcgcctagactgacactgaacaaaccctcccaaagcgattgctgagtgttagtgctggttgctgtgtgcaatgtgtgctgtggtggactccaaaggtgagagtgcatgaagcacagtcctgtgacctactgtgcgcctgattgtccctgtgctgtgggactcctcatagatgtctgacacttgcagtgctatgcaaatgc

SEQ ID NO: 703728 - DNA, 427 bp, Homo sapiens
  misc_feature (34)..(34): n is a, c, g, or t
  misc_feature (191)..(191): n is a, c, g, or t
agcagacacagaatgaccctggagctttgctttntattgaccccttttgacggcaataggtgcccacttgctacaaggccccctttactgtagctcacccagcatctcttttcccaaccagagcgcgccaaactagcttcatatattacctccctattcttcccaaacccaacaaacaacaaccaacaaantgacccactgcactagttattattacatattcttagtcttttttgtacatggagactcacgcttaacatggtttatacaataggttatccctccatttatattgcagaataaatattaacaagcctgttccagagactcccaagcagcctgggcaggcagatgtaccattgttagtggtgtatgctcggcctcgtggtccatatattctgcactttcatatttgccaccagaatgg

SEQ ID NO: 703729 - DNA, 245 bp, Homo sapiens
aaaactatagataacacattatcgaaacatgaagcaactatgtcattgacaagagtgagaggtataatgcttgcccacacagatcagatgggtcatataccctacatatactatgcttatcttgcttacttagctgtctctctgtgattgatggtgtaaagtatcaggtaatttagccccagtcggacaggctatcttcaccgaagcgccgcacataatgtcttacgtacgacgatagcacacac

SEQ ID NO: 703730 - DNA, 190 bp, Homo sapiens
tttcagatatagggtgtgctgttcctcagctacaagatagtgcctgaggacgatcatcgatccaatgaatctgaaggtatactgtgttatgattgtgcgactgaatacacactggtgactaggatgagccagatggtgagatcctgtcccttaaaagcgtatctgctgctctgaatttggtattttaaca

SEQ ID NO: 703731 - DNA, 792 bp, Homo sapiens
  misc_feature (27)..(27): n is a, c, g, or t
  misc_feature (74)..(74): n is a, c, g, or t
  misc_feature (89)..(90): n is a, c, g, or t
  misc_feature (98)..(99): n is a, c, g, or t
  misc_feature (132)..(132): n is a, c, g, or t
  misc_feature (135)..(135): n is a, c, g, or t
  misc_feature (158)..(158): n is a, c, g, or t
  misc_feature (166)..(166): n is a, c, g, or t
  misc_feature (215)..(215): n is a, c, g, or t
  misc_feature (217)..(217): n is a, c, g, or t
  misc_feature (258)..(258): n is a, c, g, or t
  misc_feature (264)..(266): n is a, c, g, or t
  misc_feature (295)..(296): n is a, c, g, or t
  misc_feature (334)..(334): n is a, c, g, or t
  misc_feature (399)..(400): n is a, c, g, or t
  misc_feature (434)..(434): n is a, c, g, or t
  misc_feature (457)..(457): n is a, c, g, or t
  misc_feature (491)..(491): n is a, c, g, or t
  misc_feature (507)..(507): n is a, c, g, or t
  misc_feature (654)..(654): n is a, c, g, or t
  misc_feature (760)..(760): n is a, c, g, or t
tacagtttaatatagtatctatcttgnatccagcttcattgaagtaaactgaatttaaaattaaatacaaaaanaagaaaaaagtaaanntgcagaannctctaaagagttgttggacggaaagagaaaaanggngtttcatttgtattctctttgcnagatccangcctaccgcaaggtcacagcacagttttgtatagaatgttgcagaaaanangatggagaagccactactgctgctatgaaggagtgaggggngcgggnnngggggtcccacagaacctgctttaaaaannctgctgctgaacactggccttgaaatgaacaccagganaatctgtgtgtgatgggagtgagccacctcagatgtggagggccctgaagaatccatataaaaannaaggctcttcacttcctcttcttccttctctctncctccccaccctcagaatccaanagcagtcgtttgcaacagaaattttttttttttnaagaaataaagaaaanagtgacttatcccgctacccaagcgtgtagagccgcgcgctgtactgcttccgatatgtgccacagagcagcaacgagaagtggacagagccgcaatggttacaactgttagaggttatttcttaaaagataaagaacacctaaggnctgagtctcatatgctcttttgagcatttctacagcatgcgattctaagagtaaacccacccaatatggcaaacaatcaaaatttttaaaatttaacttagaaagnctgagatcattattttcaaaacattgatttgt

SEQ ID NO: 703732 - DNA, 361 bp, Homo sapiens
gtgcggtgcaggttatatcaccatcgatgaccatccggtttgagacgccatgcatgtcgatactgctcacttgcctcctgcaatgccctctttccttgtccaccttccccaaccttcgaataagcttctgcccgcagggggttctgtttcattgccagagtgctaaagtgagccgatctgtccagaccttcgacactggaagtgtatagatgcaccgtactaaaaagcacaccagtatagtctggctctatgtatccagagctgctcatgcagtgtctctcagatggctcacaatctcctgcctgctatactcgatgtgccaactacgatacaccttggaaggacagcatacgtaacgaag

SEQ ID NO: 703733 - DNA, 392 bp, Homo sapiens
atactagaggatccccctgcttgctcaggtctcccagagtgttgggattacaggtgtgagccaccatgcccggccccaacatgtgcttcttaaaagtccatttgtggcctggcttggtggctcacgcctgtaatcccagcactttgggaggccgaggtgggcagatcacgaggtcaggagatggagaccatcctggccaacatgatgaaacccgtcgtctactaataatacacatgattagccagacatggtggcgggtgcctgtaatcccagctacttgggaggctgagtgcaggagaattgcttgaacccaggaggaagagattgcagggagctgatatgcaccactgcactccagcctgggtgacagagggagactccatctaaaaaaa

SEQ ID NO: 703734 - DNA, 135 bp, Homo sapiens
tcactcacaggtgaacagcaacagttgactccctaagtgaatgcagacatagaccagagacgcctgaacactctgaaccaaagaccacggagttttctcagagggagcaccttcttcacactcttcccacaggca

SEQ ID NO: 703735 - DNA, 503 bp, Homo sapiens
taatgcctattctgcatctactagcataattgtgagtttttgtcattgcctctgttatatttcgtgaattacaattaattgatttgcttatgttgaaccagcctctgcatcccagggatgaagccaacttgcatcgttgtgcataaactttttaatgcgctgctggattcagtttgccagtacattaatgaggattttcgcattgatgttcatcacggatattggcctgaaattttctataagttgttgtgtcttagccaggttttggtatcaggatgatgctggcctcataccatccgttagggatgagtccctctttttctgtcgtttggcatagtcttagaaggaatggtaccagcttctctttgtacctctggtacactttggctattaatcagtctggtactgggctttttctggttggtgagctattactgcctctgtttcagaacttgttcttggtctattcagggatttgacttcttcctggttgggacgatgta

SEQ ID NO: 703736 - DNA, 723 bp, Homo sapiens
gtattaattactacagtgatgataccactcaatagggcatgccactactttgcttaagatgctaattatgaagcagtgctcacaggcatgatttaactagcaaattagtagatggactttgggggtctgtcactggtggaacagtatgtaagacttgaatttctattagcaccacagtctgcctatcaggtaagtacaccgtaaacagtatgtttctcaggagcccagaagcagttcagtttcgaacagaagttggcagactgcgaaaccaggtatgtattacgtaagcgctctgggtcaaagattaggtgtttaatattaagcacgtagttctggtaaatatttagaagtctggcattgtagaacacaaaagccttggtacctgagctagatatgtttcattgttaagcagaaattgagctctctggttcaagcgtgtatttgacacagttgtggctctttatatttatcgcgtagcaatttactatttattctcattccctcttcgatctcactcgcaacaacgtgtccttgcagtgccgcttggcatctggcgacttcacgcatgttgtgcaactgttacttgctctctttgtgcccgaaaaataatcgcttccaaaaatttaacgcatggttcccgttttttttcgaaagccggttaaagctaagggggggttaacgggggttggcccttaacgggctcctttgggggggccacgaatt

SEQ ID NO: 703737 - DNA, 550 bp, Homo sapiens
acgtagccgagagcagctcagtactctaggatcctcagtttctttgtagcatctttatgtccatgagtacccaatgtttaactcccactaataagtgagaacatgcggtatttggttttctgttcctgcactatattgcttgggataatggcctctagctgcaaccatgctgctgcaaaggacatgatttcattctttttatggctgtgtagtattccagggtgtatgtgtaccacattttctttatccagtcctccattgatgggcacctaggttgattccgtttctttgctattgtgaatagcactgtgatgaatatacgagtgcatatgtcttttgggtagaacgattcattttcttttaaaatccaaactccttaatacagcctagatatcctatatgatccagctctgctgtcgtctctcctcccatgtaactatacttgctttctctcctttctataaacacacaaattcctgttcctgcctctgggactctacccctgggaattcccactagcatccccaaggatggtagtgaggttccatcg

SEQ ID NO: 703738 - DNA, 423 bp, Homo sapiens
gcagaagggtaaggatgaacctctccctcctttgccgctttagctttagctggcaaacaaacctgctctgtaacctcttctgttacttcgttatactccccttcctcctcatcatcagtgtgggttccaaggtggaatgaaccagagtccacccttgtcccattgttaccttgatgcctccgagctccccttcttactgaccatggggactgctttaagagtactcgggtgtcctccagcttagttccacgttctccaactgtcgctctggtgatccttcgacctggattcgagcccccacgtatgggcgctgcttgccgagaccagcttggtcagggagacactaacccagtggtgctagaggaattaaagacacacgcacagatatagaggtgtggagtgggtcagggatctcacgccttc

SEQ ID NO: 703739 - DNA, 282 bp, Homo sapiens
ctggcggatcccccagcggaacatgcaatctcgagccatttctttaatctggtggtgagtgaaactggggcactccatctgctaagggtagaacgttgtcaggagagtagctggtgataatttcctttagacgttcttccatctgagctgtagcctttgggaacctttctttgtagacatggttcatcataattatttcatggtcacagcaggcgggagaacgtccagggctcagacttcgggaacgggggcgcatcggcgagttcctgcatctgttctcag

SEQ ID NO: 703740 - DNA, 375 bp, Homo sapiens
  misc_feature (128)..(128): n is a, c, g, or t
  misc_feature (173)..(173): n is a, c, g, or t
  misc_feature (326)..(326): n is a, c, g, or t
  misc_feature (337)..(337): n is a, c, g, or t
  misc_feature (365)..(365): n is a, c, g, or t
ttcaattcataattgttggtgcaaaagatttgcttgctatggattcaaatggtctttctgatccttacatcaaaatcacaaatctttctcaaaaaacgaaagtgattaagaaaactttgactccaacnttggaatgaaactttttttgtgcattttccagaaaaaacaacccnttgaattagaatgttgggaccacgatactttttcagatgattttattggcaaggcttccatttctttggcagagattccagctttggcagaagttgatatgtggatagatatgaaaaccgaaaaaaggagaatttgcaggaaaagtgaatgtnaaatttattanggcttaaaatccagcatatttgtttganataatttatt

SEQ ID NO: 703741 - DNA, 599 bp, Homo sapiens
  misc_feature (62)..(62): n is a, c, g, or t
gtgggagtagtgaaccccattctcgccagcccgccaacgttgggtctgttggagcccaaganggagaaggaagaggaggagctgtttcctgagtcagaacggccagagatgttgagtgagcaggagcacatgagcatctcgggcagcagtgctcgccacatggtcatgcaaaagctactcagaaaacaggagtctacagtgatggttctccgaaacatggtggaccccaaggacatcgatgacgacctggagggagaggtgacagaggagtgtggcaaatttggtgctgtgaaccgggtcattatctatcaagaaaaacagggcgaagaggaagatgcagaaatcatcgtcaagatttttgtggaattctccatggcctcagagactcacaagccatccagccctcaatgggcgctggtttggtggtcgcaaggtggtggctgaagtgtatgaccaggagcgttttgataacagcgacctctccgcgtgactttggcctcatttcctggacttgcacttgccccttccttcctttgggttttgtaaagtgttaaccgtggtgtgtccctgggaccaggcactctgcccaacccaccctg

SEQ ID NO: 703742 - DNA, 479 bp, Homo sapiens
  misc_feature (40)..(40): n is a, c, g, or t
  misc_feature (359)..(359): n is a, c, g, or t
  misc_feature (376)..(376): n is a, c, g, or t
tttgcaacaatagtgataactgtatataattaatttatgnacgctatgattttaaatgtgttagctaatgatttggactggtaataccatttaattatacacatttcacccgttaaaaatagtactacacgagacattaacagaataagctgaatataagcgggcagattaaagaacttttgttgagggccgtaaaaattgacagtacagatgccagattaattggccaactggctgctcagcggggtataccgcggcaacgctgggccccggtaagcaccggccgcgcacccgctatgcgcggatgtagcctgcctagagctgttgcactagggggaccctgaccccggacaaatttnggggggcattaatacanaagcgcgactgagtacgggagaaagacgtaggggacgactaaaaatagcggcaactattgaacagcccacccccagcgagccgaagaggggcgggttgcggag

SEQ ID NO: 703743 - DNA, 1242 bp, Homo sapiens
gtcaggtgactgagattctggcgcagtgtcaggtcagaaagggggcttgggctgtgaaagatggcagtgtgctggagagtgaggcaggggtggggtgggagcgagattgtctgcccatgagtgacctgtgctctgtggtgacagttcccagtacaccatgtatacctgtttgggacagtcttgcctctagcctgtaaccaggctgcctgtatgatggctgccctgtggttcctgcatagatggcgctcccttctccactcatggagaaccatgggtgcagatgcagtgtgcttgtgcccttgtgcatgatggatctccttcaagttgaccctgattccgcccattaccagcgcatgcagccgaaaatgtatgagtggccatgccaatatcttggtgcccctgagttacccaagtcatgtagggaaatgtggacgatccatactcacgcgaccagtgcatggccccattgggagggctgacctggtgcatgaggatccaggggagggccagcggacaaggggcgcctgagccgggtgatcacctaggagcgtggaacaggcaagggtctgacgaaggataaaggccgggcaggcgatgcggcaaggggaccagcacatcgatcaggcagagatggacccgagaagcatgagcgagcaagggggaacaatcggacgggatacacgggggaacagagatcagcaagcccagcattagcaagatcatacagaaacagcacaaacaaagacacaagaggcaaccaattcgatagaacaagggcgttaaggtacatagccccaagaggagccaagtcacagtcagaaggacggacaaccgaggagcaacgaattgaaatgcctagggtaaggaagagcacctatgaaagtggatagcggacaagacgaaaacagtggatcggatagccacgcataaatgcagcccccggagaataagaacgcagaactggacattggcaagcggcccccagaaacaaaggccagggaaacgaggatgtcacccctagggagaatgtcttcaaaaggaacttaaagcaaacgcagcgatacacagagaggcgcataaacacgcaaccgggcattaggacgactacactagccccaatgaagtacagcacgtaacaacacacacccaacaggcgaaagcgagcacaacaccgagtaaggtgcagaagcaagagaatgtacacagacagctgacgggcggctgcaaggagagcgcggcaga

SEQ ID NO: 703744 - DNA, 120 bp, Homo sapiens
ctgtagcgattgggttccgtgtactacgcagaactggtacctgtgagcaggtgcctcaccaggtgccctggatagagaaggccccagctcacctcagcctgccagacctgagcaagccag

SEQ ID NO: 703745 - DNA, 1027 bp, Homo sapiens
aagcatatcagacccccagtttcagtgaattgagtataaatattgcttcttgtcacctctgtgggacagtaatgccttatagtggcactagtcaccttaagtagcattcaccaccatggttgcaggtgcacataacagctagccatgtggcacatttgcctttctgtgcatcatatttccattttgctacaactatcatacatcacatccaagttatcatgtattcaacacaccgatcggctatctcatcatatactagcttgcaggcacagctattgcgcgcatatcactcagtgatgtgtggacctttttctattgttgtatcacatcatgtctattcatgtcccccgacgtcacactctctacatatctgtgcttcaatcgtatcaacacacaacacacacacacacaacacacacaacatgatgcgtgcagacaagcagcagcacggcatgtggggagctctctccaacggtgagtgagtatcgacaccaaaggccagtgtgtctcctttcagcacacactctccctgtgaggccactatcagacggtagagaccacagtctaaccacgcaccacactcaaggacttttcccgcacaaacagtatgagctttgaaaacactctccacacaaagtgcacacatgtacagatccacatgaagaatcgcactgtggagataccatatacgccgatgtatcgctttacatctctcccaacctatttacattttgacccccacatactgcaacacccttctacacaccctcacataccatccacaacatccccgaggtgccaccatacttcccttattcccccattacttctcccctctatctctctcacatacattctccacaaaccaaaacttatgtctataccataaccatgtcactaacacaacccacacctattatctaccacaaccatgcattgtaccaataacacacaccttcactcgctcttcaactatctaacgccccaccaaccgcctcctttactcacccctctatcatcaataatg

SEQ ID NO: 703746 - DNA, 347 bp, Homo sapiens
acctggtggtgtgtgtggcaacgaccgtggtgctcagacctggccgttcattggctgagggaagcatcaaactgatttgaggtgttgaaatgggggtttcatggtagttcggcaaattcgcgccctgcttagctcgttgctctgggcgtggcgtcgtgctcgtctgcaagggaggtctgcttttcagcttgtgcgcgcctgtcttcgtgaaggtgccaaggggcctcgacacttcgcgaggcggatggctgcatatgcttctggtggatcggcctctccaccaccggtatctttggatgcctacgaaagctggcactccgcattgccgcagctggaagttcccgctg

SEQ ID NO: 703747 - DNA, 297 bp, Homo sapiens
gggctggtaacacgctcataggcactgagagtaatatatcgctgacctgcataagtcagatgggaagacataaaggacctcatctttggttattagtgggtgaaaagaatctccatctgttccattcgtcatattgcaccttgtctgtgatccaccagctcaagtgacgtttgcccattcccattccacaacatgttgtacagttaaggtaactgtctgctccagttcagaaaaacaatgtctgcatcattagtcccattatgctcaataggaataggccaacctagggagagatat

SEQ ID NO: 703748 - DNA, 645 bp, Homo sapiens
ttagcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgggaggtagagcttgcagtgagctgagatagcaccactgcactccagcctgggtgacagagcgaaactccgtctcaaaaagaggcaggagaatcactagaagctggtaggcagaggttgcagtgagctgagattgtgccagtgccctcctgggcaacacgagtgaaactctgtctcaaaatacaagaccaagtcattttccccataaacatgttatttagacaatacgtagcacataatataaattaagcggtctttataatgttgttgaacgaattttgttcagcaccaccttattt

SEQ ID NO: 703749 - DNA, 279 bp, Homo sapiens
gttaacgaattaccacaaccaacacctatatactagttgaaaatgccccaactaacatactaccgtatggaccaccataattacccccatatctctcttacactattcctcatcacccaactaaaaatatgaaccacaaactaacagctacctccctcatcaaagcccataacaataaaaagttataacaaatcgctgagagaccaatatgaaagagactctgtgcgcttcattcattgcgcccacgatccgtaggcctacccgcgcgcgagtactgat

SEQ ID NO: 703750 - DNA, 191 bp, Homo sapiens
  misc_feature (114)..(114): n is a, c, g, or t
  misc_feature (135)..(135): n is a, c, g, or t
cctcgcctttcagactgatcatttcgagaaagaccgtgcttctaaaatggtctttggagatggtgaaccggcccctcacggagtctgtgtagtacgtgttgacaccagcaacancagcataatcaccactgatgngtgagaccaatcgagtccctccctggagctgggggaccaagtcaggatagtcgtga

SEQ ID NO: 703751 - DNA, 127 bp, Homo sapiens
gtgctcagttcatctccacgcactatgacaacctcaaggagcagtgcctgctctccttcgccaatgcctcgtggactccagagtgtccctgtccctgctcaatggacgagatgaaaacaatgaacaa

SEQ ID NO: 703752 - DNA, 339 bp, Homo sapiens
ccctttttttttggggggccggcttgttgctccggtttggggttttttcccaaaaccccgtcccagggttttgcaggcccttgtgggggcgggctccctgggcagggttcccccgtgtggattgtgcctcaggccagggttccccaattggggtcctgtccggaaggatgggatttttttgggaggtggcgccggccaaaggggggggttcctagtttgtggggggaagtttttatatccatgcccggtccctcccccccccccctttttgttcggggcccaagggttttccattggttttttgtaaaaaaataaaaataaatgggggtttttccccca

SEQ ID NO: 703753 - DNA, 310 bp, Homo sapiens
tccccctcacccaggctggagtgcagtgacacaactacagctcactgcagcctcgaactcctggactcaagagatcctcccacctcagcctcccgagcggctgggaccacaggtgcatgcaaacacgcccagctaatttttgcatttttttgctgagacgaggtctcactatgttgcccaggccggtctcgaactcctgagctcaggtgatccacctgcctcgggctcccaaagtgccggattacaggcatgagccactactccgggcttacctccttcttaatctgaaatctacttctgttcccttctt

SEQ ID NO: 703754 - DNA, 200 bp, Homo sapiens
gggagctcggtaccgaatctcgacagtgtgcaagtttaaccattgagttatttcagtttctggtaattacaaataaagtggctatgaacattaaatatgggttttggtgtgaaaatagttttcatttgtctaataaaagctcaggaatgcagggcaggtttaacttcctaaaaacctgccaggctgattcccagagtagc

SEQ ID NO: 703755 - DNA, 2024 bp, Homo sapiens
cgtcggggtttcctgcttcaacagtgcttggactggaacccgtgctgctctgttccccaccccggacggacgcaacatagccagccctccgtcactcttcaccgcaccctcggactgccccaaggcccacgccgccgctccagcgccgcgcagacaacgaccgacgacagccgcctctccttagtcgccgccagtgacgaccgcgtcaacctcgcaggtgcgccagaactaccaccaggactcagaggccgacacatcaaccggcagatcaaccctggagctactacgccatcctacgtactaccagtccatgtacacactacataccgaccgccgatgatgcggctccgacacacactacgccaccacacctccttcaccaaccccatgacgagaagggaccactgcccgcaaacaacagactgaagccgcagcaaccccacgccggtggccgacatcatacctccaggcacacccccacacgcgcctgcgctgaccccgcaaagcgcgctgacacgcaacaggcagagtgccctagcatactggcacacaacacgggcaccacgctacctacactggacctgcacaaccaggccacctgcccaccaatgacacccaaaccgtgagcaccacaccagagacagcaatacccgcactgcccaagctgagcagcacaaagcatttggctcccacctcaaacaagcgaaacatagaacgccgcacaagaggccagcaaacactcgcaaagcccaccggcaaccgagatacaccacactagccccacccagcctcaccggacttacctcacttgccgcaacgatccaccacactccgcgtccacacctaaccacattcgtgtctgttatattcctgttgttcactcccacatccaccagcacaacgacaccactcaactcactaccaacacctaaccaacgaaagctactctacatactactctacacactaagactccacacacctccatcaactacaatccacaaacaactcacacttaaaccaacaaccacacaactcccaccctccgccttaccaccccaaccacactcatcaaacacaactcctccacgagaagaccaggacacaggagcaaccgaccacacgaacgcatagcgacgaacgacgacgacgagacacagcatgacctgcaaggcacgcacgcacagcggtcggacaccccacgagcagctcgagcgaaacgaagcaggcgacttccgcactagacagacgaatacgcaccacgccacacagacaccacagaacagaacgcacaaggatgaccgacaaccgacgaacggagcctacgagccgagaccgatccgagagagcaccccagagcgacacgcgcagccaagccccgaaccggcgaggacccgtgccgagagcaggagggcgaggcatggagcgcgtacagcgcacgtaccacacaaccgtgggacgcgcgagcacggcagcgccgagacagcagctggcttggagaagtgccggagcggcagcacaagtcggtgccgtggtggcgcagagcgtagcgagcacggtcgtggcgtcgatgtctgaggggagagcacgagaaggcagccgaggagccgagcagcgagcggaggggagagagcgaggcgggggccggcggggcgaaggcggagcgagtctagagtgtagagagaccagcatgggctagcgaacgatcgacaaagcgggagcgagcgagcaggtgatcgcactgaggccgctcgcacgacctagtcgcacaagtccgatgcagagggctaccgagtgagtcacgtagaacgtcacagctgggagccaacgcacgcgtagcgagctgagaaggcgccaatccgctgcactcagcacgctcaagaccgggagcgcccacccaactccacaacgcctgcacacccgcagccgcgcacgaccgcggacgcacagctgcagaactcggggacagggcagtcagagagtatcaagtagtatcgtcgatcgagatgaggcatgcgagcgga

SEQ ID NO: 703756 - DNA, 226 bp, Homo sapiens
tagacactcgtggacggtgtcttgagatatcatccgctgagggtgacgggagtagcatgacactcagtgaggtgtcttgagattatcatctgctcagtgtgtcactgggagtgatcaccacactcggggaggtgtcttgagacttatcatcctgctgagggttggacatgggagtgagcacacactcgtgggaggtgtcttgagattatcatcacgctgagtgtgt

SEQ ID NO: 703757 - DNA, 229 bp, Homo sapiens
tgtgcgagctgctctatgatgtatcccttcgactgtggactcagatgctggtaacggttacacggttgcctgattgtatggcaccccaactgccccggatgactctgtaagtaggagaggtttccttttgtctgagaaatggtaggacggagcttttagagaaggtctacgggtggggagcttccttgtgtccatgccctactgattttaaaatcgcaaaggaccattg

SEQ ID NO: 703758 - DNA, 595 bp, Homo sapiens
tctgtgagcgtgggctgtgctcttcattcctctggccgctctgtgcccgttggcttgcgaatccctccagtactcctgtgacgtaggtgtatcgtactagtataccccgaaggcaaaactgaggcactcagaggttacgagtccagtctatatagtatcatcagttgcagaaaagtgatatacgtgtttccttttagactgttgtaaaaacagtataaataagtatacatattatatttcaaagcaccctatgaagcagacactagatatactcagaataaacaaaaatgattgcaaaggaatacataaatatgattgaataaaaacctgattaatcatctacaggctcagaatacacttttaaacctacatgaagctcatacttccacatttccatcagtgggtaatgtctagcctgcaaatcatttgtaaacaactcagtctggtacataggactccacttttacatcatgcattgcctgaacaacaaaaactcaagagttgtgaatgccccaagaaagataatggaaagcccaaaagtgagtatgaccaacttcctgtggtaactactaaatgccaggaaatccgtgactaa

SEQ ID NO: 703759 - DNA, 121 bp, Homo sapiens
ctcagctgaccacagatgacgcagccgtcttccagtcacgacgtgtctcggcatcacaggtcaggccaccctcttcctgtcaccagcctttcctcagcatccacaggtcacgcgagtccct

SEQ ID NO: 703760 - DNA, 396 bp, Homo sapiens
  misc_feature (128)..(128): n is a, c, g, or t
  misc_feature (136)..(136): n is a, c, g, or t
tctacttccttggcactagttctctctgggcagcgacgcagcctttacagtgcactggtggctgctgcaatggacttggcagcttctagtactgctctcaaagtcaagatcatctgcctccttgggtntggcccgnggcttcagctgctccagctttttggctgcagcctcaatggcggctgcagctcccaggagctcattctcagcaatgactgtggggtcctctgcgtctacccattctgttcccttcatggcttcagcagcctggatgagctcagtgacggaaccagccacacgctttgaatgccctgtcaactgctgcttcagttctgggcttggcttctgcagggtcagcagtacatggtccagcagttccaggtagccattgcactccgg

SEQ ID NO: 703761 - DNA, 103 bp, Homo sapiens
aatcgagctcggtaccagatcccctataccatccctttatcggaaacaggatctcacttcgtcacgcaagtagagtgcatagatgcgaatactgcgtccctgg

SEQ ID NO: 703762 - DNA, 283 bp, Homo sapiens
ccctctgcacggcgttgctcctgagtgctattgcctctagtcatgctgccctccatcgccaggaggctacctggtttcacgtgcacctgttctctcagagtgagagctctgccctggtctagcaggtcaggttgggctggtgggctctttgcccgttagcgctcccttcaactccagctctgcttataccgtccgttcttatgtcttccacccacactcaggtagaagagactgagtgggtggtaaattatgctctgaaaaagaggacatgtgcgaatggcgg

SEQ ID NO: 703763 - DNA, 297 bp, Homo sapiens
tgtcaattcctgtattaagcaaaatattacactatcagctgtaaagttagacccgtcaaacgtgtatgattacaatcactggattggacgactgtgcgtattgtatgcttcacatcatcgaatcttctaacagtccgttataatgtcatgaggcgcacagtttacttagtcagataaaacagatatctgagtagatccccaagggacaatcctagttggtgaatgtctgtcaagctcttcccatatttgccttttaacactgtttagggaccacaattaacagtatacgccattatt

SEQ ID NO: 703764 - DNA, 428 bp, Homo sapiens
  misc_feature (56)..(56): n is a, c, g, or t
  misc_feature (88)..(88): n is a, c, g, or t
  misc_feature (100)..(100): n is a, c, g, or t
  misc_feature (107)..(107): n is a, c, g, or t
  misc_feature (109)..(109): n is a, c, g, or t
  misc_feature (113)..(113): n is a, c, g, or t
  misc_feature (121)..(121): n is a, c, g, or t
  misc_feature (129)..(129): n is a, c, g, or t
  misc_feature (136)..(136): n is a, c, g, or t
  misc_feature (162)..(163): n is a, c, g, or t
  misc_feature (170)..(170): n is a, c, g, or t
  misc_feature (195)..(195): n is a, c, g, or t
  misc_feature (205)..(205): n is a, c, g, or t
  misc_feature (210)..(210): n is a, c, g, or t
  misc_feature (222)..(222): n is a, c, g, or t
  misc_feature (229)..(230): n is a, c, g, or t
  misc_feature (237)..(237): n is a, c, g, or t
  misc_feature (242)..(242): n is a, c, g, or t
  misc_feature (254)..(254): n is a, c, g, or t
  misc_feature (259)..(260): n is a, c, g, or t
  misc_feature (264)..(264): n is a, c, g, or t
  misc_feature (269)..(269): n is a, c, g, or t
  misc_feature (279)..(279): n is a, c, g, or t
  misc_feature (291)..(291): n is a, c, g, or t
  misc_feature (294)..(294): n is a, c, g, or t
aaatattagggcatatattatgaggcatattatttatcctatccatagatgaaatnaaaatccaaatggactatttatttatttcccnccattccccccnggctggncntganttcctgtnctcaagcnatctgcntaccttggcttccccaagtcctaagnntatgggngtgagccactgcacctggccaaggntccgaatggnttganagataccttganatagttnntcaatgnaacanacacacatatgngaggnntggngaaangggaagaganggttgggctganganagggacctgggctttcctcagctcttctgccaaggtatctgtcctttcttagtgactcactgggctgaagtctagagcattccaatgggtgctggggatgggttagtgaaccaggaccagccctgcccttgggg

SEQ ID NO: 703765 - DNA, 961 bp, Homo sapiens
cggcgggaacatggaggaagctgctgaggcgcgagctggtgctgcagctctgtcaggcccaggggccactcggggggcgtgcgtgcatcatccaggtccgtatctacgacacggatcacggacgagtgttcgtgaaagtgaaccccaaggcggaggtcagaaggaatgtttgaatggtgagatggccagtttaactgccatcctgaaaacataacacggtgtagaagtgcccaatcccagtcaaggttctggatgccccaggcggcgtgagcgtgctggtgatggagcacatggtacatgagtgcatctgagcagttcatgtctgtcaaacgtcttggagcccagcgtggcctgatttagcaccttgataacaagatagcttggagatgatgcgcctgaaggaggctgggcacagtggggagaggaggtgggcaggaggaacgggcctttgtgcgccctggtttggatttgacgtggtgacgtgctgtgtgatacctcccccaggtgacatgactggccttatggagtgcacttgggtcgtgttctattgccctgtgcatgcgctttcagccccaggatggacatgtgtggagactggagtctggggcacagtggtaggccctcctagctttggtctgtctctgcagttaaagatccctgaacctgttccgtgacctggagatcatccccagccttactccacggggacctctgggggtggaaaacgtagcagaggattcctctgggccggtgattttttgacccaggttctttctacggccactcggaatatgagctggcaatagcttggcatgtttgggggctttagcaggtccttttactcccgctacaactgcaaaatccccaatggcccaggattcgagaagagcctcagttgtatcaggtctttcactacttgcacactggaacattttggaacggggcacagagaatcaccctg

SEQ ID NO: 703766 - DNA, 1091 bp, Homo sapiens
  misc_feature (358)..(358): n is a, c, g, or t
  misc_feature (403)..(403): n is a, c, g, or t
tggtatacaattgcagaaattgattatcatgagcttggaagaaggcttcagggtaacaatattggagcgcgatttcgaaaactgacttggcagtccgaggacttcaatggtgtaccaacgggcatatcacctatcacgaggaggatactaccacgtgcatttccacatacgctgcgggagagttctgagctatactttcatccattcagaatagaatacgttccgcgctagagggacgctggataagtacgaattgcctgtatgagtaggactatcatatacatgtcacccaatacccttttatcgtgaatgcacgggaactattacacacggtcaccaagtaagagcgtactagganacgctttacggtatcccaatagtagactgtcgaatgtgatgggtntatgttctaagaaaggcactatgttcctaatatcacgtgcggactacccgaaatattccctttttcaactcgtctttactatcgtatacactttgcgtattgacgctcgtataccaattctcaatgtagacacgaagctctttgaacaaggaacgaccttcctcaaataacgtcccctttattttacgtaaaggcatttcgcatataaacgcgccgattcgagatacccagatttcccccacctaagaggaaaattctctttgtggctcgctatttgctcgaaatataaaacttttactcatagttaaactcgcgtgtgaaatatagcgatagaactcctcacgagaaccgattttcttttgagtttggtaacacctttcccttgtaatagccaataggttggtactcgtgtggggtagaactcgtgtccaattttatgtaaataaagctaggacttcaagaactgtactcgttatgcgagtgaggtccccatggatccttattttaaatgatcgtccttaggcccaaaatgggctttctttttcgggagcaaaaccaataaacttggaagactcaaacccgattgggtgaatgcacgccctaaggtccctattatccaggcttacttccaagatttacttggctgattccccaaggggaccctaatatccggaacgtaaacagatgg

SEQ ID NO: 703767 - DNA, 245 bp, Homo sapiens
ggatcccagggttcgactatctgtagggggtcggctattgttacacgggggaccccaccacgcaggatcagtgaccccccaggacggtcacgcatgtgctccagtcaatgagtgtcatgattgcagaagcggtgactggacttgcatgtcatactccaggagaggccggtcacaaatgcagtaacatgaccaggatgggccggtggggctggtcaggtcacagtgtgagggacagactggccgac

SEQ ID NO: 703768 - DNA, 975 bp, Homo sapiens
  misc_feature (98)..(98): n is a, c, g, or t
  misc_feature (106)..(106): n is a, c, g, or t
tgtcattgtgtgtgagttgtggattgatatcaatagacacaaaaaaaacagtcgaacggtcgaaaaaaacaaggaagagcacaagagctattgttgtnttcgttancttatgacacggcgccagggtcatttgtgtagtgacttgactaggtcctcagaagactcttttccgcgatgagactttgctacgccgggggtttcacagacctgtgagggggtggttttacaatcgcgtgtgtactctcatcggtgctcgccttggttctcgtcagccggttatgtaatggggagttataacaccctctttcggagcgggagcgcttataaatgttgtgcgcgcaccgctttgatcgcttggtgagaagcgtgggtgttgttctctctcttttttaatggcccccctttggggggggggtgccctttcttccacgccgtgctgcccaaactttgtgggttatccactacgagggggtcgctgtaccactcccttggggccctccttcgtggtaggctatgttttacacggccctggtgtgcaacagtagtcaactcccccgtgtttctgccgcgcctctcaaggagaacaacctcgggtgggcctcctccccaggatgtcaacacacacggtctctccacgtcatggtttccacgggcccagagtcctcgctgctctctatattggggtcgcctcccataacattccgccatgtgtggcacgccccccccccgctgggcatcccctccctcctccaagggtgctttgtggtgacatcatccctccgttcagccccgcctcctcttgtcgggcgccctcgcgccgtcgttctgtgaatctttctgaccaggggcctctactacgacagtatcccccgcgggggcttaaatctgtttcttgacaacggggcggccgctgcgccccggttttttttgttccttttcccccaaaaaaaattaaacagatctaacatagacaac

SEQ ID NO: 703769 - DNA, 958 bp, Homo sapiens
aataccttcattgtgcggatggaggagactttcgttatcctgttctctgaacctcaccatgcatgagctgaaggtgctcccccgggacctgcagctctgctcagagacagcatcaggtgttggatgttgggggccaggatgaatgcggcgcgacgctggtgcagtctggatccccagactgtgggttgtcggcggtgcgactaggaacggggagaccgttccgaggtgcatgaatctatgtactgcgcaaggtggtgactgtcagacagtcacggctgtgacccggaagaaggacaaccgcgtttgcgtgtggccttgtgactcagagcagaacaggcgatccatgtgaaaagacgattcgtttaaagggtcaatgtgaatggccccccactccagggccgagcaatggggagattcagccatctcttccgaaggcttacgccttcctacattgcaaagaaactggtaggagaacgggggcgtgtatgtctgcgagaccgccacctggtgctggctgggggctcaagagccccgtgatgtgaccaacttcaccgtgggtggcttttgcgcctatgagtccccggatcagcagccccatgcaccccagtgctggaggtcagcgtggcggctttggtagcccacggtggcggcagtggtggcatgagcaggggccggggcccggagggaccaccgaactcatcggccagaccgtgcgctcttcccagggggccttccaacgctacatcggtgtggtgacagatgccccggagtcacggcccgtgtggggttgttccacctgccgacattcctgtcgacgtccgccggtcccccggggctcacgggccggcggtgctccactttagaggggcctttgtgtcccgaccctttggttggtccacccctttggtccaacctctcgtgtgggcccttgggtaggcctttatgtcccctccagggg

SEQ ID NO: 703770 - DNA, 555 bp, Homo sapiens
  misc_feature (4)..(4): n is a, c, g, or t
  misc_feature (76)..(76): n is a, c, g, or t
  misc_feature (86)..(86): n is a, c, g, or t
  misc_feature (99)..(99): n is a, c, g, or t
  misc_feature (104)..(104): n is a, c, g, or t
  misc_feature (106)..(106): n is a, c, g, or t
  misc_feature (117)..(117): n is a, c, g, or t
  misc_feature (120)..(121): n is a, c, g, or t
  misc_feature (146)..(146): n is a, c, g, or t
  misc_feature (245)..(245): n is a, c, g, or t
  misc_feature (309)..(309): n is a, c, g, or t
  misc_feature (320)..(320): n is a, c, g, or t
  misc_feature (334)..(334): n is a, c, g, or t
  misc_feature (368)..(368): n is a, c, g, or t
  misc_feature (502)..(502): n is a, c, g, or t
  misc_feature (505)..(505): n is a, c, g, or t
  misc_feature (516)..(516): n is a, c, g, or t
  misc_feature (519)..(519): n is a, c, g, or t
tganatttcctcttgaatagctccaaaccctaagtataaatatttttatacacacaaataggcacacatatattcntgctgcaggntgtcatgctcaanaaaangntcccacctggnttnnatatgcaaggaactgcgcatccacngccatccacggccatccacccatccatccaaccttccatccatccgcaacaagacagcagcaagttctgagcagtcaggccccagggttcacagcagtnggggctgggcttccagcaggctcatgattcaggccttaacccttgccctgggcgcccccaaggntaataacatcnctttctgggggggnggaactggggccgggtgggtgactgatatttggngggggaacctaaacagtctacggaggtgtcctgagatgggcgtaaagtcaaacagaccaagcacacaggtaacactgaaataggaaagagtaagagcttctgttcaggctggaggtgctcgtatggcgggacangcnaggggaaaagnganaggggcaacatggcagacataccacggttcctacag

SEQ ID NO: 703771 - DNA, 417 bp, Homo sapiens
gtcagtgatctctgctcactcgagtagctggatacagtcgccacaccatactggctgattttgtgttagtaggaaggttcatgggaaacatatagaattgttcaggtgtctcgaatccgacctggtgattcaccacttggctcccaagtgctgggattaaggtgtgagccatcgtgcctgcctaaaaaattttttggcttcatctgggtttgtgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcgggtgaggatcactatgagcca

SEQ ID NO: 703772 - DNA, 184 bp, Homo sapiens
tcccatgcacagttatggttcggaatccaccggtcacggtcccggggctcaacggcaactcagaaacttctcaggacggacaaactgggaggtatgcagggagttccagcgacggaaactggggcccgggggaagagaccgactggccggcttggcacaccccggcagacagcaccagtgatcg

SEQ ID NO: 703773 - DNA, 601 bp, Homo sapiens
  misc_feature (143)..(143): n is a, c, g, or t
  misc_feature (150)..(150): n is a, c, g, or t
ctgcatgtttgattatagtattaatggacaaataagttttgctaaatgtgagtatttctgttccttttgtaaatatgtgacattcctgattgattgggttttttgtgtgtgtttgtttgtttgttttttgagatggagtctcnctcttgncactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaaccaagagtgaaattccatctcaaaaagaaaccaaaaaaacaaaaaaaaaaacttgccggttgagtactgtgtttcaggtgtggtccacggaacatttacaaacctgtagcatgaataatgtggttttcattccgaatcttgtgatgtttcacttattatcgctcttaagaggacggtgaagttcctatttcaagttttgggtcaggtgcgtctctcaacagctgtttttcttaaattaccttaactgttggctgagtacaggaaaaaccaaaaaaaag

SEQ ID NO: 703774 - DNA, 295 bp, Homo sapiens
  misc_feature (143)..(143): n is a, c, g, or t
  misc_feature (150)..(150): n is a, c, g, or t
ctgcatgtttgattatagtattaatggacaaataagttttgctaaatgtgagtatttctgttccttttgtaaatatgtgacattcctgattgattgggttttttgtgtgtgtttgtttgtttgttttttgagatggagtctcnctcttgncacccaggctggagtgcagtggcgccatctcggctcactgcaacctctgcctcctgagttcacgtaatcctcctgagtagctgggattacaggtgcctgccgccggctggccaattttgtacttttagtggagacggtgtttcgc

SEQ ID NO: 703775 - DNA, 117 bp, Homo sapiens
tggacccgatttatgcagcccagacgcttcccactgctgctcaggacgctctctatgcggtagttcccggtggtgagcaatgttcatgccactgccattaaagggcatataacatgg

SEQ ID NO: 703776 - DNA, 155 bp, Homo sapiens
atctagagatcccgcgtctgtgtactcctccttaggcaactggtagtccccgctcccggagctcaccatattgatgctgaacttagtgcgacacccgatcgccatagggcattacagcccagaactcctggactcaagcgatcctccagctctca

SEQ ID NO: 703777 - DNA, 111 bp, Homo sapiens
catatactccatcaatcaccagcacatcatgtgccaatcatttcagcatgcagcacagccagcacatgcactcacaacatcatccagctgcatcaccattatcacataaac

SEQ ID NO: 703778 - DNA, 922 bp, Homo sapiens
  misc_feature (1)..(1): n is a, c, g, or t
  misc_feature (4)..(4): n is a, c, g, or t
  misc_feature (11)..(11): n is a, c, g, or t
  misc_feature (30)..(30): n is a, c, g, or t
  misc_feature (34)..(34): n is a, c, g, or t
  misc_feature (44)..(44): n is a, c, g, or t
  misc_feature (54)..(54): n is a, c, g, or t
  misc_feature (57)..(57): n is a, c, g, or t
  misc_feature (76)..(76): n is a, c, g, or t
  misc_feature (81)..(81): n is a, c, g, or t
  misc_feature (93)..(93): n is a, c, g, or t
  misc_feature (100)..(100): n is a, c, g, or t
  misc_feature (102)..(102): n is a, c, g, or t
  misc_feature (104)..(104): n is a, c, g, or t
  misc_feature (106)..(106): n is a, c, g, or t
  misc_feature (114)..(115): n is a, c, g, or t
  misc_feature (133)..(133): n is a, c, g, or t
  misc_feature (143)..(143): n is a, c, g, or t
  misc_feature (152)..(152): n is a, c, g, or t
  misc_feature (154)..(154): n is a, c, g, or t
  misc_feature (161)..(162): n is a, c, g, or t
  misc_feature (164)..(164): n is a, c, g, or t
  misc_feature (167)..(167): n is a, c, g, or t
  misc_feature (172)..(172): n is a, c, g, or t
  misc_feature (176)..(176): n is a, c, g, or t
  misc_feature (179)..(179): n is a, c, g, or t
  misc_feature (181)..(181): n is a, c, g, or t
  misc_feature (190)..(190): n is a, c, g, or t
  misc_feature (195)..(195): n is a, c, g, or t
  misc_feature (198)..(198): n is a, c, g, or t
  misc_feature (208)..(209): n is a, c, g, or t
  misc_feature (225)..(225): n is a, c, g, or t
  misc_feature (228)..(228): n is a, c, g, or t
  misc_feature (231)..(231): n is a, c, g, or t
  misc_feature (243)..(243): n is a, c, g, or t
  misc_feature (262)..(262): n is a, c, g, or t
  misc_feature (271)..(271): n is a, c, g, or t
  misc_feature (274)..(274): n is a, c, g, or t
  misc_feature (278)..(278): n is a, c, g, or t
  misc_feature (306)..(306): n is a, c, g, or t
  misc_feature (312)..(312): n is a, c, g, or t
  misc_feature (315)..(315): n is a, c, g, or t
  misc_feature (320)..(320): n is a, c, g, or t
  misc_feature (329)..(329): n is a, c, g, or t
  misc_feature (340)..(340): n is a, c, g, or t
  misc_feature (346)..(346): n is a, c, g, or t
  misc_feature (365)..(365): n is a, c, g, or t
  misc_feature (373)..(373): n is a, c, g, or t
  misc_feature (387)..(387): n is a, c, g, or t
  misc_feature (397)..(398): n is a, c, g, or t
  misc_feature (405)..(405): n is a, c, g, or t
  misc_feature (408)..(408): n is a, c, g, or t
  misc_feature (437)..(437): n is a, c, g, or t
  misc_feature (446)..(446): n is a, c, g, or t
  misc_feature (455)..(455): n is a, c, g, or t
  misc_feature (458)..(458): n is a, c, g, or t
  misc_feature (460)..(460): n is a, c, g, or t
  misc_feature (469)..(469): n is a, c, g, or t
  misc_feature (480)..(480): n is a, c, g, or t
  misc_feature (485)..(485): n is a, c, g, or t
  misc_feature (492)..(492): n is a, c, g, or t
  misc_feature (502)..(502): n is a, c, g, or t
  misc_feature (504)..(504): n is a, c, g, or t
  misc_feature (511)..(511): n is a, c, g, or t
  misc_feature (516)..(516): n is a, c, g, or t
  misc_feature (524)..(524): n is a, c, g, or t
  misc_feature (565)..(565): n is a, c, g, or t
  misc_feature (599)..(599): n is a, c, g, or t
  misc_feature (728)..(728): n is a, c, g, or t
  misc_feature (741)..(741): n is a, c, g, or t
  misc_feature (750)..(750): n is a, c, g, or t
  misc_feature (792)..(792): n is a, c, g, or t
  misc_feature (816)..(816): n is a, c, g, or t
  misc_feature (872)..(872): n is a, c, g, or t
nccncaaaccnctttgatgacccagggggngggnggggcggggngggggggganccnggggggggggggcggcggnaggcngcgggagccccnccgggcncngncngcggggcnnggccaggggggggcggancaagagcggngagcccaancnggggggnngnggnagagngggnagngnggccaaacnggccnctncccccccccnncacccaggccacagcnttnaanaaacaaaaagcnaccctttacagcccaaacnacacagggnagncctnccccccagcccggggcgcccagcagggnagaggngcncgggngggcagggngggggcccccnggggcngacaccgccccaccccccnccctagcnccaggggggagggncaggcagcgnngaacagnggnaacaaaaccccaacttcccccaaaccccnatgcgggcngggccatcnagncngggactgcnggcccaagggntttcngcccccnccaaaccttngngcttccncaggncgggagcntagcggagactgccccaagaggggcgggggcgcggggctcngaggcacagggggcctgggaaacaggcaagagtntggttccaaagtttttcccagcccaggcctctgccttggcaagcaggaagcagggccaggtgagagccggtgagacccaggctcagaggggccgggtggtgtggttatagaccaggtgctccgtgtccncggtagtggaganagttgagcnggcaggggtgggtggtgggtggtggtggtgtccgtggaagtnctttctctggttcttgaagaagcngttacccaagaaggctaccaccaccacaatgcagaagaccaggaacactgcgacancatctccacagagcctgttctgggaatggggattcccgcctcaggccaaa

SEQ ID NO: 703779 - DNA, 1023 bp, Homo sapiens
catttatatttacattttaattaaacagtatcaaaattgcttgcttaaaacctaagcaatatgcattttgcttgaactgcttactgtaactttaacctaagattatagtgaccttattcaggaacaaaaaaaaaatttagtgtaccttcaaagacttgacattctgtgtcagaggcaaacacaaatttctagatactgttggcttgtatataggtggttggtagaaagataaaatatttgggtagtaatttaaaatacaagaaacgaatatttatttggtccacagttggagatgtaggataaatgtcttaactcaaagatcacaggactttggtcttacattattggccattttaatttaccatttataaaagatctggtctggaataatggaattcaatgttaatcagaatctatgtatacctttatagaaggctagaaggaagtattacaaataaacatgtaaaataaatattaacacatttatcacaaagatatatttaccattgggtatgtagccccatttaccttagatcatggtaaatataacataaatgaggtaataatgtacaactatataatagaaggaagataatgacatttaaagtagataaaatgtgagataaaaggtacttataatataattataaaaggtactgataagataattaccaaaattaatacaagaacatagattgaaaattaagaaaaaaataattatataagaaattattgaaattattggaatatcaatatagaatagccatatatgaagatatgaaaaagaactggattaataaaaaaatataaaagaatataaatggtagataaaatatacaaggtagaactcataggaaaaatgaatgagaaaaaaaaaagataaaagataatattaaaaaataataaaagaataaactaaaagtacagcaaaaaatgaagaaattaatcacataaaaaataataaatataaagataaagagaaaattacataaaaataaaaataaatatgaaaagaaaaaaaag

SEQ ID NO: 703780 - DNA, 101 bp, Homo sapiens
aaaaaattcttttcttgctttcttggggtaagggaaaaattctatttggaaggaatttttattccaaaacagttttattaaaaaggatactccttttggga

SEQ ID NO: 703781 - DNA, 368 bp, Homo sapiens
  misc_feature (19)..(19): n is a, c, g, or t
  misc_feature (106)..(106): n is a, c, g, or t
  misc_feature (117)..(117): n is a, c, g, or t
  misc_feature (154)..(154): n is a, c, g, or t
  misc_feature (174)..(174): n is a, c, g, or t
  misc_feature (185)..(185): n is a, c, g, or t
  misc_feature (189)..(189): n is a, c, g, or t
  misc_feature (294)..(294): n is a, c, g, or t
  misc_feature (306)..(306): n is a, c, g, or t
  misc_feature (352)..(352): n is a, c, g, or t
  misc_feature (357)..(357): n is a, c, g, or t
ctttcccagccccaccatnggagctgcgctgtgggggattgctgttcagttctcgctttgattccctgaatcaaagcggtagtgtccccgggcccaaaccctccgncgcctcttcgnctttaagctgattcccatgttgaaccccgatggtgtngtccggggacactaccgcanagactcacgtngagngaatctgaaccgtcagtacctgaagcctgatgccgtcctgcacccggccatctatggggccaaagctgtgcttatgtaccaccatgtgcaatatcgtctgaactnccagagttcctntgaggaccagcccagttactgtttcccgcctgatgctactgttttntgaanggggggaaagg

SEQ ID NO: 703782 - DNA, 384 bp, Homo sapiens
  misc_feature (25)..(25): n is a, c, g, or t
  misc_feature (37)..(37): n is a, c, g, or t
  misc_feature (55)..(55): n is a, c, g, or t
  misc_feature (58)..(58): n is a, c, g, or t
  misc_feature (134)..(134): n is a, c, g, or t
  misc_feature (140)..(140): n is a, c, g, or t
agagccatcttttgttctgatttcnacttataaatgntagcctaacaggttcctnggnccatgagttggagtactgcttcaaaatccacagtgattgttaatctttgtaacgtcctttttagtatccactgatngtgcangtagagtaacttgtctctgacaccttgtagaagctatcctgttaggcttcctaccattggtcccctagaaatctttcttaggcgatgggctcttaattgttgtgggtttaatgtcttctgtcttacatgtgtcttagctcgatgtctaaagaactttttacttcctctttttcactctttataagtacgatatcctcagcattgttgctcagtgatttgttctgtgtcttgtcagagtgaccac

SEQ ID NO: 703783 - DNA, 420 bp, Homo sapiens
  misc_feature (127)..(127): n is a, c, g, or t
ggagcttgccctgttccaggcagcacgaagcctagctgcgtcggagtggctgagctctgcctaccagtctctccgattcctccagctcgccaggactgctcaggaaggagtccaggggccatcagangcgcagtctcggagccctgtgccaccacacttcctggcctccgccacgccccctgttaaggccctcgagccccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgaagaaacgccacctgcccgggccggggccacagccaggaacctggggcccaaagcaggcatcatg

SEQ ID NO: 703784 - DNA, 788 bp, Homo sapiens
acatgattggctagatctctgagctcgaaggtactctgcttcaacagtgcagcacagggctctagttggaagtttaaaccccgagcaaaacatggcctccctgtagatggaaagatccatagcattctacacccgcaccctgccctgttgtgtggtgatgatatgttgtaccccaaggatcaataagatgtcctcaacccatcctcacggactctcctctctgggacaggctgggaccttcggaggaagaataaaggcgctgcctttgagtacccgatcatattcgagtgtccctgttccttcattcacaaaggataggctgaagcagtctagggcttattatgcagtgaagttccacagtgctaacagggaacctggctgggagatcctccttaaggggaggcagagcaaggcagttgtggtccccagtcttcggggaagctggccatgagagcagagggcttactcgattgcaaatggggcgtgggcgctcgtgtgtcctgggaaagcccgatcagtcgccttcattttctggaggactgaacctcccgtgggagggaggaggggtctccaagaagtgggtccccgggaacacgagggcgggggcagccagccattctattccagggtcgggggctcctggtcctgaggacgcctgaactactacggctaagggcgcaggcctgagggactgcaagcaaacggctggctgaaaaacaaattctgtgggaccgcccgtgagcacgccaggtggttgccccaggaccaagcagcgccgccacccagga

SEQ ID NO: 703785 - DNA, 198 bp, Homo sapiens
ctggggaatgcatgaatctattatagttgggcagtatggcccccggggaatagagttctccctatccatgagcatggaaggttcttccattgtttgtatcgtcttttattttattgagcagtggtttgtagttctccttgaagaggtccttcacatcccttgtaagttggattcctaggtattttattctcttggtag

SEQ ID NO: 703786 - DNA, 298 bp, Homo sapiens
cgcagcgtatcagacagatgagtgcgagccagtcgaaaacacagcacattcctgcacttggtgccctgatcacagtacctgacagtcctcatgcactcaggatggcaaggttgttatcctggtgcttgccagggatgagataaggtagtcagagttctggaagaattggttgtatagaagatcctagtgaccaaattcagcctactgcctcggatctctccagccgaagtctgtggactgcaagtctttgagatgcttctggctcccatcacctctaacatccttgtccggggttgtt

SEQ ID NO: 703787 - DNA, 847 bp, Homo sapiens
  misc_feature (54)..(54): n is a, c, g, or t
  misc_feature (134)..(134): n is a, c, g, or t
  misc_feature (141)..(141): n is a, c, g, or t
  misc_feature (223)..(223): n is a, c, g, or t
  misc_feature (233)..(233): n is a, c, g, or t
  misc_feature (678)..(678): n is a, c, g, or t
  misc_feature (681)..(681): n is a, c, g, or t
  misc_feature (703)..(703): n is a, c, g, or t
  misc_feature (789)..(789): n is a, c, g, or t
  misc_feature (801)..(802): n is a, c, g, or t
ggggaggggggaaatggattcgcctctcctacagaaattctgagattcatttanagttctaatgcattcgattactgtatttgtacagttcgggatctagtttagcgaaaatgtgttttgtagttctggataanctatttnatccgctgtgtcctccccaaaagactagcacgacgagagcaaagctccctttcagtaatacagcctctcatatccactggcngtccccgttncacatcatggtctccatgtgtaccgccaaagtcaattatgtttgaaagcctttggtggatgttatggggcaaagttatgatttacacagaagcaactgccaaatctgtggtgcaaccatatctccagtgaaatattgtataacaccattgtggaactactgaaaagacagtggcttttctacaagtactcttccttattgcaccattttggtattaacgtagaaactaagcatcagaatttatgaaccaaagaatatgttatttttcctttgtgctctaaaaatactgagattgggggaagcaattcttttttttaaaaaaaatttgaataactatctttgtgataacacattcggcggttacgatgtggaatttagcagaactatcaaatccaaaattattttcaatcagatgttaacttataagttcttggttgttccagtangtntaatgaacatttctatgttacnattgttggcttatgtggcaattacacaccaaccaatatgtgtccaatttttttttgacacaggtgtacttaaagggctaatgttgntacggggaaaanntggcctacacaccttaacaataaatgtgccaatagggggggggag

SEQ ID NO: 703788 - DNA, 137 bp, Homo sapiens
gacaaacctacccgagcctggtgatagctggttgtccaagatagattctgagttcaactttaaatttgcccacagacccctctaaatccccttgtaaatttaactgtaggtccaagggggaccagctcttgggacac

SEQ ID NO: 703789 - DNA, 371 bp, Homo sapiens
  misc_feature (150)..(150): n is a, c, g, or t
  misc_feature (224)..(224): n is a, c, g, or t
  misc_feature (266)..(266): n is a, c, g, or t
  misc_feature (297)..(297): n is a, c, g, or t
  misc_feature (300)..(300): n is a, c, g, or t
  misc_feature (355)..(355): n is a, c, g, or t
gatggagtcttgctctgtcacccaggctgggatggaagcaggccccctctgtattcgtttgctggggctgccataacaaagtctcacacactgagtgccttaaacaacatcaatttcatatcttacagttctggaggccagaaggcaagnatcaaggtgcgggtggggttggtttcttctgagggtcataagggagggatctgtctcaagcctctctccctggnttatagacggccatcttctccccatgtctttacatggtcttnatttctgtgtgtgtctatgtcctaatctctnctntttttgttgttgagatggagtcttgctctgtcacaataaataaataaataaatanataaaataaataaata

SEQ ID NO: 703790 - DNA, 882 bp, Homo sapiens
ggtctggggcgcagagcagcgtgcgggaggaggcggacacgtgtgcaacagcgtgtagcagcccgggcggcggcagcaacagcctggcggcggcatcggcccgagccgccggcgccctcccagcctcccggccacagtgggcagaccactagcatcccgtccacttgggattcccactggatccccagctctgatacgggactgggagcaggctctggtgcatatttctctcagtgatttctcccagctgacagagacccggcagcacgggcactgagcaaaccgaccgacccaatgggcgagcaaagcggcggctatcgccacggttgcactacagctaatgcacagggccttgacagacgttgactcccgagccaccacacggctgacttccacgacgacgaccccacgaacgaggacgacaacagacacagccaccagaggcacccaatgcgactctgaacggcaacagcaacacgggacgccgtcatcccaactggcgagttggacattcccgttaaccgccgtttaccagcagccaatagaagttgacctgcgtgtcacagctccagcgcacgacgttcacttgggcgagcgagaagactgtgctagcacgccccggcggccaacttccagcactaaattcgtagacatccgagatgccaaatgcatttgacacgacgattcacaatgggcgccacagcaagcgaatagcggtccagcacaacacacggacaccatacaaacattcaccaccccacagttcccacgaaacagaaaacattcactagagcaaacaatgggggacatccacaaagataactaatagcttcccgcgacaaaaagcgcacacttatagtgaggaggcgacgtaagctccag

SEQ ID NO: 703791 - DNA, 764 bp, Homo sapiens
agcggggcgacatggtgaaaccccatctctatgaaaaatacaaaaatatgccaggcatggtggcaagtgcctgtagtcccagctgcccgggaggctgaggtgagagggacaatggaggctgcagtgagctgtgatcataccacttaactttagcctggaggaagtgagatcctgtctcaaaaaaaaaagaaaaagaaaaaaaaaaaagaaattgctgggctcagggagttgtgaaaaatttgcagaattttacttacgatagttcagcaacctatttgtacacatgtaagcaagtgttacactccgtactaggagtatacacggataaatactcatgatttctctagtttcctagctagcacttaatatgggtaagaatactttacaactgctattaatttgcaactaattttatagagacaagaacctcacttttgtttgcccaggctggagttgcaggtggttgccatcttgggcctcactgcaaactttgaactccgtgggccctcaaggtgatccttccttaccttcgagtttccgtgagttagctacgaacttacgagactcgttaccaccaaaaaccagttaattctttaaaatttttgggtgtagacaggggcgcaacattggtgaaaccccaatctctatgaaccattccaaaatttatgccagcgctatggtggcaagtgcctgtagtcccagttgcccgggaggctgaggttgacagggacattggaggttgcagtgagctggtgatccatacc

SEQ ID NO: 703792 - DNA, 158 bp, Homo sapiens
tggagtctccatcttgggtctagctactccgcgcttgtgtccttacggttgtgtgaggccagtgcaaagacagactaactgtccgggcctctccgtgacacaagtctcttcccagccttcctcacaggcttctgccgcccccctcatctccaccatgg

SEQ ID NO: 703793 - DNA, 731 bp, Homo sapiens
ggcggttgggcgacgaagggaagagtcttttcagcgctgaggactggcgctgaggaggcggcggtggctcccggggcgtttgagcgggctcacccgagcccgcgggccatcgcggatccaggcccgactggcgggacgccccgcgattccccgcgggccttcctagccgctcatggaggacggtcgtctatgaatccccccagacgcgtgatctccggaggagcggtatggaggctgggagtaacaatccgggcggcggaaaggccatgggagctgtgttgggtggagattcagcgcctgcggggaggagctcaggttgaagccattgatgcgaggtgtgaggggctggaggccaatgagggcacgtaaggacccttgacaaccggataccggaagatggcatatgggctagggaagaagttcaacagtggaccccaaggaagggggatccagttcttggtggagaatgaactgctgctagtaataaacccgaggagatcgcccgcttcctgtacaagggcgagggggctgaacaggacagccatccggggaatacctggggggagagggaagaatgaacctgggagttgtccatgcgtttgtggatctggcatgagtttcacgccgactcaatctggttgcagggcctcagggagtttctatggaagctttcgctaccggagaggcccagaaaatgaccggatgatggagggccttcggccaggatactg

SEQ ID NO: 703794 - DNA, 914 bp, Homo sapiens
acccatcaaacgttccacgttacatatactttattttcattttccgcgtctttcttatgttaaacgatcacctgtaaacttgcgcgtcattctctctgctggctaatgcaagtataagaactcaatgaaaagacttaatcttacagctttcaatgtcgtcagattttccattatgtattgattttgcaacttacgatgtttttgagccccatggttcattttgattgtttaatctttgctattaaattcttgtcaaacacaggattatattgaaaatattggccttcttggcctcaatgagtggagcttttccggccagatttccctttcatgttggggcgctaattgattgaacctttaatctactagactcgggtgttactctagtccactccgtttgcagttgacgaggtattcaacattacttcatagagatgcatatcccgcgtattccacattaatttttggtttattcgcatgtaataatactttcgacaattagggcttgttttatgcctctttatcccgtgatttaggcccgcgtttgtctgtattctatacttaatggtcccgcccctcgcgattatttattatgtatttggacctctctttctttggaccacgtatcatcccctttactcattatcatctcctcaagttattccttctggtaaatttttctttgtcctctcctaacttaccctcagcgtagatggttactctgtctctgtgctcccttctttataatttttctgattcattaatatgtttattttttagccccgcccgctttcggtatatcagatgcttttatcctattagtagtatccattggatatttttttccacttccttatgttttctaagatctctcacattctcaatcctactacttattaatcatatttatattt

SEQ ID NO: 703795 - DNA, 418 bp, Homo sapiens
taggatcccctgcctgctgtcgctatgaaagatgtttccttattatttcttcatctctaatatggacaccagggaatgggggttgggggtggtactaatgggaggaaaaaaaccagaacagggtaggtttttgttttttgctttttgttttttttttttttttttgggggggttttaaaaacagaacttttttatttaaaaggggggggttaaatttttttaaccattgaaagggtttaaaaaggttcaaaagtttcgttagcctttttttattaactataattttaacattttaatttttaattaattttgggcggaatggcggttttcctttttaaaaaaaaatttattttgggggggggagcggaacccagttaattactttttttgtcaacccccaattgttttaaaaaaggat

SEQ ID NO: 703796 - DNA, 407 bp, Homo sapiens
atatcctatagtaataggtttaacatgagtacagaagagtttgcctgggaaatctattcatcaaaacatatatgtctacagcacggaaacaagtgtagtactgcactttctggtactcacggctagcaaacggttcctggctagcatgaggcatgagtcagatactcctatcctgggaactgcctaggatatttgaagagaaatatacagaattggaccttgtcaaaacctcttccttctcagtcatcagtacagtaatatacactgggagacttcagagaaaacctagatttattaacagttatcctcgatggctgtttgaattatatttaaataacaatctagtagagccaaagaaagtgccttaattcaatgatctttcgtaacggaaataaaaaatacactat

SEQ ID NO: 703797 - DNA, 454 bp, Homo sapiens
cttagctctgagaaaggggctggtgatgaaactataaaagtgcatgcgggtggacatgatggaacatgtcagcatggtgtaagagggtcaagtctttggggccttggccttgtcacatcggaaggcaaacggtaaaagagtgcactggggacacctagaaggtgggacccatcttgagttcctagaaaggcaggaactcttagagggtaagcctttggggggggaaaataaaactgggggaaagggctggcacagggtcagaggattggattctgatgtctcgtgtgtgccggcctaaagagccactgatgcacccaaaaatgacttgatttgcattccaatgaagtcatcattccaaaaggggctgatttggctctggaaagaggtgagacataagaaacatgaggtttcccagtttaggggcatcatggcaactggtcccccttttccagag

SEQ ID NO: 703798 - DNA, 216 bp, Homo sapiens
cacgagggcgatgaagatctttacgatcgctacgagtacacctattgagacgcagttcacaacgtgtgaaccgatgaggaggatgtacgggatgtgtctcaccgaatcgggtttggagactggttcttctgcatgctcgatgatcctcgtgcagccgacgctcaacacgagtgcagaggacgactgttgctacacgtatcaggagaaggtatccgc

SEQ ID NO: 703799 - DNA, 309 bp, Homo sapiens
acatggctataatcttattacctctggttgaagtagtaacagaccaaaataaacggtgagtagagattggttatagggattatttttcccatcagagtcagtgtaagtgactgccctctcccttgtagtatgtttcagtcctgacttgactagtgaagccactcatacagatttcaaactcgttgccagggtaggaaaacacaggttggcttcagttcatcctcagcctcctaacttccttttaagtaaccatgagatatatttaggaactgatggtttctgagctaatacccatgaggcgccagggca

SEQ ID NO: 703800 - DNA, 80 bp, Homo sapiens
  misc_feature (23)..(23): n is a, c, g, or t
gcatcgtgaccgccgaggagctngagaacgtgcccacactcccgctgcagccaataggaccttaaatagccacttcgtgc

SEQ ID NO: 703801 - DNA, 912 bp, Homo sapiens
cgggcgaaagacccacctgatatcctgcggtatatctttgccgttctccgtgtccttttgtccgagcctggcgagtgtgtgtatacacgttgttcggcagcacaatcccgagatgtgccgcgatttccgcggtcaatttgttctcccgggccaaatttgtcgtgcgcgcccccgtcgtcgacatgtcaatgtggcggctttccggccagtgatcagcttgcttggcgccaagtggcgttgtggcctgtttatgcccgcgtggcgcttgaccgttctggtcgccgcaatcggttctggtagggtcccgcccgcattggcgctcgatccaataagggcgcttaattcccgcttctcataagggggttcttctcggtaggtgtgccccccttttgccggggtacactccgttaggggcgcatcatccgtgggcggcaaaatcgccgttggctgtaatcataatttctccggcgggaatattgatcatgttgcgttgcgccgcccaacacctctttctcggcgcctcttcgtcggatgtcccccgtcgggttatttctgggaggtatgcccccccgtgcgcatcctcccccgtgacctccttctatctaactctggtaagggtctacatcacatttttctgtacacccacagtaatgtttttaataaaatttcatagtagtttgttggacgccttctccttctgcacgcgaaaatctctcttattattgtagtgaagaccaccctctcccttaaacccgtgggagtagcctatattatgggagacgcccccccccctgcttccccccttctgtagaacgccgtaatacacataaacatttttgcacccaaaaaggaaaggggacccccccacaagggtttaacccacccccgggcccccgatttttttaaaaaaaa

SEQ ID NO: 703802 - DNA, 1055 bp, Homo sapiens
agcggagttgttttgcagtcctgggctgctcggaagtccaggccgtgcccgggtcatggtggtgggccgagggctgctcgggcgtgcgcatgctcgtgcgcgctgggagccgtctgcgcccgctcgaggactcgtgtccatgccctgcgtgggagttttcgtgccatgagcagattttgcgtgaagaacctgagccgtgtcacgagggcatcagtgagaggtagaggtgctggctgccctgaaacgagaattacatgtacctggtcatttgattggtcgagatcaacgcgagggcttgccagtttgtggatcctgcgttgcatgccccaggaaaaggtacgtaggactgcagggtgacgaaatgcagctgggggttgcaaagttgaccaccaggtgcgtcacgcaaggcgcaaacgatccatattgggagcccatgctttggcggggacattgaggagatagctgggtcaacgccatggagaggtccggggacctgaagacgtgttgtatcggccgggggttgactgactcggttattctggaggacctcgtgagctcagccaatgagtctacgtcaggcctttgttccagcagcttgacaagaggtgggtgatgtcctccattggaagcggtcgcacgattgcccttgggctgaaccacccgatggccaggaactatcaaagtgaacctccagtttttgttaccttttccggtggagagcaaacgccccccggggaagcggcgtccgagaagggccccacccctggcccggtgtggttgcaacaacgtggttggagaagaccctattggttcgatgtgtgatgcctttggcacttggcctggggacaagagttccttaagttgaaagagtgcgaaccttggctcggattgtagcacttggttgttacaagcgcatctggctgaggaacgagtctttggggaccgagattcccagcaccgggaaaattaaaaaagtcataaatgttcggtcaaagtatataacaccacatcagagaacactgaaagtattgagagcacacacagttgatagcccg

SEQ ID NO: 703803 - DNA, 154 bp, Homo sapiens
catcctttacgaaccagagcaagctctcgtgtggaaagatgggcagcttgttcaggaacttatcaaagtacagagcgcccactgctccagccttgcaatcaaggagtacaatatgctcaaatctgctggcctattcgcggatatgaagatgccg

SEQ ID NO: 703804 - DNA, 372 bp, Homo sapiens
  misc_feature (52)..(52): n is a, c, g, or t
  misc_feature (101)..(102): n is a, c, g, or t
  misc_feature (320)..(320): n is a, c, g, or t
gacgaactaaaaacagaattatcatttgatccaggagtcacacggctgggtntctacccaaaggaagaaaggtcagtatatcaaagggatacctgcactcnngtggttattgcagcactattcacaatagcaaagatacagaatcaacctgtgtgtccatcagtggataaaatggataaagaaaatgtggtacatatacacagtagaatactatttagccattaaaaaaatgaaatcatgtcatttgtggcaacgtagatggaactggaggtcattatctaaactgagataaggcaggcacaaaaagacaaatatctatngcatgttcttacatatgagagctagaaaatttgttctcgtggggtaggaggt

SEQ ID NO: 703805 - DNA, 118 bp, Homo sapiens
cggaagcacactgcaacaaaacaaaaaattgtataaaaatcttaagagtgtggttggggccaggtacagtggctcacacctatagtcccaacattttgggaggctgaggtgggtgtgc

SEQ ID NO: 703806 - DNA, 187 bp, Homo sapiens
tctgtcgacctaaggatcccattgaggtccgggtggggttgctcacgcctgtaatcccagcaccttgtggaggctgaggcaggcaggcggatcacttgaggtcaggagttcgagaccagcctgccaaacattgtgaaaatcccatcttctacaaaaatagaaacagttatgctgtggcatgaatggc

SEQ ID NO: 703807 - DNA, 546 bp, Homo sapiens
gagaggagatggaaaggcagagaagaaggggcggacaatggagtggcaaggctaggggaaagggagggaggggaggaaaggggggagaagaggagaggggaaggaaggggaaaagagagaaggagaaggaagggaaagggggaaaaagagaggaaaaaggggaggagaaaggggagagagaggaaagagagaagaagaaagggaggggggaaaagaaagggagaggaaagggaaggggaagggagaggagggagaaagaggagaagggaagaaggggggaaaaagagaaggaggagaaagggagaagagagaggagaaggaggagagggggaaggggggaaggaggagaggagaaaggagaagagaggaaaggagaggaagaggagaagagaaagagagggggaggagagggggaggaacaggaggaggagaaggaaaagaggagaggagagagagagaggaagagagagggagaaaaggagggagggggagggggaaaagaagagaggagagagggaagaggagaaggggagggaagggagagag

SEQ ID NO: 703808 - DNA, 393 bp, Homo sapiens
  misc_feature (26)..(26): n is a, c, g, or t
  misc_feature (29)..(29): n is a, c, g, or t
  misc_feature (62)..(62): n is a, c, g, or t
  misc_feature (87)..(87): n is a, c, g, or t
  misc_feature (339)..(339): n is a, c, g, or t
  misc_feature (342)..(342): n is a, c, g, or t
  misc_feature (377)..(377): n is a, c, g, or t
  misc_feature (387)..(387): n is a, c, g, or t
aggcataaacttagaaagatcgtttngangccaggcacaatggctgggattacaggcgtgcncgggcgcccggccttattttttctntttgagatgtacccagactggagtacagtggtgcgatctcggcttactggaacctccacctcccgggttcaggcaattctcctggcctcagcctcatgagtacttggaactacaggtgtgtgacaccacacatggtattttttgtatttttagtgaagatgacatttcaccatgttgcccaggttggtctcgaactcctgacctcaggtgatcagcctgcctcggcctcccaaagtgttgggattacaggcntgncaacatggcccagccaagggtaaagtgtttagganttcaacgtgntttggg

SEQ ID NO: 703809 - DNA, 121 bp, Homo sapiens
gatgcgcgtccacactgctccaaaagacgacgtacgctcctcatcggcagcccggcgacgtaccacccgtgcacccctgatgtatggcgacgccggcactgaacgtgctctacgagagagc

SEQ ID NO: 703810 - DNA, 380 bp, Homo sapiens
gctctgctgctccctcttcaggtacacagagcacatgcccccctgtgacactgcggatgacacctgtctgtcccaccacctgtgtatcccaggtaggtgtcccgcgactttcaactgaaatgtccagtggtttaccccagtcgctggagttctgctcgaatgctgagcctggcgtgtgtgggttgtagccaccaggggagggagctccaggtgtcataggacttgtagccaacggggctcgggctggggctagcctgataggccatgggcgacggtgtagggtggtagctggctggggagtgggtattctggtagcctgctgggcttggcgccaactggtgttagctctgggggctggggctgggctggtaggaaccttg

SEQ ID NO: 703811 - DNA, 357 bp, Homo sapiens
ggggttttttttaaaaaagaaaggtttatttttgcccctatttttaaaccggaggggatttggaaatcctggccttggttgtaattctccctttttgggagaattttttctccccgcctgttggcggggaatattcccttttttttaaataatatgaaggggggggggctccctgcttctctttaccagggcttttttgcccggtttcatcccccctcatgtaagcagcccgtttttacttttggggaggtgaatgttttgttttccccaatactttgtacagggcccctgcctcccctaattttcctttgtacttgggcggggtttttcattaaagggtgttttccttatccccga

SEQ ID NO: 703812 - DNA, 329 bp, Homo sapiens
  misc_feature (150)..(150): n is a, c, g, or t
  misc_feature (153)..(153): n is a, c, g, or t
  misc_feature (156)..(156): n is a, c, g, or t
ttcccggaacggcttttgcttttaaaaattgaaaaagttttaaacagggctttcttttggtcacccctcccaccccttggggtttagtttggaatttgccccctggaacaaaaaaaccctttaatccggggcatcccttggttttggggntgntgntgcttcccaagatccccaccagggattaaaaaggaacccggtgtgcccccccgatcccccaaattggtgggctttcccccctggcaaatttttgggtctttcccctttctgttcaggccccctaaatttttaaatgtggatgcctccccaaataaaacccattccttttgtta

SEQ ID NO: 703813 - DNA, 348 bp, Homo sapiens
agcggagagcaagcgtgctgtgcccagatcctgggagaaccccagccgagcccagcctagcccgagcccagcccgagcggagccggagccccaagcccgagcctgcagcccagcgctgagcagagcccggccaggcgctctaacccgcgtgtcatcgccagctgatcactcaagctcgtttcttcctgccccattctcatcgggacacgtcgacacgaccgctcgacggagaccgatctgaccctaatggaacactagggcgaggatggataaagaagatgtggccgcgcggcactcgagagcggactatccaggacaagaactgctctcccaatggcctctcggaca

SEQ ID NO: 703814 - DNA, 147 bp, Homo sapiens
gcagggcgctgccatcatacgctgcgatcagtgctaatggccttaacttcaaggtcccgccgcattactagctaggctgaggtgatacgatcgcttgaacctgataggtggagactgactggagccaagatcatgacactgcactca

SEQ ID NO: 703815 - DNA, 375 bp, Homo sapiens
agatttgatgatttgctagaaaggctcacaggactcatcttgtagtcatatatatagctacaatttgttacagcaaggtgtgtgtgtgtgtgtgtgtgtgtgtgtgtgtgtgttttaagacagggtctgtctctgtcacccaagcactggagtgcaatggcaccatctcagctcgctgcaacctctgcatcctcccacctcagtcagcctcccaagtagctggaactgcaggcacactccaccatgcctggccaattttcctgtttttttgtagagacagggtttcaccacgttgcccaggctggtctcaaactcctggactcatgcaatccgcccacctcagcctcccaaagagctgggattagaggtatgagc

SEQ ID NO: 703816 - DNA, 1302 bp, Homo sapiens
gagacagggtctcactctgtcaccaggctgagggcagtggcgcttcacagctcactgcatcctcaaccttgggggctcacgcagtcctcccgcctcagcctcccaagtagctgggcatgcgccaccaagcccagctaattttgtatctttagtagagatggggtttcgccatgttgcccaggttggtgtggaattcctgggctccagttatatgcccacctcagcctcccaaagtgctgggattacagacgtgacccaccgcgcctggcgcaaatatgtattcttttaaaatttcctctgatactataagctttttgcatttatctgaagcagtatacatgcctttggtatcagcaattttaacagtttggatatacttatcagctatcttattccaaaactacatctacttcttccagtatagaatctggtgcttcctgaccaaaaagatgagaaaaacaatgttaaaaatatagatgctttccattgaaatggagtgaaaacattggttctatatgttttcttttaaaataattttcttattaaaaacttgctgtctttattatacttaccctttttatgcatatcaatagtatttataagatgtgttctataattatgtaattgtagatactgttatgcattgtccagtgacatcataaggcaggccctactgctgtatcttttctaccttcttatttgtaatagaaactatagaatgtatgactaaaaagtcactttgagattgacttttttaaaaagttattaccttctgctgttgcaaagtgcaaaactgtgagtggaattgttttattctgacttaatgtgttagaaattagagaatacagtgggaggatttttagacattgctgctgctgttacccaaggtattttagataaaaaatttttaataaacatccctttggtatttaaagtggaacatttagcctgttcattttaatctaaagcaaaaagtaatttgggtcaaaatattggtatatttgtaaagcgccttaatatatccctttgtggaaggcactacacagtttacttttatattgtattgtgtatataagtattttgtattaaaattgaatcagtggcaacattaaagttttataaaatcatgctttgttagaaaaagaattacagctttgcaatataactaattgtttcgcataattctgaatgtaatagatatgaataatcagcctgtgtttttaatgaacttatttgtattttcccaatcattttctctagtgtaatgtttgctgggataataaaaaaaattcaaatctttca

SEQ ID NO: 703817 - DNA, 106 bp, Homo sapiens
tgtttcttgggtgaaagaggtagtcagagacgcaattaaaaatggtcaggccatgtgtgcagtggctcacacctatattccagcactttgggaggccaaggcaggt

SEQ ID NO: 703818 - DNA, 121 bp, Homo sapiens
tctaataattatacgtagcggtcacacctattgacagcttattatataaagtcacatattgctgtattctcaagatgacacacctttatttaaatgagatgcttgctgtagattattcttt

SEQ ID NO: 703819 - DNA, 1356 bp, Homo sapiens
gagacagggtctcactctgtcaccaggctgagggcagtggcgcttcacagctcactgcatcctcaaccttgggggctcacgcagtcctcccgcctcagcctcccaagtagctgggcatgcgccaccaagcccagctaattttgtatctttagtagagatggggtttcgccatgttgcccaggttggtgtggaattcctgggctccagttatatgcccacctcagcctcccaaagtgctgggattacagacgtgacccaccgcgcctggcgcaaatatgtattcttttaaaatttcctctgatactataagctttttgcatttatctgaagcagtatacatgcctttggtatcagcaattttaacagtttggatatacttatcagctatcttattccaaaactacatctacttcttccagtatagaatctggtgcttcctgaccaaaaagatgagaaaaacaatgttaaaaatatagatgctttccattgaaatggagtgaaaacattggttctatatgttttcttttaaaataattttcttattaaaaacttgctgtctttattatacttaccctttttatgcatatcaatagtatttataagatgtgttctataattatgtaattgtagatactgttatgcattgtccagtgacatcataaggcaggccctactgctgtatcttttctaccttcttatttgtaatagaaactatagaatgtatgactaaaaagtcactttgagattgacttttttaaaaagttattaccttctgctgttgcaaagtgcaaaactgtgagtggaattgttttattctgacttaatgtgttagaaattagagaatacagtgggaggatttttagacattgctgctgctgttacccaaggtattttagataaaaaatttttaataaacatccctttggtatttaaagtggaacatttagcctgttcattttaatctaaagcaaaaagtaatttgggtcaaaatattggtatatttgtaaagcgccttaatatatccctttgtggaaggcactacacagtttacttttatattgtattgtgtatataagtattttgtattaaaattgaatcagtggcaacattaaagttttataaaatcatgctttgttagaaaaagaattacagctttgcaatataactaattgtttcgcataattctgaatgtaatagatatgaataatcagcctgtgtttttaatgaacttatttgtattttcccaatcattttctctagtgtaatgtttgctgggataataaaaaaaattcaaatctttcaaaaaccaacaaacaacacacaaccaccacaacacaaaaccacacaaaccacgag

SEQ ID NO: 703820 - DNA, 175 bp, Homo sapiens
  misc_feature (164)..(164): n is a, c, g, or t
cgtcggtactccagatcgatttttacgagtggttcaggggtgccatccggcagagatcgtgacgtcaattccctcaagcggagacgcgtcaatttcataaaactcttcggggccctggtagtattcgatatccagttccatcagtaactgtggcagtatgcccnttctgccaccg

SEQ ID NO: 703821 - DNA, 119 bp, Homo sapiens
ttagactgattgcatttagatagctactccataaacagccccatcacgaaaagaaaaatcgtgatcccgatataaaccattctaggtctacaatgctatcaggagatcctctagaagtc

SEQ ID NO: 703822 - DNA, 308 bp, Homo sapiens
ctcctttaacctcaacagtgatcctgaagagcctgatggatggagagctggtcctgtggggtgctcggactcggcacattacatcccaaccctcagcttcgtgccagtcacggtccccgcctattggcagatccacatggagcgtgtgaaggtgtgcccagggctgactctctgtgccaagggctgttgctgccatccttgagatacgggcacgtccctcatcacaggacccattgaggagatccgggccctgcttgcagccatagggggaatccacttgctggctgtggagtacaacctgcgcgtgt

SEQ ID NO: 703823 - DNA, 660 bp, Homo sapiens
catggtggctcacgcctgtagtcccaactgcttgggaggttgaggcaagagaatcgcttgaacccaggaggtggaggttgcagtgagccgagatcgcgccactgcactccagcatgggcgacagagcaagactccatctcagaataacagaaagaaagaaacaaagagaagaaaagcttatattgaacttctctaataaaaagacctaaagacagaaagcctgatgcacacagatatctaaagtttggcaagtcgatcaattagaggatatttatttggcatcacaaaataatgctttagctccccccataaaatcaataaaaggttcaaatagcaacttttcctaatgtgtttacaatgtatagtcaccggatgtcacctgctgtcgccgaactctcatggcgagttggctgcttgcggtgcaagacacggaattctgagagaagtgaactgcttcttgcaacacaatagatgacatgcccagaaccctcaccgcgattggtgagaccacgaggtggactgtgatgtgcgactgccttttcattgagcaagtgtaacagacattcctgataaaaatacttatatgaaattgccacgaaggaacgtcccttacgtttgcgtgccccggaactccttttcttttgcctacacaggtataca

SEQ ID NO: 703824 - DNA, 310 bp, Homo sapiens
agtgcagtgagggcacgaatagaatggtatatagattagtagtcccaatagtaacttctctacgcatcaacactcacatctagtaatacattagaccacagtagtctatgaagcttaattaaaaataggtataacaacttacacatacatgaataattggaatgcagaatcatatttaacttcccttacccagtctttctataagtcagtttgtatttaattcaacaattgtttttagagaggcccacatttattaaatgtatatcttgtacagcttaatttctctagaaccaatttctcatcctgggag

SEQ ID NO: 703825 - DNA, 184 bp, Homo sapiens
cgactctcttgtgcagcctctgcattcacctttagtcactatgccatgaactggatccgccaggatccacggaaggccctgcagtgggtctcaacaattcgtgctggtggtgaaaaatgcagactacgccgactccgctgacgggccgcttcaccatactccaagagacgaattcccaagaata

SEQ ID NO: 703826 - DNA, 403 bp, Homo sapiens
caagatattgcatatgatggtgaagtaatgaagccttaatctctggatagttactagtcaaacattaaaactgtcggaaattgagtccccaataaagtgaactaatcattggaggatctgtttctcggggacatccaattgggatgtctggagccaggattgttggtcatttgactcatgcgttgaaacaaggagaatacggtcttgccagtatttgcaatggaggaggaggtgcttctgccaggctaattcagaagctgtagacaacctctgctatttaaggagacaaccctatgtgaccagaaggcctgctgtaatcagtgtgactactgtgggtcagcttatattcagatcagctgtttcattttttattattttctatgttaacttttaaaaatcaaaa

SEQ ID NO: 703827 - DNA, 422 bp, Homo sapiens
tcagcattgtgacacttcccaaagaaggccaaagctctacccgacatcctgaactacgtggcattatacttttctggattgctcatttatggaaggctaaccctctgttgaccgtaagccttttggtttgggctgtattgcaaatcctttctaaaattgcatgactaggctctgctcacgtgatgagacaaactgaaaattatggcaagcattgactataataatgcagtacgttctcaggatgcatccagggctccatttccatgagcctgtccaggtcagtttactcctgaccagtaatagcattgtccatctgggcttgctgttgcactgaatcaacaaaccacaatacttcctgagcaccttaggtactttatttgaactatgagtctgtattaactgcttgggtccggagctcgaat

SEQ ID NO: 703828 - DNA, 431 bp, Homo sapiens
ccatttaataagtgaatccaaaattaaccagtgattaattgctcatcagatttaaggatgttccatagtctataactacattccagcaagatagactcatagatgattaacagggacatttcttggcttcctgaatattgtgggttcccccttaaaatgaggctgttcacaagattacaaaaccaagtcctataccatgattcagatagatcagtgaagaggagacagacatagctccatttgctcctccaactagaaatcctcactttctggcaaagatatacctttgataagttcttggatggcttcatcccaaactgccttacttttttggtgactgcattctttgttacaaaaccggcaatccctgcttccctcttcctctctgcttccctctttccctctgcttccctctaccccctctagagcca

SEQ ID NO: 703829 - DNA, 689 bp, Homo sapiens
tccccgctgacagagccggtggtggtactggaggggcacaccaagcagagtgggcatcatcggcgtggcaccccacggtccagagaacgtgctgctcgagtgcaggctgacgacaacagtggtactcatctggaatgtgggcacagcggaggagctgtatccgcctggagcatgcctgcaccctgacctcattctacaactgatcagctggaaccacaatggcagcctgttttgctcagcattgcaaggacacggagacgtgcggcatcagtcgagccccctgtcggggacaccctggtggcagagcgggagaatggctcaatgagggggcccggcccatgcgggccatcattcctggtcagatggcaaggtgttcaccagaggcttcaggcgaatgagcgagcggcaggtggcgctctgggacccagaaaacctcgagggaacccatgggcctgcaggaactggactcgagcaacgggggcctgctgcccttctacgagcccggaaaccaggtgtggtactacgtctgcggcaagggtgactccagcatccgtgtacattcgagatcacagagggagccgtccctagatccacgttcctgaaacaggtgcaccaagcagaggagccgcagcggggtatgggcagcatgcccaatgcggggacctggaggtcaggcaagtgacggagat

SEQ ID NO: 703830 - DNA, 1187 bp, Homo sapiens
ccacgcgtcggcaggagcaggaagccaacctgagcaaagacacgcagccctagtgttcccaaggccaaaaatgctgagaatcgtccactcctaatctgtgtggtggtctgctattgccgggccccctggctctcttctggctattctctgcctctgcctcactattcttgttaggccaggtgggcttgctgcagtggacacccccagtggctggattacgggccccctttccagcacccctctgacaccttgagtttgtgcatctgagctatgagtccttcgactgctgtgatcagaacaaggaccgccgcatcgagtgcccggtactggagacatcagtggaactatatatagatctgaagagacatgagctgtgtggagattacattaaagacatcctttggcaggacgtgctcgaccctacgcgagcaccaactcatacgacgccgagagaaacccagaggacctctccggaatctcccgggccatctgactctgattgactgctctgccttccattctaactgtcactcagccatttccctgctgaccaatgaccgcgggctccaggagatctcatggaacgggacggcacccgcatctggcacctcctaggaaccttacctgacaaggactattgcctaccctaaatgttcctgaaggaacgagtatctaaacagcactgggacatagttgcgcccaagaatcctcaggggtgacttgagaactgcctgagcgaaggataggcacacggggctgcagacacccagacaaccaaggcgaccaagacggagcaagggacccaaatacgcacacctaaggagccgagcaggaagaacatagaaagagaaaaacaacaacataagagagaagccagaacaaacatattgacagtaagacaatcgtttacacacaaggaagggagtaaaacagaagcggtaactgaacaggtagtaataaaccaaagataggcgcacagcgaatctatatgataacagcagcagccaacgaaaaaccaacaccaccagctcaaagagatgcgtagatacaaaatcaactaaacagatagacaataaagcacaaacacatcgcacaggtgttgcatgccaactagacatgaaatacaacgccagccactccactcctgtgtgtctgtctccttagttttacaaacgagagctggagag

SEQ ID NO: 703831 - DNA, 481 bp, Homo sapiens
  misc_feature (281)..(281): n is a, c, g, or t
  misc_feature (419)..(419): n is a, c, g, or t
attcttctccacagctgcagactttcctgggctgtatttctcgcacatctctgaagagtttaatcttcagctcatcgtgtccaggagtggatcataaaaggaatattttttttcctaggagcagtgttaaaatctgtgtcacattcctgaccaaggacagcatcctggcttctggccatccccttcagttcacaaaagctgacattttaaacaaatcatgactcacacgtattaattggttataaatatgttgtgtacactggttagataaaacttaaggncacaaggaggggccaggtaggcgatgtcagtgtgtgaaggggctggattgggcgtggtgaggatgttggcaaaccagtgcatgcacctggttggaagatgctcagccttacaaaagctccaagccctttgtgagccanagtgtctgagagtgtgacccactcctgtaaagtatttatcccacccattaatataatttctg

SEQ ID NO: 703832 - DNA, 527 bp, Homo sapiens
ggtctagtacaggaaactttcctttctggataatgaagcaggtaatggaattcagggtatagtgttcctgtgggggtcattagccgttaacttcttgtgagatgcgggggaggggagcagaaaagtctaagcgacaaaagggcatgtagggatatttgctcctgcagcttgcctatgctgtaaattcttacttcaagtattgaggaaacaataagcgaagtctgatttcccgggcgcctttatacggaatatttcccgctccacaaaatgaaatcgcagtagttttgagttataattgtttatcaatgacaacagctatgcagtttacatatttcatgcatcccagaaatccagattcccatttcctaagccacttaacgttctgatttccagctctgcgagatacaaaagggtttggattttgtgcccttccccatctggcgccactgcaaagcttactaggagggccccacttggagagggaaatctttttcgagaagtccaggacgccaaaaaaaataaagcta

SEQ ID NO: 703833 - DNA, 1112 bp, Homo sapiens
gggttgggtttccatagacgtctgggagacgccaggcgtacagtaaactacgccgtcgtacagcaggaagagagcgatctcctggactaaggggacagataagaaactcagatatggacttaggtatctgagtgcccagaccctaggtgccctgttctaaacacgagagcaccacgtgtcatcatcggacccgtcgtcgtgaggctcacatttgtctagcaagcagtaacgaattatatggggccgtatatatgtatccacgcacaaggtgttacaaactgtcgacgtcagcagaagttcactagtaactgaccatgacaaggacctcactatagatgtagtatgaccatgtgtggaacacacgaatacattttaagctgggacagttaagaaggctcggtacagttcaagggcctcgattaagcgtcgccagtacaatgctctaaacaattgtccggcgagtaactcagagacttcgaatgttgcaaggtacattcatatacattcgagcctgtcgtgaatccagatttgcataagctttgcttccattcgagctcaatgacattactaatacgtgttataacactcacgaaaagtcaccactcattatcttctacaaggtcacacgggcctgcagtctggggcactaactgagttcaaagcttgaccttccttgccttcacacgtccacgtcagaagccagggcgaataacattcggtaaacaagccaaatccggcgcacgtgccaccctcgaacgggccaacacaccatcaccgaccgagaaaggaagggcccaaaagtgtgcaccacaactttctgagaccaaaaggggacgcacaaaaaacgggaaacacattagccctgagaacagcttcctgggtgcaaacaccaaaatacagtgactacgaggaccccagacattaatgcgcgggcatgactacggatgactcacaagcacacatcgataccagaatagacataaagccgcacaagaccatccatggaccacatatgcggggacactcatgtaagctgactgatatgtggtcgggtcacctcagcattcctcttgtctcgccttttctctgcatgagcattaatgacacagagg

SEQ ID NO: 703834 - DNA, 662 bp, Homo sapiens
  misc_feature (150)..(150): n is a, c, g, or t
  misc_feature (165)..(165): n is a, c, g, or t
  misc_feature (168)..(168): n is a, c, g, or t
  misc_feature (178)..(178): n is a, c, g, or t
  misc_feature (228)..(228): n is a, c, g, or t
  misc_feature (258)..(258): n is a, c, g, or t
  misc_feature (338)..(338): n is a, c, g, or t
  misc_feature (420)..(420): n is a, c, g, or t
  misc_feature (540)..(540): n is a, c, g, or t
  misc_feature (557)..(557): n is a, c, g, or t
  misc_feature (559)..(559): n is a, c, g, or t
  misc_feature (561)..(561): n is a, c, g, or t
  misc_feature (570)..(570): n is a, c, g, or t
  misc_feature (592)..(592): n is a, c, g, or t
  misc_feature (594)..(594): n is a, c, g, or t
  misc_feature (609)..(609): n is a, c, g, or t
cggaccgaaaagcaggacatagaagtaaacagcaaatgaaggcatcgagagataagcaggagaatcgcttgaacttgggagatggaggtagcagtgagccaagatagcaccactgcattccaacctgggtgatgaagtgagactctccanaaaaaaaaagaaatnatnaatcccggcnggtgctctacatagcctcaggggcatcatgggatagctcagagggccctngattctgggcagggcaaataaagccagaangagaaattaccatcttctactagagaaaaccaagagaaaaatttttatgctaggatgcctttatgaccacttaatttttnaatcttagttaaagggtctctcccgggtgctaacggctgacaggggccacctctttttggggggtggaggggcctacataantagcgggccttaccccatatctttggttcaaacataataccatcttttggcttcttctgaactttagatctccataacacatgtacggtagaaggtgagggaaaagcatggatgagaatntatgggcagttcagatngngntttcccaanttaggctctttataaatgggtnanggttttctccaaaangggcttcaacagtgggactcatttagtgtaccgggggcacagatactatcttc

SEQ ID NO: 703835 - DNA, 427 bp, Homo sapiens
tggtaatctgtagagtgcagtgacagaaactcatcttactagtgtggagtggaaaagcgatcatgtttttctgtgcactccccaaccccaaccccaagcagatcctgaaagaggcacaggattgcaagtggattatttaggagatgattccagggaacaccaataggggagtgaggaattgattcatggaaaggcaggaggccacacagggggcttcaatgagcagcttactactccaggcaactaggatttgaccccactgtggacctctgcgaggtgatgtggaatagatttcaaagttgttccatccagggggcgaagatattgaagcatttatagcctggctcccatccgtcactggctgaggactggtcccaggcatcaactctctggcttttcttttttcttttctttttttttttttttt

SEQ ID NO: 703836 - DNA, 108 bp, Homo sapiens
gaatggaaagtatttctatttgtcccttttttgttttctgttctaattgtcagggacatatgtagtggctataggtttccttaaaaggaataaatttggaatgctcca

SEQ ID NO: 703837 - DNA, 420 bp, Homo sapiens
tacgcctgcaggtacggcccggggtacgggtcgacccacgcgtccgtggatgctcacagtcatctatcagatggaacacaggtcccccaggggagaagctagagaaagcacccaaggagctgaaggggtctgcagccctataggtagaacaataatatgaactaactagtacccccagagctcgtgtctctagctgcatatgtagcagaagatggcctagtcagccatcattgggaagagaggccccttggtattacaaactttatatgccccagtacagggaaatgccaggccaagaagtgggagtgggtgggtaggggagcagagtgggggaaaggtatagggaactttcacgaatagcatttgaaatgtgtatgaacgaaattatctaataaaaaacacaacaaaaaaccaaaaggg

SEQ ID NO: 703838 - DNA, 404 bp, Homo sapiens
ttgaggatccccctgcatcccggggagtacctgccacagagaagggaggtgcactggcatatcggactcatgccagatgtagcaaacaagctgagagagggtgtggcatggcttgcattcagcactactgagccttttctctttgcctacttcctcattcccctttctccatgcattttcctgtctttcccatcattaaatgttgaaagcagaactagaagtgtcaaaggccaaccctttaccttccttctcctaaatgagcctttcttctgtttggtttacaaaatgccctgaactctgagagcttgagcagtctcttaatcactgtgactctcaatctccttaccccaaattggagtcatacctaccgtccccccccccggatacagctccccgggatacag

SEQ ID NO: 703839 - DNA, 1246 bp, Homo sapiens
  misc_feature (272)..(272): n is a, c, g, or t
  misc_feature (475)..(475): n is a, c, g, or t
agcggactatcaccctgggctgcggcttctgaagcttgcctgtgagctcatgtgagactacatgggagaggctgggctgttcgggatgaaggcctgggtgggctctaacgctcccgcgtggagggcgaaggaggcctagacgcagtgaacatttcgtaagcggatgaccaacgcgcgcgttgtggaagagagccccagtcaccctggcctctggttacactactgtcccctgggttaccgtcacgctagccgtcattctgctgtgcattcanactgtttggtgcatcgctgtggtcgtgttttctcccagctgtcgccttcggttctgttcggttccattccgctgtctgcgacgcgtgggcatgcgcgtcggagcacactgcggagaaggtgggtgccgtgtgtctctggttaatcaaccaagtggcattcgcacatctttgtaggtacacttgtagcgctctacttccagttnctgtggttgtctcacattctaacacttcttcagaaacctcttggacagttcttcacaatcaacgggcttcctgacttgtacgacatgggactcgcctttgcaatgagtagctacgttgcgtatgttcgtgcgtattgaaatccgacggggtgtgcactttccgtgcacgtgacaatatatgtgtagtacctaacattgtcgtctcgcatttttcctacacgggtcccttgaacccccggtgcatttttaaaacaacatgtgtccgcccttaggatatgcgaatacctattcattagtaggtacgagggaaacttggaatcgtatttttgcatcgctactcaatcttccgttgatcctgggttgggaggttcccaagctccaatcctagggctactttccggacttccgagcaccggttcgaaacacatttttcccagcgcatattaccttgtacagattgccctttggccatatggtttgcacctcggttacaccccttggtttgcaccagttctttaacatttactgctgcggccggcccttcaactagggcgttgggcgcttccagccccctttgggttccttccgaatttccttggtgcggcctttggggtttggcacagctattcctataagtttcgcaaaaccgctttgggccccctttcctttcccgaagctccggtaaccggaatttggcggccccagagctcccggggcccaatgtcccgcatgcagagttagtgtgcccgcgcttggataccctggggcccg

SEQ ID NO: 703840 - DNA, 431 bp, Homo sapiens
  misc_feature (3)..(3): n is a, c, g, or t
  misc_feature (11)..(11): n is a, c, g, or t
  misc_feature (29)..(29): n is a, c, g, or t
  misc_feature (38)..(38): n is a, c, g, or t
  misc_feature (43)..(44): n is a, c, g, or t
  misc_feature (48)..(48): n is a, c, g, or t
  misc_feature (50)..(50): n is a, c, g, or t
  misc_feature (59)..(59): n is a, c, g, or t
  misc_feature (72)..(72): n is a, c, g, or t
  misc_feature (99)..(99): n is a, c, g, or t
  misc_feature (103)..(103): n is a, c, g, or t
  misc_feature (113)..(113): n is a, c, g, or t
  misc_feature (117)..(117): n is a, c, g, or t
  misc_feature (119)..(119): n is a, c, g, or t
  misc_feature (123)..(124): n is a, c, g, or t
  misc_feature (139)..(139): n is a, c, g, or t
  misc_feature (160)..(160): n is a, c, g, or t
  misc_feature (206)..(206): n is a, c, g, or t
  misc_feature (216)..(217): n is a, c, g, or t
  misc_feature (219)..(219): n is a, c, g, or t
  misc_feature (225)..(225): n is a, c, g, or t
  misc_feature (228)..(229): n is a, c, g, or t
  misc_feature (232)..(232): n is a, c, g, or t
  misc_feature (254)..(254): n is a, c, g, or t
  misc_feature (257)..(257): n is a, c, g, or t
  misc_feature (259)..(259): n is a, c, g, or t
  misc_feature (261)..(261): n is a, c, g, or t
  misc_feature (269)..(269): n is a, c, g, or t
  misc_feature (272)..(272): n is a, c, g, or t
  misc_feature (275)..(275): n is a, c, g, or t
  misc_feature (277)..(277): n is a, c, g, or t
  misc_feature (282)..(282): n is a, c, g, or t
  misc_feature (286)..(286): n is a, c, g, or t
  misc_feature (303)..(303): n is a, c, g, or t
  misc_feature (312)..(312): n is a, c, g, or t
  misc_feature (318)..(319): n is a, c, g, or t
  misc_feature (350)..(350): n is a, c, g, or t
  misc_feature (360)..(360): n is a, c, g, or t
  misc_feature (362)..(363): n is a, c, g, or t
  misc_feature (365)..(365): n is a, c, g, or t
  misc_feature (371)..(371): n is a, c, g, or t
  misc_feature (417)..(417): n is a, c, g, or t
tanaaaaaaantttattttttaggaaaanagccaaaantatcnnaaangngaaaaaccncaaccaaaaaacngaaaaaaagttttaggaacaagggaanatcntattgtcacncatncncagnnaaacaccattttaangcagggccagagccaaccgcngtcccgtccaaccccaaagggacaagggcccggcccccccccccgngtaccgcccnncncccccnccnnacnggggccagcaaaaagcagaggnccncngncttccccncangcngngatcntggnttagagggagggacagngccgccccngccgcnngggggtcgcgttacttaggaacagcagcccntttttccccncnncngtaggngccttcccatgtggaagccaattgttttccaaaaaaaactgaaaanaactttcaaattcc

SEQ ID NO: 703841 - DNA, 549 bp, Homo sapiens
atacttacctggcagggttgatactattatcaaacgaaggtggtttttctcagggcgaggcttatccattgtgttccggatgtgctgacctctgcgatttccccaaacgtgggctcgactgcataatttgtgttagtgcaggactgcgttcgcgctgtcctctggagcttttgcgttgcgaataggagatgagccgtaagtgcttttggaattcagtgttcgtcctcgtgtttagcggctgtgatctgcccggtcaggtgcaccggactgcaccgcgtagaccacaggttggactttattcgaagctacagcacttcacctgtcactcattctgttgtctctccaacctcatcctattggcctggacacgctactctttacaacccatcctctctcttgctcgtgtctcctttactgccgccctaccctctctccccctcgccttaatttttctccttgtcaccctcttaatttcgctactctctattcgccgcttcactccctctcctccctttctacatcggtacactccttccccttttcttctcc

SEQ ID NO: 703842 - DNA, 290 bp, Homo sapiens
agatgtctacagagacttttaaatctataatccaggagtatataaccatgtagcacagacaattaagccaaatgcaaataaattaaaatcttaccaaaatatcctataaacactgcaactattcttttcaaaaggaccctaatcttatgtgaaaagagctactgtgtgggaaccagaaacctagctatactgatctaggaggaaaggagcaattcaagttgcatgtggttggtgggagcaggcagtagtatgtctcgctcatttattttgctgctgttgctgctgtattg

SEQ ID NO: 703843 - DNA, 370 bp, Homo sapiens
ggtcgacattcgattccatttgatgataattccatttgattccatgcgatgattctattcgattccattcaatgataattccattcagttcagtgattcctctggactccatttgatgatgattccattcaatgattccattcgattctattcgaaaatgattccatttgaatccatttgatgatgattccattagattccatttgatgattccattcgattccatgcgacgatgattccattcgattccatttgatgattccattctattctattcgatgatgattccattcgattccattcaatgatgattggattcgattccatttgatgatttcatttgattccattcgttaatgatttcggtcga

SEQ ID NO: 703844 - DNA, 196 bp, Homo sapiens
  misc_feature (16)..(16): n is a, c, g, or t
  misc_feature (156)..(156): n is a, c, g, or t
cttaaacgcactgganatatcctggtgctatgtacaaatcttccttgtgtaatattctcagaagtgggatttcttgaatcagagagtacataaaatttctagataaagtcaatagcttttcaaatcaaatgcaatttacatgctattagcagtganctgagaattttacactcctcgcacaaaacattcagtaaca

SEQ ID NO: 703845 - DNA, 552 bp, Homo sapiens
  misc_feature (265)..(265): n is a, c, g, or t
gttatgatctagaggatcccgttcgggctccattcaggctctccagaagggtggggtcctgtgcccctccgtgaacccaagttgtgctctgttactacttggaccagatgtgactccgccatttctgtgcctaggctttaaaagatggtcacttctccatttccggtgcctggaacattctcggggagccttgacaccacatttgaagttgcctatgggggccagcagggtggctcacgcttgtaatcccagcacttcagaaggncgaggcaggcagatcgcatgaaatcaggagttggagaccagcctaaccaaggtggtaaaacccgtgtctctactaaaaattacaaaaattagaggggcgcgggggggggcgcttgtaatcccagctattcaggaggctgaggcaggagaatcacttgaaccggggaggcggagtctgcagggaggtgaaatcacgccagtgcactccagcctgtgcaacagagcgaggctctgtctcaaaagaaaaaaattagttgactgtcggtttggcatggtggctcatgcctc

SEQ ID NO: 703846 - DNA, 140 bp, Homo sapiens
tagaggcacaaggagggggggtttgtggttagagccccagccaggaaaggagagagtccagaatgttccaagagtctagccgcagccccagacaccatgagctggagggtcgggatggggcagcctccttgtgcctctgg

SEQ ID NO: 703847 - DNA, 105 bp, Homo sapiens
catatgagcgggaaaacgtttagcgaatagaaactttttttctgaatgtgggttttctgtgtccttttggcctactcccaagaaggatattggtagagctattga

SEQ ID NO: 703848 - DNA, 1101 bp, Homo sapiens
gaaaaaaaaaaaaaaaaaaaagagtttggggaagaagaaaatgaacaaagggagactatgagttgtttggtaaaaggagcggctcagctgtttgggaaagtgcctacgtgacattccagaaaatctccaagtggatttgtggttcttgggctctgtgtggggtttgacacgaagaaaatgtgttcaggtggcggtgagtggaccacagagtgtgcaacaaggcagggtttggcaggcgtggaagatataaccatgtgtgtgttagcgccacttctagaaaagttctcgtgctcgtgggccataacgtggtgggtgctcttcagacactttgtggggaaggccaaggccagaacagggattgtgcctgtgagccccagggagttctcaagaaaccaagccctgtggggacaaaacaactgagtgtgcaagacagcctcccaactcgtcttagcacacaaaaaacaatattttttataagcgccccgaggcatatgtgggcgtgggcccctcatgtgcgcccgtgtataatctccccacaagaccaacctatgtggcgaaagggcccaaagggtgtgtgggccgggtatctcacaccaggggtgctccaggagcaaggttctccacaagaaaaccccgaagtgcctgtggccccacaaggaaatgtacatgtggaaaaaccccccccgcggttcgttgtgttccttaaaaaaaaatgttaaccaaaaacaaatctgttagcccccaaggcgccgtttgtggtgtgggccaaacgtcaccacaccctataatattaaatactcactataaggctcattaaccatcacgaggggcacagacgtctttgtgacaagcggcgcgggcaacaagacacaatttggcgcgccctgggaaaggccccctgtggggaggagaacgaaacccagcgcaggtctttttgccactgcgtggataaccccctgggaagaatattgagggcgcccccaaagtcgtggggacccttcacccaaggctctgtgtaaagcagtgctaacaccagtgacgtccaagcgagaacgtgtggttgctcttccagaccacacacactgacacaaccgacacaca

SEQ ID NO: 703849 - DNA, 913 bp, Homo sapiens
tgcttgcgaaaatctgtgatttcatttgattaggctaaaagggtacataggcttgattacactgaacgctgcatctatatgtcactgacataaagtcgaaaacacataacatgcaggcaaataactacagtacttctttaaagggggtctggctgggttctgctctcactgaacatggccagtcgctgattaaatgtgataaaaccccataatctgtttcggtatatcgtacacaaaccttacaaaaataaactgaacttgcaatatggtttgcaccaaaatctgtcgttaaagactgaggataaaatacctgctcaattgttattttactaagtatatatttacatttcacccaggcaggtcattttcttttgtgattatagaaagagtagtcgttgattaaattttcagactaaatataggacaggtacaatttgggataaaatagtcacatttataagaaccggctaatgaacagactgacttgaaatagatgcttgtgactcatggaacagtaattgcatccagccgatttcaaaataccagattcactgatgcataaaagtcaatacatattcgaggaataaggtctcctaaaatcttaagcttcacgtaataatgttgcgtagcaaatattactgcgtctagcctttaggaattaagatctgatcagaatttagctaaagggtagtgtctaacaatgagactaaaactgacagatggtgcctgccctgaggcaaacttggtagtgtcggcaggtgttatacaggctggcagaggtaagctgtccagggacaattgggacactggttaaccaagggattttaaagggtccttacaaaagatgccggacaattccttccggtaccccaccttgtgcacagtcagtgggaaagcgagccacacaataatg

SEQ ID NO: 703850 - DNA, 195 bp, Homo sapiens
cgatggtgccttggatacgcgggtgctgccacagtcttcggctgatatcaggcgaagactgtgtgcacgatgacgaggatgccacaggcaatgtcagcagtctgctcagtatgtctagcacagcaagattcgttatgcatagttaagtggttcttcgtgtttacttgcatctgacaccctattatacctaaacag

SEQ ID NO: 703851 - DNA, 116 bp, Homo sapiens
ttttttttttccccccgggggggaaaatttaaccaaaaaaaattggctttcaaaaattttgttttcctttttggggggggggggtttggggaaaaataaaccccccccccctttta

SEQ ID NO: 703852 - DNA, 351 bp, Homo sapiens
cgtgaagaattaccaaaaaaaaaaagttctgagcccagtcctttattatctcaggagattttacttcttgaccaagtcaagacatgatgtctctattttcgccgctaatggttttctctagatctgattctgtgttagcggtatcaaaccaacttagaaatttccaattcatgcacgcagttttcacccatgtggtcccaggagcctctgggcccaggcagaatatggaagggtacagggttacagttacaggggctgaaggtgagtctataattcactaattcaaaagtttagttaaatgacctcaaagtatttatagagtttccctagtgaccctgcctcgtaaagctg

SEQ ID NO: 703853 - DNA, 1001 bp, Homo sapiens
  misc_feature (374)..(374): n is a, c, g, or t
  misc_feature (661)..(661): n is a, c, g, or t
  misc_feature (786)..(786): n is a, c, g, or t
  misc_feature (817)..(817): n is a, c, g, or t
  misc_feature (825)..(825): n is a, c, g, or t
  misc_feature (865)..(865): n is a, c, g, or t
  misc_feature (909)..(909): n is a, c, g, or t
  misc_feature (937)..(937): n is a, c, g, or t
  misc_feature (944)..(944): n is a, c, g, or t
catgttgtggtgataggcgctgcctttgttgtggagcccctcggggaatatgtgtctgttcgtcccgcccgcgttctgtttacttacgatgtgtgcgctttccccagagggggtttttggccccggtcgccgatgttcggaagtttgattcgtgtgtgtccgtgctccaaggtcccccccaatcctgttctaggcgttatccgccgggtggtttgccagccctgtgtataacccgtgcacatttgccttgggttctcacggcagacacatgtggtgaaattctatggcttgtaagtgccccagggcccccttggtggattccagatgtctggaaatggaagagaactgggagagtacggtttccatgaatatanccgaggtccaaacagtcaccgtgaaatctctcagaagaactcattaagaaataccagagtggagagaagctcttccatagctaagcatctccttaccgtccctaatatagtagattttaaagaccaaatttttcttttcttgatttttttaaacactaagctaaatcactattagtattaaatagctacccactagaaaccttgaccactgtagcttcttctgaaagaattatttgcccttctgaaaatgtgaccccccagtcctatcctataataaaacaaagccnaattcggaatgtatgatctctctagcctttgtcaatagttaatgtgattttcctcttgtagctaacttttgcacggataataattttaatagaaaaggaaccacgttgcactttagctttctttncccttagtgaacttcttgaagtacttaaacnaacaccgntaactcgcacgagtaaattgctctgttcccacgtagttantaaagtccttggagctgttttgaaaagtttcctaggaatgtcantgtctgcttgtccaaagaaataatcccngtaatantttagctgtaaactgaatataaagcttaataaaaaccaccttgcatgattcttgtta

SEQ ID NO: 703854 - DNA, 689 bp, Homo sapiens
gtggggaagactggttgctgctgtacggaaatcgtaagccgggtggagtgtgataggtgactcgacgctagggagattcaattcaacgcgatcactatgtcgacagacacattggtgtctcaccttccttcatatgaggaagatcagggatcaaaattcattcgaataacgctatagaggcacacattggtacccgttgaaatagtgggttctgagacgaatttgtagcatatggattatatatagtgaagatgcaggtgaagatattagtgaatgtgcattcatcgtgatccacatgcgtgtggcagccaaggctttgttgtaggagcaatgactgttggtatgggctattccatgtatcgggaattctgggcaaaactaagcgcttaggaagaagagatgctgtcttggtcttgtggaggagcttgctttagttagatgtcttattattaaagttacctattattgttggaaataaactaatttgtatgggtttagatggtaacatggcattttgaatattggcttcctttcttgcaggcttgtatttgcttggtgaccgaattactagtgactagtttactaactaggtcattcaaggaagtcaagttaacttaaacatgtcagctaaatgcacttggatggtggttgaaatgtccaccttcttcaaatctctaagatgaacttat

SEQ ID NO: 703855 - DNA, 838 bp, Homo sapiens
cagaatgggtcccggcacacatgggggtgaaacaaagaggtgtcccaaaagacggaaatgctgccgccgaggctgtttgtcgcggcaaatgtgggcgtcgggttttcggtaacaaataaaacagcttcgtcccggcgccagacaatgtggcggctgttgtgaaccacgtgcctgccccacgctgtttctctccgccgtcatatggtacgctgcttcgccatcctcttatctggaccatgctgcatgcaacatactgcgtccgcgggggccttttccatgcaagatattaagtcccctgcgccttcctctctcaagaatagggtcagtcacgtcgccccaaatggagggcaacacgtgagtagacccctgccaatcaattgatcttttctaactacgggaaggcctcctccgcagtttgtttcgtatcaacgggtgcgtggtgtctttccactgtgtgggggcacaatcactcgcgctccccccactacaggtgttagtcaaattgtcgcccgctttacccccccccgagggtactttcacccaatgcagtggtcccaccaactcttgtctttctgtggagtgctggccccaagagagcatgcattttcttggttgtgcaattccctttggtttgttatagttgctcatcacactctaatgtcagatagtggagcacacgccttcgtgtgtggccttccgcccaccctcggctgcgggcagtcagtttgttccacccaacgaaagacaaggcgctacccgataataaaagaaacaaagaacacaacaacaaaccaactcaggatacgttaataacaaacagaatacaacaaaaaacata

SEQ ID NO: 703856 - DNA, 804 bp, Homo sapiens
tgccgcctgcgagcgggtggcctagccctaatagtctcaatctccaacataatatggctagatagtacataactaaactaatccaatgctaaaactaatcgtcccaacaagttaatatcctacccagtgacatggattttccaaaaaacacacatacatctggaattcagcacaaccacccacagcctaatttaatagcattcatcccttctattaattttttaacccacattcaagaaaccaacctaattttaagttgtgccccaaacctttttcctcgagaccccttaaaaaacccccttcttaaatactaaactagctggatttcatacccttcaaaaattcatggcaagccaaggccactttatccagtgaaccacttatcgaggaaaaaaacgtctaagctctctaatagctaatctccctaaaaaaatctccttaagttattacacattcacagccacaagaacttacatcatatttaatatcttcttcgaaaccaacatttttatcccccccacttgggttaatcaatcacccgatggaaggcaacccaagcaaaggaacggcctgaaacggcgagcgcaattactttcctatttctaccaccccctaagtagtagcgtcccctttcccctatatttcatcggcacttaatattgaacactccaaaaaccacccctaagggtacactaaaacattctactaattcattctcagtggccacggaattatacaaatcctggagcaaaatttatattggtgaggttaaacaaaataagtttaaaagaaaggatacttctg

SEQ ID NO: 703857 - DNA, 311 bp, Homo sapiens
tataagtacaatcaacgtaggcctcaactcaatcgcaaactataccaaagttaaagaaactataagaagcttgaactaagcgataacagagtctcaggaggcctggaagtatcggcagaaaagagtccgaacctcacgcatctaaatttcagtggcaacaaaataaaagcactcagcacaatagagccactgaacccgttatcccccctcaagagctacacacttttccattgcgaggtaaccaacctgaacgactcaccgagaaaatgtgtacccagctcctcccgcaactcacatatctcgacggctat

SEQ ID NO: 703858 - DNA, 217 bp, Homo sapiens
ggccttcgtctatctaccgtgttaggcttaggaccctaagtactaagtgtgtccaggaggctggaatctcatacaatggaggaaatttggagattaggataaagatttggagaaagaggcatgagaagctaaagatgcaggagttgcctatgctggctcttgcttcgtggtcatgcagtttaacaggccctgggtgaaggctgagggctgctgtttt

SEQ ID NO: 703859 - DNA, 356 bp, Homo sapiens
  misc_feature (91)..(91): n is a, c, g, or t
  misc_feature (97)..(97): n is a, c, g, or t
  misc_feature (116)..(117): n is a, c, g, or t
  misc_feature (124)..(124): n is a, c, g, or t
  misc_feature (139)..(139): n is a, c, g, or t
  misc_feature (179)..(179): n is a, c, g, or t
  misc_feature (195)..(195): n is a, c, g, or t
  misc_feature (214)..(214): n is a, c, g, or t
  misc_feature (219)..(219): n is a, c, g, or t
  misc_feature (238)..(238): n is a, c, g, or t
  misc_feature (245)..(246): n is a, c, g, or t
  misc_feature (263)..(263): n is a, c, g, or t
  misc_feature (270)..(270): n is a, c, g, or t
  misc_feature (276)..(276): n is a, c, g, or t
  misc_feature (339)..(339): n is a, c, g, or t
  misc_feature (344)..(344): n is a, c, g, or t
tgtgtctcttgaacatacttaggatattctgcacattatggaaaaaggtaaattttagaagtttctgctctactaactgtagatatttatnaccctncgagttatctatttttatnnccacctnggtccatttgttcanttttaatttcacattttcttattgaaggtattggtaacangggaggggagacaccntatgattaggcagcttcanttttntactacttcagccaatctntgaattnnaaaaactacacttgttngccttgntagganccaccctcctgtaatatggaacaaatatctgaattgaatccaccctaggggacggggtcaaanctaancttgtggttttt

SEQ ID NO: 703860 - DNA, 418 bp, Homo sapiens
ttgcgctgtgtaacacaagatgcctccgtgagaggctggtggtcagccctggggtcagtaggttaacataagatgcctccgtgagagggtggatagataaaagcatgggtgtaagataagaaggaagatcactaggatagtaatcaagacatgtactataggatagcacatgtgataaaagaaaaacaggagacagagacgataaggctatgggccccagaccaaacggatacacagaagaggcgagccagaacagctaatgcaaaaagtaagaatgagaatatgaattataaaggcaaaagacaaaacaataggaaacagataaatatatcaacaatgacaatgataatataaagacaacaagaattgcatcaaacaacaacagaagaagagaaacagcagaaaacagaacagtaca

SEQ ID NO: 703861 - DNA, 218 bp, Homo sapiens
ttgacctagttaattttcataggagtccttatgaatgtagtttaaaatatggaattgatggtgatatggttaatcaaatcatttgaccaagttattataaattatagaaattaagaaacagtgagaaattataggtcaaataattttctgggctaaataattaatcaaagctacccatataagattgttaatttaatattactggagtataattgagg

SEQ ID NO: 703862 - DNA, 990 bp, Homo sapiens
ggctgtgcttttaaaaagagatgcttgcaaagcaatagggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaacagtagtaagtaaaaggctacctaggaaactacttcagtgaattctaagaaggaacggcacggaagacaggaccggaacacgaagggacgggaaaccaggggagcaacacgggacacccacgacagacccaccagacgaacacgactgaacaatacggacacaaactacaagacaaaccaacattaagggccatattgtacgatttccatgttaatgatctaatataatcactcagtgcaacattgagaatttcttccaatggctcaaaaatggaaactgaacagcaagtcatggggcaatgaatcactttgggcagtatcttcctcaatggtcttcgttaagcccaaaaagaacaagagagagacgacggaacaacaacatatatacgaggagcctccgaggcccaagaagaaaggtctagaaagagccacaacgcagttagggccacagcgaccacaagagaggcaaacaaggaacacactgtggccagactagttgtgcaccaagcgaaaaacacgcgggcacaacacaaaagaagggcggtgagagcattaccacacaaaatcaacaacagccgggaggaaacaccgagagtgtacgaaacaaaatccagaatgagctccggagaccagccagacggagcataaacagaggagtccagcaaaccaataagaaatgcc

SEQ ID NO: 703863 - DNA, 107 bp, Homo sapiens
gccgcccactcagcattctttacttttctagtcataacctattttcacgctggaaaccagaaaggctggttctatgtgcagatagcaatgctgaggtttagaggtaa

SEQ ID NO: 703864 - DNA, 197 bp, Homo sapiens
attcattccagcgtagtcctagatcgctgccattgcactctagcctgggtgagagagcaatgagagcaagagcctgtcttaaaaaaagaacaaacaaaagaaaactccaaaataaaaggggccaaaaaatccttaaaagggttcgctcaggggggggttgccctgagaaatcccagtccccccccgttggcggggcc

SEQ ID NO: 703865 - DNA, 831 bp, Homo sapiens
agcggcattactactaataagtcgaataataccaacgcgtggatagagaaaaaaaaatcaagagaattccaggaaaaagaaaaaaacaccaccggttagatgtatcctacaatttgcgtataattcatttggaagaaggttgtgctctgggacgtattttggagtgaccttctttcagccagaaacaatagacataagttgtcccaggtgtgtggatggtgcttgtggctctaaaaagtgacacgttgagactctcttgacaagaatcccaacaactgtacaaataaaagacctggccgggcgcggtggctcacgcctgtaatcccagcactttgggaggccgaggcgggtggatcatgaggtcaggagttcgaggcctgcctggccaacatggtgaaaccctgtctctactaaagataagaaacaaaacaaaagaattacctgggagtggtggtgcgcacctgtcatcccagctactcaggaggctgaggcaggagaatggcttgcagctgggagatggaggttgccgtgagctgagctcgcaccatatacactctagcctgggcaacagagtgaacagtgagactccggctcaaaaacaacaaggcaacacaattcaggttttacacacttgtgacctatttattgcgcgtgtaaggggtttgctcaaatatatgtaacataatgttaaaagatgatatagtgtggaattatagtcgcaatagtgaagaaatgtggagttacaatgtggatacacgagtgagagaactgttacacaaaggagattcttgagaaaatggaaagagtaaaaatgcacaaagtaattgtaaa

SEQ ID NO: 703866 - DNA, 356 bp, Homo sapiens
catcgtgagcagcgacagctaagacttggggatcatctgacactgtccataatagttttgtctaagattttcatagagtgtctataattcttctctattttaacctctacagcattctctgctacaaaatttgctgcagatttttgcacaggactccattccaaccttccagatttaagttctgaactgtattcatcaaatgaactaaggtcctggacactctctccaagtttttccaaaagaaatttgatatcttcgctgaatgttatctatcgtacttctgctgtgccaagttctccaactgtttctagaactttgcactgaatatagccagggctatattcttggcgagtcac

SEQ ID NO: 703867 - DNA, 319 bp, Homo sapiens
ttgagtccgggtagggcctcggggttatgaacagagcagagacatcagagcgtgggggtcacctggctggccgggatcccagcttcagccctgtgggagtcctattgttcctgtcatgcacttatctggtttggcggcagtgaagacaattggtatcctactgtgaagccctgggccttgcagaaggcggtgaatttctcctattaactacagccctggggggtctgcggttctggcttgtagacgggtggccatgctggaaggtccttcgtccagggaccctttgctggcccttggcttgatacatgcaagcggcgta

SEQ ID NO: 703868 - DNA, 324 bp, Homo sapiens
catcgtgagcagcgacagctaagacttggggatcatctgacactgtccataatagttttgtctaagattttcatagagtgtctataattcttctctattttaacctctacagcattctctgctacaaaatttgctgcagatttttgcacaggactccattccaaccttccagatttaagttctgaactgtattcatcaaatgaactaaggtcctggacactctctccaagtttttccaaaagaattatgaactcttgaaaatcttgacaaaacttttggaagtgtcagatgatccccaagtcttagctgttgctgctcacgatg

SEQ ID NO: 703869 - DNA, 1075 bp, Homo sapiens
gaaggccccaccgaccctcggctgcagaaacccacagactctaccggcctcctccccgggctgccaagcccggacctgctgaggcgccctctcccaccgccagcaccgagtggggatgcctccaccacagacaagcgatcaccatacgacacctcgagtgcatggaggacggtgaactgggctcagggacggaggagggcagtgtttaagctagttgttgatgaagtcgatatcagccttgtacagaacgctgaggtaatcccaaactgactggaggaggccatcgccataagtagcacgaattgtatagataagatgatgacacaagcaagcaaggattgatagaaggcaaagtgacaataagacatcaggccatccaagaggcaataggtgcagaactaccagaaatgatcggcaaatctaggccaggaaagccagaccaatacaacagtgtaagtgcctgtatgcatgcattgtggcaacccatctatctttattactatatatggaataagaaaagggaagatgtagcaatgggaatgattggaagtaaaagaagaagtacaagaccaggaacgagtatgaaacatacaagcgagatagagaagaaatagacaggagagagacgcgataagagattgcgaaaagaggaagaggagaggccgaagagaagcaagagtatagaataaaagggataaataaccgagaatatagaatgaaaaaataaatgaggtaaaaattgagaaaaagagacgtaaaatagagaaacgtagatgaaagaagagcagaacatggagtaacgtcagcaaaagagaagcaagaagaagaagaaggaaagagagaggaacataacgagaataagaacggaaggaggaatataaaagatgcagaaaagagaaaggaaaaaaaacgcacatataagaagaaaagaaaaacatgtcataggagaagaaggagatagatgagagacagaaagaaaaagaaggaaagcgacacggagaaagaaaggagaaaagagaggaaagaaaggaacaagagagagagaagaagacagggagaggactagaagaaaggg

SEQ ID NO: 703870 - DNA, 797 bp, Homo sapiens
ccaaactcgggttaatcagagggggcttcgcgcgcgccccacagcgcctgcgcatcgcactccggcggtgctgcttggggccctcctccttcaccgccccttcaccacctctacacgttctaggccttctgtcctggagaagaagctatagtcgttctccctttgtgggcccggggcgcagccaattggtggacggcggcgaagggaggggaactggcagcggagaggaggcggaggaaactagccaggcctctgcacggggacagaagatgggacgcatactggggaccagcagagagcaggagagcccaatacaacccggggcctcgatggacttcccggggtgaacccggaaagataaatcgggtctccatcggtgggaagcaggctgcaaatgagccggggagccatttataggaacagctctccaggcgggaaacatggctgggccagatgtggacacacaaggcacagaattacccagagaaagcctttagagtgcagaacatgtgggagataaagttatatggtatgtccagagaacaggagttcagtttgagcacacaaagggaccaagggacaatatgtagagaatacccatacacggacttgacacaccaccacaacacccaagatttggcacaagaactggggtcatgtgacagcagatgagagtggtgggaaaccacgaccccaaggggactgtatgaggcagacgttggcgaggaaaaacgaccgggacataaataagcacacaggattggatggaatacccaacaagattaaaccccaaaatt

SEQ ID NO: 703871 - DNA, 233 bp, Homo sapiens
  misc_feature (192)..(192): n is a, c, g, or t
tgtctagaggatcccaattctgcaccacagctcccaagtaactggggctacaggcgccgccacacgcccggtaatttttgtatttttagtagagacggggtttcaccgtggtctcaaccttctgatctcatgatccgcccgcctcggcctcccaaagtgctgggattacaggcttgagccaccatgcccggnctcctttgttctcttaactgcagaattgctgtgggtggatt

SEQ ID NO: 703872 - DNA, 575 bp, Homo sapiens
tgactggtgaaaaaaatctaactctacatgatgataacattgtacagttttatatacaagctctgcaggaactagaagaaattattaactttttagaactatatataattctaattcacttgtctattttgtggggaggcagactttggtatggagcacagaaataccaaaactactttaaatggcaagtaacaccaactttattcttgtaatcccccatactggtcgatcacagcaaacttacataagtgggctattgaccgaaagagttcacaagcttaagatacagaagctatttgttcaacggatagaatgcatctaagagtttaggctcaagatcaatctttacagcttgatatttacagtttttaatcgactggactgcagatgttttttcttttaacaaactggaattttcaaacagattatctgtatttaaatgtatagaccttgatatttttccaatactatattttaaaaaattgtatgatttacatatgcacctcagttctgaaatacattacctctctgtctcattctgccttttatactgtctaaatgcatcagattgattt

SEQ ID NO: 703873 - DNA, 456 bp, Homo sapiens
gggggtttggttttatttatcaaaaatttaaaagaaaccataaaaataaaaaaaactaaatgaaaagactaaacaaaaagaagatacaaaaaaacaaaagacatacaacaaagactatctgcactacataacaaaagaacaaccgttaaaagaaagcagccacaagaacatgtcatgacaacctgaccccctgcttcagggactttccccatcggtgacatcgtcacagtggcctattgccagcctctgagcatgacagtgcgctccaacgtgctcaaggtcaccaaggttgccgccaccaagaagcagttccagaagttctgaggctggacatagccccggtccccacaatgtaccgttattggctcattccatttcacccctttcccccaatctcaacacgtcgtccgccttggtccaaccaattttggacccgaccaagcttgctgcggcccc

SEQ ID NO: 703874 - DNA, 224 bp, Homo sapiens
agttggagaccaggtggctaatatggtgaaacctgtctctaccaaaaatataaaattgttatattttatataatacagctgggcgtggtagtgcatacctgtaatctcagctatttgggaggtggaaacaggagaatcacctgagcccgggagttggaggttgcagtgagcctagaattgcgccactgcactttagcctgggcaacagagcaagactccatctc

SEQ ID NO: 703875 - DNA, 404 bp, Homo sapiens
tacttgccacaggttaagtctagagtctaattgtttaaaggtgtcagctaaagaagaaaagtttgtatatatgttagaaaaatactagagaaatagtgcttagaataaagttgtctttctgggacaggcgcggtgggtcacacctgtaatcccagcactttgggaggccgaggcaggtggatcacctgaggtcagaggttcgagaccagcctgatcaacatggtaaaatcccgtctctactaaaaatataaaaattaggctagacatggtggcaggcacctgtaatcccagctactcaggaggctggggcaggagaatcacttgaacccagggggcggaggttgcagtgagctgagatcatgccattgcattccagcctggggaacagagcgagactctgcctc

SEQ ID NO: 703876 - DNA, 515 bp, Homo sapiens
tgagtgttcatcgcagtgtacgtagcggataattgtataccatgtgcttagaagagcataaaattcagttccagtaattatggctgctgttggtaccagacaaaatgaagagttaccttgtacatgcccactatgtacctcagcacagcagggagctgtgttagtacacactgaagggatccaactggcaaaagaactaggagcgacctatcttgaactccacagcctagatgacttctacataggaaagtatatgggaggagtgtgggagtatttgatgattcaagccttaaatcagcaagacaagtgaaaaaatgaagacacgaaaaatgagcaactcctttcagggaattagaccacctcaagttgaacacacagaagaaaatgcctgtcttcaaaggctgaagcgtcacattataactctgacttaaataagcttgctgtactgctgccagtgtgtggacgtggtatataacaacccaatttaagaaagtgtagaggccagagatcgtctc

SEQ ID NO: 703877 - DNA, 688 bp, Homo sapiens
  misc_feature (520)..(520): n is a, c, g, or t
  misc_feature (531)..(531): n is a, c, g, or t
  misc_feature (562)..(562): n is a, c, g, or t
  misc_feature (570)..(570): n is a, c, g, or t
  misc_feature (611)..(611): n is a, c, g, or t
  misc_feature (688)..(688): n is a, c, g, or t
tttacacgaggtctgtgagagacccaacccttgttcttgtttaagatttttaagcacaagtgaaaatcaagtggtgtcagggagttgggcatttccatgtcgtctccatcatgaactccacatctgaaatttgtagagagatcatatgtaggccaggtaaggacaacagtgtaaggaatgggtcgtaggaaaaaagtggaggtcaggaatgtgtagaattgttgggccgcttccaggtgagttctgtaatctactctcatacttcagggctattaagtttccagaaggtgtgaatctgggtgatgctcggtgcattgtactgggcaatggagaaacacgtggcttgcaatctggaactctctgcctagtcctggctgggcttcactaggactcactcactaactagttgtttggccttggtaggagtcactttacctctttgggcctatgtttctctacatttaggatgcttgataggtgatttcagaagccccctggtttagcctcatgagagtagggntcctggcctcnttacaactggatttcctgtggttgggacagnggctcatnattattattattattatattaataggcagatttttcatagngcttacgatgaaggaacttagtgcgaaagtgtttataaatgtgctaaggatttcccttgggaggggcccggtttccn

SEQ ID NO: 703878 - DNA, 1100 bp, Homo sapiens
  misc_feature (214)..(214): n is a, c, g, or t
  misc_feature (827)..(827): n is a, c, g, or t
  misc_feature (831)..(831): n is a, c, g, or t
  misc_feature (833)..(834): n is a, c, g, or t
  misc_feature (837)..(837): n is a, c, g, or t
  misc_feature (844)..(844): n is a, c, g, or t
  misc_feature (857)..(858): n is a, c, g, or t
gtaaaattacacatgcaaacctccatagaccggtgtaaaatcccttaaacatttacttaaaatttaaggagagggtatcaagcacattaaaatagcttaagacaccttgcctagccacacccccacggacgtcagcagtgataaatattaagcaataaacgaaagtttgactaagttatacctcttagggttggtaaatttcgtgccagccacngcggtcatacgattaacccaaactaattatcttcggcgtaaaacgtgtcaactataaataaataaatagaattaaaatccaacttatatgtgaaaattcattgttaggacctaaactcaataacgaaagtaattctagtcatttataatacacgacagctaagacccaaactgggattagataccccactatgcttagccataaacctaaataattaaatttaacaaaactatttgccagagaactactagccatagcttaaaactcaaaggacttggcggtactttatatccatctagaggagcctgttctataatcgataaaccccgctctacctcaccatctcttgctaattcagcctatataccgccatcttcagcaaaccctaaaaaggtattaaagtaagcaaaagaatcaaacataaaaacgttaggtcaaggtgtagccaatgaaatgggaagaaatgggctacattttcttataaaagaacattactataccctttatgaaactaaaggactaaggaggatttagtagtaaattaagaatagagagcttaattgaattgagcaatgaagtacgcacacaccgcccgtcaccctcctcaaattanattnannttnacataantaatttctaacanntttatgagaggagataagtcgtaacaaggtaagcatactggaaagtgtgcttggaataatcacagtgtagcttaatcacaaagcatctggcctacacccagaagaattcataaaaatgaacactttgaactaaccctagccctacaaccaaccaacataactaaacccccacataaactaaaacatttaactcaaaaagtattggagaaagaaatttacttaccaggagctatagagaaagt

SEQ ID NO: 703879 - DNA, 693 bp, Homo sapiens
  misc_feature (251)..(251): n is a, c, g, or t
aaaatggatggggcccccaaaaggcttcacacagaggttctctggaaccagtggtgtggggcggatgagatgatagcgttcatcggggtgccccaggccaagggctacaaaggggtcacaagtggttggcaccacagagagttgcctcgccaacccccaccagggcggcggaaggggggcctgtaatggggcacggcattccgcttgggagccctttttgtgcacgcgggtgggcaggaaggctcccctcnccgcctggagatcaacaagaagatttataagattgggccggggtcccttatcaagggcggggaggtggtcaagaacaaagcctcccctggttatggcctatttgacaaggggatcaaccctttgggggggtttgtcccctatggggaagggaccaaagactttgtcatggtgaaaggctggggggggggaaccaaaaaggggggggtccccccccgcaagtccttgttggggcaaaaaaaaggggggggtttggagaaaattgcccttaaggttattgaccccccccccaaggttgggcatgggcggttccagaccatggaggagaagaaagcatttttggggcccctgaagaaaggccgaattgcaaagggagaagggggttaatgcccgggacagattttgcggggggggggggttcaaaaaaaggtattttcccctgga

SEQ ID NO: 703880 - DNA, 809 bp, Homo sapiens
  misc_feature (355)..(355): n is a, c, g, or t
agcggagaatagataagagcacggctgtcaaaggagagaaggggacgaatggtgagagagcatgagacaccaaacacgactgactctgacacaggttacaagcaatattggggcaccgttcaaagacacatccgatttcttgttataagagcaaagacgaactccagtggcactactcagctcatcagatgaagctcaggggatgtgaagttaccccagatgtaatcatttcaggccagaaatttaacattaaactcctgattccagtctgcagaaggcatgaatgaaatctggcttcgttgtgacattgaaggaacacgtatgcacactggatggcagcgcatgctagattatngctccaaaggcaagatgcatggcggacagtgcttacaacttagaagttcacgagatattctttcctttctgaagatgcgagcagtttaaagtccagatcctcgagttaaggaccagagcagatcacgactgatataactcctgaatgttcggtgtctccccgttatctaaaaaagtataagaacaaggagtcaggctatataggagatgtgataacagtgagaatcttggagggccatcagaatgtagctcagatgagtctaatatgaaagccaatgatgagatttattcaaggtatggagtcgactagctgaattgggcatcactcacattcattgcatgggttccaagggggcagaaacagaagaattattggaattgatacaaaagactgattcggatggatgcagactggagatgcaagttaaaaccatggcgtttcaggaacatgaaag

SEQ ID NO: 703881 - DNA, 224 bp, Homo sapiens
ctcctggcaagcgtactgcgagatgaagtcatatggaatctggacacgaccgtggacgacaaggctgatgtcaactgcgcatgtgtgacccacgctggcctgaacatcgtcacaggagatgactttgggctggctgaccgctctttgactttcccctgccaccgaacacactttgccacacacactaacgctgatacttctggtcactcgtgctcactgtgacg

SEQ ID NO: 703882 - DNA, 626 bp, Homo sapiens
ccgcgtacagtcgcggcctaaggcagttttcccctatctcagtagatggaaaatacaatcgggttttataccgagacattccattgcccagggacaggcaggagacagatgccttcttcttgtctcaactgcaaaggaggcattccttcctcttatactaatcctcctcagcacagaccctttacgggtgtcgggctgggggatggtcaggtctttcccttcccgcgaggccatatttcagactatcacatggggagaatccttggacaatacctggctttcctaggcagaggtccctgcagccttccgcactgtttgtgttcctgggtacttgagattagggagtggtgatgactcttaacctgcatgctgccttcaagcattggtttaacaaagcacatctggcaccgcccttaatccatttaaccctgagtggacacagcacatgtttcagagagcacggggctgggggtaaggttatagattaacagcatcccaaggcagaagaatttttccttagtacggaacaaaatggagttcctatgtctacttctttctacacagacacagtaacaatttgatctctctttcttttccccgcaactggacggcgggggcaccgagct

SEQ ID NO: 703883 - DNA, 174 bp, Homo sapiens
gtattagcaggcactgtcaacatcacccacaacggtaacccactgtcgcccttactaggcgcacaggtcagacaaaatgtgaagaacagacttcttgttaaacaaccaggatgtcagtatttcaacacgttcagcccacaaacatccaacttttgtaccaatccatgtgccaac

SEQ ID NO: 703884 - DNA, 1466 bp, Homo sapiens
ctagttctagatcgcgagcggcctgcccttttgtcttgattttttagatagcctcttatatgacttaacaataaaaaggatgtagggtattttaatcaaacggtcgtccaaaataatctctgtgttaggcaggggtacgtacaggttgctttccatccatcacatgaaggtcccaagtacgtaggctataccctaaacgtggcaaagggcgaatctgtatttgacgttggatgtacgctcgttgacaacgcaagcctgttggaggtgaagaaggtaatggtggtgcgtatacgacccctacacaatatcacgagtgcgctggatgtaggcgagcatgtttcactccacacagatgtgttacacaaatgagtcatcttaggggcgtagacagttgaccgactgtatggcgctatagtccacaaatgcggcgattctctacttaatagaacacaccctcaagtgcaacgtcgggtctcaatacacccttcctattagacagaatattcgatgtcttccctcctaaagcacagtcttttcagcactaccccatctggggggcggcgtcaacaatccgttcccgggcgacgaccaacagaagccacgtgcccttagcctgcagggggcaaaaccgcgtctctactggccgcaatcctataggacacttacacgagcacaacgactctcatctcaggtcccaacaaagcgcgagggggcatcactcatccgaaggaggccaccaaacagaaaccaaacaacacgcaaataccaaagaagacaaacaacacataccacacacacaaagcaccggaaacccgaacggaacacaacaacaagaatccaagcgaaacaagcacaaaggcacgataaacaagcggaaaaccaccgcaaccatcacacatggaaggcaaccacagcacagaaacaacacgacagagaccacacagcgcaaactggcgcaacccctcacaccccaacccctcggcggacccaccacttatcccagagcgacaaccaccccacagtgaccacagacagcgacacactacaagcaaactacaaccagtatacaaaggcgcacccccacaacttcggcagcacgcgcaacgacactgacacaactaacgcacacctcacacggaacggacccaacagagtacacggacgcacagcgcgtacaccacgcacttcccatacaccaagcagcggcaaacaggcaacccgaaccgtgcaacacctcatcccacagcatacacacgacacgcacgcaggacgccacgcccgacacaacagccctaacgacctcaacccgcgaccgagcacagtcctgcgacacgtcggccctccacacgccgatccgtcaactatcgcacaacaccacgcacacgtccacgacactttcccccaaagaccacccaacccgcgcgcacgacagagctcaagagagaccctactcgaccagcgcccca

SEQ ID NO: 703885 - DNA, 332 bp, Homo sapiens
ggtcggtccctggttggtagcacaataaggaagggtccccaggttggggagagccccaagttgagaacaataatgaacaattattgtatgaacacatgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 703886 - DNA, 181 bp, Homo sapiens
ttaagcatcctaacagaaagaatgcaactaggtcgaatggtgagatctaccattatattgtcagcactaaacccgtgctcttgcgcctatccgaagtttcctccggaattacgaagacaacagccatggttaaaaccgcgtactttgcgacaaccaaacacattaattctgtaggccgcac

SEQ ID NO: 703887 - DNA, 114 bp, Homo sapiens
  misc_feature (40)..(40): n is a, c, g, or t
  misc_feature (94)..(94): n is a, c, g, or t
  misc_feature (97)..(97): n is a, c, g, or t
cggagagcgattcccgtacccttctttccactgggacccnatccgggaccccttgagggatccttaccaagaacttgacattcaccagagaganccngtgggcagggacttcct

SEQ ID NO: 703888 - DNA, 126 bp, Homo sapiens
aggtcttttcccctcaaaaatctcatgtgatgccagagagacctttctgaaacctctccgttttttactgtgtttaaaaccccccagtgccacccatgaaatacacagctgcgtttcacttcctga

SEQ ID NO: 703889 - DNA, 371 bp, Homo sapiens
  misc_feature (359)..(359): n is a, c, g, or t
gaagccctatgatgacgatgccgagtacatgaaacacacacgtctcttccggtgaggccagggccctgaccctcccctcagtcctggcactgctgcttatgacctctggcctcaccttgacccttgattcccagagtgctccagacgagaaggtgctacttgtgcagtgactgagaatatgctccagacttattgccaagaatgacctgggcagtatgatgacatacatgttgctagactaatgcgccaagaggtgctacatgtgggtgggtgacccagaactagcctaggtggagtatcaagtctgaagcctgaagcgcctgccagtgtatatatccagcaacatacggtaccaaggnaacatgagcggc

SEQ ID NO: 703890 - DNA, 265 bp, Homo sapiens
ggctggtgtagtgggcagctgcagctccattagacccctagcctgggaacatccatatgctgtgagggtgtggccctaaaaagacaaaaaaaacaaatcatagtcatgccagttttattgttgacttggtgggggcaggagattgtctggatgacaggtttgggagagagaattttgctgtatgccttcttgcgtgtgtcctggtctgctgcttatcccttgctttctaacggaatttccctcaatttgtacctgattcagcttg

SEQ ID NO: 703891 - DNA, 713 bp, Homo sapiens
cacttctttgtcgagttgtgtgcccggcttgtctttggcgcggtttttgttcttgttctcgtgctgttgtcgttcctactgttgttgtgcgctttttgtggtctgccttgtggtctattttggtctcctcgctctccctccgccgtctgcccgggcggtagccttgctctttgtgttcggaccgcacacaatggtgttcttgctgctggcctcacctcgcggtaatttttgttgagtttagtgtgcggtcgtatttgtcgcgccctcgttgcctcgctcttggtatgcgcgcaccgatctgtttgtattattcccacggggcgcgtggctccacgcaagatgttcttagccccgcaacatcatcggcagcccctcttagcgctctggttgtgcagacgagcttcccctccacccattcagttgcttgtcaccttagaattgcttgatagggcgcgtccacacacaaatgttcctctcaacaaatcaggtggatacatcgccctctcgacagtcaacagagagcagtgcaacaccccctgactaagtgtcttctactatgacgacttttcacacatctctttctccatagagccccccttctacacaacaataatatagcgcgcggcggcccctcgggtgttgtggacacgttgttgcggttgcaccaacaacgcgcgtgcttcgactcacggcccaacaaaaacaacaaagat

SEQ ID NO: 703892 - DNA, 461 bp, Homo sapiens
  misc_feature (30)..(30): n is a, c, g, or t
  misc_feature (39)..(39): n is a, c, g, or t
  misc_feature (185)..(185): n is a, c, g, or t
cctaaccccatatccaaacataaaataaanctaatttanaaaaaggaaacccttgcaatgcctttgtggttcaagtgtaatcttccatgtaatttccatccatttaaatgctccccagcccaacctgtacctactaggccccattttaatagattagaaaactgagatgcaggccgggccatggntgtcacgcctgcaatcccagtactttgggaggccgaggtgggtggatcacgaggtcaggagttcaaaaacagcctggccaacacggtgaaacccctttgctaccaaaaatacagaaactagccaggcatggtggcaggtgcctataatcccagctactcgggacgccaaggtgggagaattgcttgaactgtggaggcggaggttacagcgagttgagatcacgccactgcactccagcctggtacgacagagtcgagactctgtctcaaaaaaaa

SEQ ID NO: 703893 - DNA, 390 bp, Homo sapiens
ttcagttcactgccactccgtacctcccaggctcaagcgattctcctgtctcagctcccaaatagctggggggcacacaccaccgtgctcagcaatttttgtacctttactagagatggggttttcaccatgttgcccaggctggtcttgaacttctgacctcagatgattcacccgcctatggctcccaaagtgctgggattacaggcatgagccactccacccaggcaacatgcatattatttatgatagtcaatcaacacttggtgaagaaataagtgtgcaccagggcctgtttcccaatatatgtatttaattatttaatcttgaagtgtgcctttatgagttagactcatttttatacatatttttggaactggaaatggagcg

SEQ ID NO: 703894 - DNA, 791 bp, Homo sapiens
  misc_feature (246)..(246): n is a, c, g, or t
gcggagccgcacctagtggtcctcttccgtcccccatgccagctacccgttcagaccagcagcctcgtgggggcacccccccgccagcctgctccctcccgctcagccctgccaagggggggggcctttttttcccccccgcgaaaagttcccagtgaattcttcggtattttccccgccgggggaaagttttttccccaagttggcgggcggcaaagggaaaccccctatccaattcgcgccaanatcgcgttcccccgatgccggtacccccaaagattcaaagttttcccttgtgcgcgcccttttaaccccagttgtgagccttttcccgactgaacacacaaagattcccctttggggcgcgcccaaaagaagaggcacgttatccccacaccaccgcggggcgcacattttcccgggcgtgttgggaccggtggccgcgcggggaaaacacatgctttattttccccaccgcgcggggggtgacgcaacaccacgggggccacaaaggagagaccgccaccccaacggggcgcgggcgcattatttcccccccccccttttgtgcgtatttctccgttggcgccatattggagtagagtgcattcgcttatccaaacctctgttgtggcccacccgccgcgggagcaagtatttaaacgtttttccaagtttcggcgcgggaataccacgcactgtttcccgatatttattatcgacaaccgcccgaaacaaaccgctttaaatcaacatttttccgttcccaacaccaattccggttaatccag

SEQ ID NO: 703895 - DNA, 696 bp, Homo sapiens
cttcgtggatttactttgcctttgtgtttgatgccgtcgttgtggtgaaaagtcaactccgagtgccaccattgctgggccggacgaagtgatgctttcttcctagaggctcctgagctgagctgcgaactcgccccccgcccttgggacacgaagaccctagtcacatcactgcatcccgtcctgatgtcctcgaccagttgctatgcaaaggtgatgtcttgttggtacactaaggattgtaacataagtgcacctattctaagacactgttgacagaattgcgggctctgggagcccgtcctcttagttgtattgaagtctcttggagccgttccttctgtgagcagtgaacttggacgggctgtcccttacgcacacaggggggccatcaggcaaaaccttgagcaccacaggaaacgggcacatgggttcctaccaattgacgttacgcaaggagccctctgaggcaactttccaccaacgcgcggtgtctgaaagtccatcccagaaaaggcatcacattgcgaaagagcctcggagacacctaattaatacatggctccaagggcccactggaaagcaggaaaaagcaagcttagccctacccaaataggtgggacatccacgggctacccatggttacaagcatctggaaggcccgcccttggccacccaacaccctggacaggccca

SEQ ID NO: 703896 - DNA, 414 bp, Homo sapiens
caagtttgtattgtgtgattaatctgcttaggcattaattcataatactttcaattgttacacaaaattgttactagaagttcttaagtctaaaacatcttaggaggtttgccttgatattctgaaacactgtcttaatactttattagaagaaatatgctttaaatttctttaccataatctatacgcaaactttataaatatatatctagtagaataccatatttcaaatgcccagaattgtataataaaggtcaaaaactgcttggaaatatctttatgattacactcataatcaacaatgcttatgaactagcacaatcattatgggaccaacatttcaaaatattttgcctatcaaagcttgcaccaggaaaagtattatgcacataaaattgagaaacagataatctt

SEQ ID NO: 703897 - DNA, 1720 bp, Homo sapiens
  misc_feature (73)..(73): n is a, c, g, or t
  misc_feature (654)..(654): n is a, c, g, or t
gctctaagctaagattacacatgctagcatcctccggtaaccagaagagttctaccctcataaatcactcatngcatcaataaggagagcccgcgaatcaggcatcgctagtaatctgcatgcttcaatatactgcgttagctcgtagactaacacccatccacggcgcaaatcacgctcgtgagtctcacctatttggtgcactataggcaatgttataatctaaagctagtacctaagaccccaggggtttgggtccacatattccgttgactaggcccatcagatgcgtccacaacgcattcatagcgccatagtcaatatacagtaagcctggccgtcaaacgcatgtagtccttaagatctaccccccttacactccgaaatcaaagctaaacatcatctaccttagacgatttggtaacaatagaaaccttctccacgatatagcaacaacacaatcataatgacgtaactgcaaaaacggtcggactctatacacaataagtaccttgaaaatcaactacaagactaatgcattacacgcatactcacatacttgtggactataacgcaataaactcgcaacataatagaatcttaaatttcctgaaatagtcttcccacacaaagatccttatatattcacatacngaggaagacctcggcctacagacacaaagacaacacccacattcactgtcagactcacatcaggactttacacatagaccttctacaccaatagagtcaccttgcgacgagattggctattgcgcataaattcgcccattcttgcagccagggtagactccgtgagttccgtagtgtacaattctgaatttaacaagaccacgcggaattaccatactcatacaatccctaactccattcatttgaagctttcatgccccttaaataattacttcgtgcccatttctattcacagtacaaacactcccatgtaatggacaaggcgtaacaaaacggttaatgccggcaaagttatccccactgttagaaaggaaccgttcacgggttcaaaacgggctgatcatgcccccaattgtagcggtgggccccaggaaacgtctggggggccttcacaagttgtctttgataaaagcccccaatgaaaaagacttaggcgacataagtccccttttcatggaataactataagcggcgcttccgaacgggtgggcactttaccgcagtatatacacctcaggcactgttgaagtctggcgcttctcactgtgtaaacccgtgtggaccctcgtcacgaatgcgcgtatacaccaaggaccgtcggtaccccagtccctgtccagcgtagtacctttactaaagggcccgttaagccgtagaaaccctatacgggttttacttttcacgggacacaccacgtctttacatagggtaatcgttctgtgacacaggacccggtggtgtacccacaaagcaacgatatgtggccactttgttgggtgcgaacatgccacactagtcaaagctatgcggcactgttacacccacttacaaggagaacgtggcacaattagacacttttgccattactaactagaacgacagttcagcactccatacagcagcccttaactcgctcaacgagagccgcctaccttacaatctcatctacactcatttttgtgctatactgctcatgacactactagcagcaacgatcagcgaaaca

SEQ ID NO: 703898 - DNA, 470 bp, Homo sapiens
  misc_feature (45)..(45): n is a, c, g, or t
  misc_feature (121)..(121): n is a, c, g, or t
gcccggaggccccttaaggccggggggcgggaggggttgttgggntggtcctccctgtgcgggtctggggccactaccctgggtgcgggccctggcctccctcctgtgggcctttcttggnaaattaggcggggggggggaggcccccctccgggccggggcccgggggttatttggggccggggccggcccgggtttttttgtgggggggccgtttggccctttggccctttggggtttccgcccttttgcccgggcaggcccggccccctggggattttgggtaaatttatcacgcgtttcccaggggggggggtgggggggggggggggcggggcccccctcggggtggccccggggggttttttttttggtcctgggccccccccccccccccccccccttggcccccggccttttaccccggtggggtttttttatttttttgggggggtttttttttcccccca

SEQ ID NO: 703899 - DNA, 243 bp, Homo sapiens
ctgaggatccagatgcagcaagtagtgtctctgacaccagtgtctgcaatttggttacgatgcaattagatcactccccctccacacctgcatcctgggcccgccaggaactgctgtctccaacgcttcattcacagcgaatcctgcacactggcacctcatgagctccccctctgacctgctccgggacccaattccctgcttacttttctcccaaacacagactctgcccaagaactgagg

SEQ ID NO: 703900 - DNA, 838 bp, Homo sapiens
gcaggctgtactggtccggaatttatggatgtaatggcggcggagggaggtggagcgtagtgcacgctcagccctgatccccgaaagtttaggttcgaatgccccaccaactttcctgtggaagcgctgccgatccggaggtcgtggacggaaggggaagccgaggcgggaagtctggtgggaatcgtgcaatgggagccgggggagactcgaacccgctggcgggggcggagtccgcagtgcctcgcgcctccgcggtccccgcctctttctctgcaccctccccgcggccggagcctggagccgtgagccggagccgtagtctggcaggccctgcaggcctgcaggccgcggcgccgggcctcgcatggcagcggcgctggctgagctgcatgccgggccccctcctcgcgacctccggggccctgtttgctcggggccggcacctggccgcgtgtgaggcccgggggccggcgtttcggggaaagctaggcagggagggcccggggccaaccggcggcaggcccccttgacggggcccccaggttcccttggggtgccgggcccccgagtaaggtggcatgcgggtggcggggggcgtgccgttgaaccccggaggccgaacggattggaaaggggctttaacggcttgaagccggaatgcggagccaaggaaaattacttatgcaagaatctctttcctccatacttgcggaacatttgaagagccacccaaggaaaggttggttgtcacacaccgggggcgggggttgcctggacacttgatacccgggcctgcgcaagtttgcggaacaagaagttgggccccttacaagat

SEQ ID NO: 703901 - DNA, 138 bp, Homo sapiens
actcctgcaagcagtatggcatcacgggcgaaaatgtccgaggagaactgctggccctggtgaaggaccctccgagtcagctggctgagattggggcagcggctcaacagtcccttggggggaagccattttacgtgt

SEQ ID NO: 703902 - DNA, 110 bp, Homo sapiens
atgcagtggactcggaccaccattgtgctgcccctcgcaacttctgggagctcctcattaacgtgaagaggggggccttactggcggagacgtacattatcccggaggag

SEQ ID NO: 703903 - DNA, 219 bp, Homo sapiens
tgacacaggagccacaagcacagctcccacctgtctctctgcactgtgacaaactggaattctgaaacaccgctggcctcgcacagctcccacctgtctctctgcactgtgacaaactggaattctgaaacaccgctggcctcgcacagctcccacctgtctctctgcactgtgacaaactggaattctggaacaccgctggcctcacacacaatctta

SEQ ID NO: 703904 - DNA, 145 bp, Homo sapiens
  misc_feature (80)..(80): n is a, c, g, or t
aatcttggcagagtggctttgggagtcagatcaacccagttggctctgtcccttattcactcagggtcctcaggtaagtnttagtcccgtgtcctcgtttgcaaagtggagctaatgatcatgcttaatgccgaagtgggtgtgg

SEQ ID NO: 703905 - DNA, 287 bp, Homo sapiens
gtagcatgatctcggctcactgcaacctctgcctcctgggtccaagcgattctcccgcctcagcctcccaagtagctgggattacaggcatgtgccaccactcccagctaatttttgcatctttagtagagacggggtttcgccatgttggccaggccggcctcaaactcccgacctcaagtgatccgcccacctcggcctcccaaagtgctgggattacaggcatgagccactgcacctggcctcaatccttatttgaaaaaatacttttgcatcaccatagaagt

SEQ ID NO: 703906 - DNA, 106 bp, Homo sapiens
aacccccggacgggggggggtttaattttttttgggggaacccccaaaaggggttttttgggggggggggcccccttttcgccttccaaccccggttggggttcca

SEQ ID NO: 703907 - DNA, 339 bp, Homo sapiens
gctcatagagactgtgtgctctagcgccttgcggcggagggaggcgatgctggtgccccgccacacgtcgctgctgtccggggagctgcagagctggggcgaaccggagacgttgctggggccggggagggaggcgggcaccatgccggggaaggcgggctggtagaggtgcgactgcagccccgcgccgttggaacccgccaggctgttggacaggcccatggagttgggcggcggaccggccgccaggctgcactgggacagcgactgcgccatggcctgctgcctgcccagcgccggcggcagaggcagctgtgacacgccaggcatggcggccgc

SEQ ID NO: 703908 - DNA, 784 bp, Homo sapiens
cagcaatttcaaaactacttctggtgttaaacacttttcccattaaataagtcctgtggctaatgaaagcaattgaaaaccaaagaaaaagctttctgtggcctcaataagttatcctgaaactgaaaagtgtctgctgtccgcactgaggagacatccgggactctaaatggaagcttattgcagacaatgatgaagacaacccacagtcagtagctttggagttttatcctcgatttactgtttaatgataaccgtatgtatcaagtagagaagctatgtagccattttgctcattatgcagtttaatatgttctctcatttgatagccttttccctcctctctcacttgctcccccttcctccctctctgaaacaccatggctcacagtacttaagtaatagtgaatatgtttaagagcacataagttcctacctaggaagaggtacaggcaaaagcatagacaagataaagagaaatgctgagaaatatgtcacaggaggggaggaatctgggtaatgcttgccagacattccaggacacggagtcatcacgatgtgagggaacaagagttctggttttgtttttaattctgtaagttagtcttttgggggctagaatggaatggggagggggtttattaagtcctgtgccagcacttcgctcataaagttttaaattctggaccaatagtgtttgtttcctgattattgtatccaatactttgcctagtatgtaactcactcttactgataataaaataaatattagtctgtaacagaa

SEQ ID NO: 703909 - DNA, 192 bp, Homo sapiens
  misc_feature (18)..(18): n is a, c, g, or t
  misc_feature (23)..(23): n is a, c, g, or t
  misc_feature (26)..(26): n is a, c, g, or t
  misc_feature (31)..(31): n is a, c, g, or t
caggttaaaccttcccantaagnagncaaancagtatcatgtaaaaggaagaagagatataaagccctaaaatgtgcactcattgtattcaatagtttgttttaaaacaattatgaaatgacttgttttaactgaagttgagttgcttttgcataatcctagttgtgaataaaaagttttcaaaagcagaag

SEQ ID NO: 703910 - DNA, 244 bp, Homo sapiens
atgtgtcgtgtagatactattccccagagcagcctcactgggtaggctcccagagctttcaagatgcgttgcggtttgcctttgtgctcacgggtcacacctgtggtctgctcattactcgctcttcctcttcctgtacttgcacccctctccccatgggagcttgggggagactgaactgttacaaagtccctgtcaggtgcctagtaaacagtatgcaaagcttcctgaataaggccacggt

SEQ ID NO: 703911 - DNA, 163 bp, Homo sapiens
cataggtaaatatattgtaaccatcaaaatatttacagagaatgtaaagagatagtgaaaactgcttatgatagccatgttacatagaaacaaacaaaacttagaatacatgctacagtaataaaagaagaaaaaggtcagccaggcacagtggctcatgcct

SEQ ID NO: 703912 - DNA, 966 bp, Homo sapiens
  misc_feature (142)..(142): n is a, c, g, or t
cagcttcagatgtgtgaagtgcaaccacgttgatcacctctgcatcacaaggtgcgtaacagccaggccaattcgaactctctgggatcctgcacggtgactcaaagacggcagcagggatgagggagctgatctgtggagntccacgtgggcacagcaagacctgaagagcttgtattagacctaaggggacacgagaggtttcaagccgcaaccaggatcgttggagctcgttcgtaggttggcagtagaagcaatgcgattacccatgtattgcgtgcgaaggggaaatatcggggagccccagacgcagatagtccacgaagcggatggttggagaagagcgggcctgcacacgcaatcgtggatgtgggccacctccaccaagtgctgtgcatgggcaacgactgtgcctggactgtgtctgcaaagaggctgcctctcatattgctctgcgaatcaacttcttatccatcgtatatcgtgctcacaccacatgaaacgctgtagaccgacgttccttgtcctgcatagaaagggatgaaccggatgacttaattcctggaattgactggacctgtttgccgtcgtcgtaaatgggacccctacataagagggtgacgagatagcgtgaggttgcgggtctccacgagagcgacctctttccaacgtagaggtaacctgctggtcctagttcagcagcgcaccaaacaagtattcgggtcggacccttaatcaagatggggcggagagacatgtagtgctcgccattggtatatgggcccccagcccgagaaggtcaagcacaacagagcttatctggagaaaaaagcccatgagaaagggcattcttctccagtggacacgccccccagggggaacgtttgttccgaacagagcgaggaaaggcccagccaattggcaagaagccttgtgaaatctacgagggggcttcctggaagccaa

SEQ ID NO: 703913 - DNA, 189 bp, Homo sapiens
ttcgtagagtgtggtgttccatttgcggatggtccggctcttgagggcgtcgggtgtgaggttgcagtgagctgagatcgcatcactgcagtttagcctgggtgacagtgcgagactccgtctccaaaaaaaaaaaggaaaggaattgtggcttttaggaccacatactgaggtggtaaaacaaaaaag

SEQ ID NO: 703914 - DNA, 745 bp, Homo sapiens
  misc_feature (32)..(32): n is a, c, g, or t
  misc_feature (87)..(87): n is a, c, g, or t
  misc_feature (106)..(106): n is a, c, g, or t
  misc_feature (130)..(130): n is a, c, g, or t
  misc_feature (151)..(151): n is a, c, g, or t
  misc_feature (172)..(172): n is a, c, g, or t
  misc_feature (346)..(346): n is a, c, g, or t
  misc_feature (388)..(388): n is a, c, g, or t
  misc_feature (395)..(395): n is a, c, g, or t
  misc_feature (408)..(408): n is a, c, g, or t
  misc_feature (451)..(451): n is a, c, g, or t
  misc_feature (512)..(512): n is a, c, g, or t
  misc_feature (517)..(517): n is a, c, g, or t
  misc_feature (537)..(537): n is a, c, g, or t
  misc_feature (577)..(577): n is a, c, g, or t
  misc_feature (596)..(596): n is a, c, g, or t
  misc_feature (600)..(600): n is a, c, g, or t
  misc_feature (616)..(616): n is a, c, g, or t
  misc_feature (630)..(630): n is a, c, g, or t
  misc_feature (657)..(657): n is a, c, g, or t
  misc_feature (709)..(709): n is a, c, g, or t
cctgaccaagagggcaccagcagaagcggcanggccaccattaattgctttctcttccggtggaaggctgctttgctctcatgaganttgacctgcagcgggatanaagcgtctagatgatacagccgcngggggccccccatcaccaggnggttctccccgatctccagcnacaccccagggctccatccagtttggggaggtcaatttcggccaagaggaggtcgggggcttccagccacaggttcaggtgaggcttttcagggcctgacttagctctcccgggggcgggcgtgtccaggtcccccagcccctggatccgaggacgctgccccgagcggatttncttctgccagacggagcccatgaatggccggtcctccatcangcgccanttcggattcagcngcaagttgtatttgttctcaaggccctccctggcgatggtgancacgagcccccgcaagatatcgctgttctccatcccccggtagaagttgctgttgaaagcnacgtngtaggcggtacatccctggncttttgcatccagttctgcatgaggctctcccagaatcanggggatgcgaaaaccagcntggncctcctctagcatctnaagcagcccctccncggtcacgtaggcgggaggagggatanaaggggagttgcagaagtagatgaaaaccttcccttccgaggagttggtctntatgcagaaaccagggtgaggctggatttgtgtgga

SEQ ID NO: 703915 - DNA, 1131 bp, Homo sapiens
gaattccttggcatagttaaaggtgatgatgatagtgcaagaggtatcgttgcacaaaatatgacaactgctgagattgaaacatttggttcagatgcagttattatggcaacgggtggccctggtattattttcggtaaaacaacaaactcaatgattaatacaggatcagcggcttccattgtttaccaacaaggcgctatttatgctaatggtgagttcattcaaattcatcctactgcaatccctggtgatgataaactacgactaatgagtgaatcagcacgtggtgaaggtggacgaatttggacatataaagatggtaagccttggtacttcttagaagagaaatatcctgattatggtaacttagtgcctcgtgatatgccaacgcgtgaaattttcgatgtatgtattaaccaaaaattaggtattaatggcgaaaacatggtatatcttgatttgtcacataaagatccacatgagttagatgtaaaactaggtggtatcattgaaatttatgaaaaattcactggtgatgacccacgcaaagtaccaatgaagattttcccagctgtccactattcaatgggtggtctatatgtagattatgatcaaatgacaaatattaaagggttatttgcagctggagaatgtgacttctctcaacatggtggtaaccgcttaggtgccaattcattgttatcagcgatttatggtggtacagtagcaggtccaaacgcgattgattatatttcaaatattgatcgatcatatactgatatggacgaaagtatttttgaaaaacgtaaagctgaagagcaagaacgttttgataaattattagctatgcgcggtacagaaaatgcatataaattacaccgtgaacttggtgaaattatgacagcaaatgtaactgttgttcgtgaaaatgaaaaactgttagaaacagataaaaagattgttgaattgatgaaacgttatgaagatattgacatggaagatactcaaacttggagtaaccaagcggtattctttactcgtcaattatggaacatgttagtacttgcacgtgtgattacgattggggcatataatcgtaatgaatcacgtgccgcccattataaacca

SEQ ID NO: 703916 - DNA, 268 bp, Homo sapiens
cccggcaatcgcacggaggcggacaccccgctcatggtggccgacaccaggtggttgaggaccccgtctgcgggatggggcagcttgagggtgctgctacagatgtcgaagattgcctcgtgtgcgatgcaagacttatcatccgtatcctacaccagctggagcacagacggtgctactgtggatcgctccaccaccgtgcatgacactgtgcgcgagatctccacactgaaggcgtacatgatgcaggctggcagctcctcgcgga

SEQ ID NO: 703917 - DNA, 303 bp, Homo sapiens
tgttggacgctgctgatcaagcagtactgccgcgagagcggtctgcgcaacactgctagaagcaactgagagaaggcgctacgggacatcgacctacaagattggcagcgccgaggccgagtccgtggaggagacgcccgagaacctgcaggacttcgcggagaagcccgcgttcaccgcggagcgcatgtatgacgtcacaccgcccggcgtggtcatgcagctggcctgcaccgcaatcgcatgctccacgctgtttgtggagacatccctgagacggccacaggacaaggatgccaaggg

SEQ ID NO: 703918 - DNA, 350 bp, Homo sapiens
cctcatggattgtaactaaaaaaaaaacggttcctttttgtttttttaaaaaagatttttaaaacccgttttttaccccgttctctcgggactttttttaaggtaagtcagcattgttttccagggttaaaggcatccctcccctttgcattgaacttagggatccatgccaaggaatggaatttccatcctgagccagttcaggtaggggtcaattgaaactattttaattttttatgcaatttgatgagatggggtcagatttaaaaatttcaaaagcccgttttttgtaacaaaaattgttatgtattaaaactgcagttttcaataaagattgacttgggttgcca

SEQ ID NO: 703919 - DNA, 172 bp, Homo sapiens
  misc_feature (67)..(67): n is a, c, g, or t
  misc_feature (168)..(168): n is a, c, g, or t
cgagctcggtacccccacggagaaggggttatcggagctgctagcggccggctacgccagagccacngcaactcgggatcgagccgcatctgtgacccacaccacagctcacagcaacgccggatccttaacccactgagcaaggccagggatccttctccggtggcntggt

SEQ ID NO: 703920 - DNA, 262 bp, Homo sapiens
tgacacctccatgacccgagagacaccccgtcgacgacatatcacctccagaaccagagcacccctcacacagggatcacacacacggacacctccagacccagagcacccctcacacagacacctccagacccagagcatgcctcacacagagatcccatcacacggaaacctccaagaccagagacacccctcacacagacacctccagaggcagagcactccctcaacagagatccctcacacggaaaaactacaagaa

SEQ ID NO: 703921 - DNA, 955 bp, Homo sapiens
  misc_feature (955)..(955): n is a, c, g, or t
agcggggccggccccggggcctccatgatggaggagcgagcggccgccgggtctgccgccgcctgctcctcctgccgtccgctcggtcaggcgcgggccctggccccacgtaggggcggccccggatcgtccgcccctgtccccgggccgggccggcagggtaagggaggcggcggctggaggcagccccgggcccacggcgaggcccggagcccccatgagcctgccggggatccttgcacttaatccagcacgagtgggccgcggctatcaaatgcctgagaaaaggccctgctgggagggcctgagctggccgcggattttacacggctcacgtgtggcctttcccttcgcgggcacagacggacaacggggcagggacgcactcgtatagggacggtgctgtgtgctggcgtgatcaccgattgctgcgattattgcgctgactggcagtgaaacggggcccaacgtactcataaacttgaacgtttgcggacatggaccttgaagccagggggggacgaccgacgcggcacgagtgtcgtcagacacccaggtctccagatggcccccgtgagaatccggtccaccccttgtaagacaccagccccgctttgcgtggttgcaacctgagcgaagcgtgctgcagcatctctttgccgggaacacgtataccttgggcacaacaacgtggtggccgccgtactccacgcacccctccaatccctccggaacatttgccgtgtccaatatgcgccgttcctggttcccatggcttggggcccggcttctgcgttggaatcccttccaccgtgggaatatgggaaccttgagctgtgaacgtggggccccgcaaggggactcccagctatgtgcccttgccgggcgttagagatgtgtgctgtatggtcacgttcggttgttcgacaccacgattacggtgactgctgataan

SEQ ID NO: 703922 - DNA, 314 bp, Homo sapiens
  misc_feature (17)..(17): n is a, c, g, or t
ccgtgcagtatccaggntatggtgcgaagctaggttgcgcttgtccaccttcggcagagcagcgacctatgctgagcgaggttcagaacctggacatcaccaagaagaaattggccacgagtgccactgacgtggcgggtgactaaggacaagcagtggagtgcatgtgctgtgctggacgactgctgctgtgctccaggccagacgagcggtgtgtcaagtccatagccgaatgacgcccccccgatgagacatgcggccggcggtcactcgcagacggagtgcacgccgctcccccgccccccgccccgctg

SEQ ID NO: 703923 - DNA, 409 bp, Homo sapiens
ctcaaatgcgcacagaaattttagcttccagctgttttccctattagctgtcagatgagagtcttccattgggagatgcccctgcaggggctggaggatagagtcatgaggttaagcttttactctcctgcactggttacagcagacactgggcagatggcatatctcctgactgcaggaagctaataccagctgtggcaggtgttaccactcctgagtttctggcaagtttacaggagcttctctgtcctctgctgccttcattttcctgtccggatctctgagcgaaatccatcacccctttagggatgccatgcccagatctatagtcgtccccctcctcgagtctcaccaaaagcacccactgcctctcagggactatgctttgcttctagaatttctgtgcccg

SEQ ID NO: 703924 - DNA, 585 bp, Homo sapiens
  misc_feature (3)..(3): n is a, c, g, or t
  misc_feature (193)..(193): n is a, c, g, or t
  misc_feature (531)..(531): n is a, c, g, or t
  misc_feature (574)..(574): n is a, c, g, or t
cantgtgctccaggaacaaggagcagctagagcttgccgggcttttttagatgtagaggaaatgaaaagaacaagaaaaaggaagagcttgcaacggcctattccccactgtgtcacagaagaatttccaaacaccctacttgggaatgcacttgatccaaggagtgtgagctggaggaggtaagatgcctcntgtcggtgacttgtctggagcctaacagatgccgggtgctcttcacttttggcttctgcatgtatcttttcatatttccccaaacccccagggccgtggctaatgcctatacattttttgttaactctagttttccatgactgcttgcttcccatctcatgtccttgacagcatgtatgctaagatggcagccattgcctttgccttttcacttgctttggggagtcttctctcagacccatggaagtgaaacctgcctgaaggcgggaaccattcagttctgctcaccattgcatcacctgggtgtggcctaacatctggacacagtaggtggctcnaaaatatctgtgaatgaatgaaaaattggatgggatcccaaangagaatagctt

SEQ ID NO: 703925 - DNA, 198 bp, Homo sapiens
agcacctacagcagaagagatatgaggaattgttaggagtcagcacttacattaggaaattggctacaacccgacacagtagcatttgttgccaatttctggtgggatggtgacacatgctggggccaggtgcttaacatgccttggttcagggattggaaggttcacccgtgggtgggcaatccgtgggacccagtt

SEQ ID NO: 703926 - DNA, 230 bp, Homo sapiens
tcgtgccgaattcggcacgaggcgtccgaagggatgatagcggatcctagtaggtgctatgtgtcaagcctgacgttcacggctaccgtatacctgcgggggctaccaaccttggatacaagggagctctttgctaaggattcagatcagcccttcgcagagtgtgcaggtgtaaaattatcacaggtcaccgaggatgctttccgcgcccatactggttgtaatcactt

SEQ ID NO: 703927 - DNA, 661 bp, Homo sapiens
  misc_feature (176)..(177): n is a, c, g, or t
  misc_feature (195)..(195): n is a, c, g, or t
gcccggctgggagaagcgcatgagccgcagctcaggccgagtgtactacttcaaccacatcacttaacgccagccagtgggagcggcccagcggcaacagcagacagtgtgtgtgccaaaaactggtgcagtggtggagcctgccatgggtcctgcgttgctctgctaccttgctnnttttttttttgggggggncgggggccccttttgcaaacaaaaggtgtgcccccctaaatacccttaaaaaagggatggacccctccaccaaaaaagtgggtgtcaagttttttaccccagcaaaaaactcacccccccttgtggtggtttcttgtgtggggttgtcaatatcctccccctgtgggtggtgtctcgtttggggtgggggttaatcatcccttctccccctcccacgcccccccgtggtttttttttccccccctgtcgtgtgggccgattttttcatccccccctttttgtttttgtgtgtgtgtgtgtctgttgtgtgacccccccccccgtggtgggtgtgtcgtgtgggttacctcccaacaaaatgcggggtggccaaaacaatgcgcaacccattgccacaacaaattttttctccccctcacataaaaacctcctcccctgcggggcggtgggcgcacaaaacacccgc

SEQ ID NO: 703928 - DNA, 225 bp, Homo sapiens
  misc_feature (8)..(8): n is a, c, g, or t
  misc_feature (39)..(40): n is a, c, g, or t
  misc_feature (58)..(58): n is a, c, g, or t
  misc_feature (95)..(95): n is a, c, g, or t
  misc_feature (203)..(203): n is a, c, g, or t
  misc_feature (211)..(211): n is a, c, g, or t
aaccacanctgcttgggttaaagtccccatcctggcctnntctcagccaccagacatngccaggaaccgcctagttcccaagaacaatttaaagntcactctttggatttgaaagaccaccattatcattttactaaattcttatatatacttgtgccttttcccaactttcagttctctttaagaaaaacatccactgtagntttataanaataccttagtatt

SEQ ID NO: 703929 - DNA, 145 bp, Homo sapiens
agtctccatgaaattatgtgcatgtctatgtgtgtggcatttcatgttgaacacacagatggtagtgctcctagaaaatatttcttcttctagtcttatgtgctttggaactacacatgtattaccaatgactgactctgaaata

SEQ ID NO: 703930 - DNA, 173 bp, Homo sapiens
  misc_feature (111)..(111): n is a, c, g, or t
  misc_feature (130)..(130): n is a, c, g, or t
gacgagcgtaaaggtcaacttaagaaacagagagaatataccttcctcttaggacctccctgggttagcagaaggaaagaacccagaagtcttcagtaccacagctaggcnttcggctatctccgctagnccaagttggaccctgctgggcggtacccgagcctcgaaattcg

SEQ ID NO: 703931 - DNA, 400 bp, Homo sapiens
tttctaccacccactcaaaatgtcaggttcctcctggtctccataatgatccataaatatctaccctgaactcatgatgatgattggattcaacattataattgcatatgcctgacttttccactctgtcaacagcctcttttctggagtatctcccagtgatcatgtcatatcctgttaggtaaattgtgaaccctgtaaggatggtatcccctagttttatgagtgaagatcacatttaattctctgtcattttcagaacataacacatcgttagtgctttaaaaggatgaaacatgcagggcatttgtaaactttaaaagtactttttttatctggttattttatggcaatccctacaattaatcctttgaagggctgggcaaatcccgggtttgac

SEQ ID NO: 703932 - DNA, 572 bp, Homo sapiens
cacagtgccaagcgaccaagcaaagtatcgccgcgcgccgaataaattggcggagtcaatctgttgatcaacgctgctggggtgaatcacttcgccatgctcgaacagctcgacgacagtgatatcaatgcgatgcgtcgcgttgaatatcaacgcgccgatttgcctgaccaagctattgctgccgctactcaagcaggccgatagcgccatggtagtcaacgtcggctcgacctatggttcgatcggctatgccggttacgccagctattgcgcgacgaagtttgccctgcgcgggttctccgaagcgttgcgccgagagctggccgacacccgggtcagcgtgctctacgtcgcaccgcgggccacccgcacgtcgatgaacagcgtgacggcgcaagcccttgaacgatgcgcttaaggccaacgtcgatgatccgcaaaccgttgcctcggcggtgatccacgcgattgcgggggaccgccgcgacctgtatctgggatggcccgagcgctttcttcgtgcgcctaaacaatctactgccgcaactggtcgatcgaggtctgcgcaa

SEQ ID NO: 703933 - DNA, 1004 bp, Homo sapiens
attaatcccctggcccaacccgtcatctactcttcacctatcgtttgcgaggcacacttcatcgaccagcgcataagcatcgcgcgtgatttatttaccgtgagtagtgcctagaaataaaccatgcgtagcgttggattaccagttcgtaaccaaaaaattcaaacccgtcagttccacaagaagcttgccagtcacgtatttccatcacgtcaagcaaccgtatccataatccttctaatagctctgctcttcaacaatatactctccggacaatgaaccataaccaatactaccaatcaatactcatcattaataatcataatggctatagcaataaaactaggaatagcccacctttcacttctgagatcccagaggattaccacaaggcaacacctctgacatccggcctgcttcttctccacatgacaaaaactagaccacccatctcaatcatatagcagaatctctcccatcactaaacgtaagcctacatacctcactctcatcaatcttatccatcatagcaggcagtaagaggtggattcaagcaaagccagataaggcaaaatcttagcatactcctcaattacccaaataggatgaatacacagcccataactcaccgatacactccctcaacattaagcaattccataaatacaactatcctatattaatcctcaaactaattaacgacattcctaatacatcaaacttaaactcccaaaacatcgaaccttaatactatctcgcacctgaaaacaagcctactcaatgaacctatacatacacatataagttacaattcacacatttccatactaccttcagaacgcacatgtctctatactaaaccgcgcttaattgacccaaaatgatccccataaatctgaaagaagtacacaaaatacacacatatacccatatatcacatacccaactcactacatcactcaccatataaacatctcatataccactctaagttaactttagtc

SEQ ID NO: 703934 - DNA, 815 bp, Homo sapiens
tgatctgtcttaaccttaataaaaatgggtctatcagacaacacggacttcctgacgtaatgcaataggaagtccacaccatcatctacaaagccttattgctggaataattgaactaggaaagagcgagacagggagctagatagaacagtatatggtcgatccctgtggtatccatcggggaactggggtccaggatcctccacgtagataggtagaagcttgatggattgctcaaagtcccgtgtataaaaggggcatacgtatgtatttcgctatattatcctactcacatcttgcggtatactttagattattctgttaggaatcaacttgatatcgcttagagcaccagagtgttaatatcaccttatggtacagattgagatttggttgatgactgtgtaatcttattgccaatttgcaatttagtatgtattgactgtggtatgggtatttgttagtagtgagcttgctgaatatagacgatttgagattgggtgtgaaactcttgcactatgatggggagggggctgggttataaaggggggagactacaaggagtagaggaaaagctcagagacatgaccgcagaaatggtgctggacaccattcctacgcgagggcaaatttacctgatgttcgttccagctaacccggttgcctggaattatcccaagctgggaagcgctcacaccagttaaacagatttaaccgagacctttgtgagcactattatcgcacttagatgccggtttgctggggctcacttgcgcctggtttcgaccccaaccttatacgccactcttgtcccc

SEQ ID NO: 703935 - DNA, 263 bp, Homo sapiens
gaggttacgagatccccatacagagtaaagggttgggatggatagaggttagtcaacagatacaaaattacagctagataggaatgagctctggtattctgcaatactgtaggatgaatatggttaactattatttattgcatattttcaaaaggccagaagagaggattttgaatgttcccaacacaaggatgggtgtcctaattaccctgatttgatcattatacgttgtatacacatattgaaatattactctgtatggg

SEQ ID NO: 703936 - DNA, 333 bp, Homo sapiens
tcggtacgtccctctgtagtacttctagactatgagcagggaatcgaggactctcaggcctttgtgttgggacactgactcactgcattagtaccttctagactatgagcaggggaatcgaggaacctctcagggctttgtgttgggacgctgacacactgcattggtactttctagactgtgagcaggggaatcgaggaacctctcagggctttgtgttgggacgctgacacactgcattagtactttgtagactgtgagcaggggaatcgaggaacctctcagggctttgtgttgggacgctgacacactgcattagtactgaggtgtcag

SEQ ID NO: 703937 - DNA, 378 bp, Homo sapiens
ttaaaaaaaaggggtttctggtaaggccggggaaaaaaattttttgcccccccaaaaaaggggggtgttaaaaattctaaaaaaaggggcccccccctaaaaaaggtgaaaaaaaaaaaagggggggggtctctattaaaaacggtttaatttttttgtcacacccctattacccccaaagggcccgggggaaaagggtcccccaaaaaaaacgccaaaacgtttttaaagaaccccccccgggttttaaaacacagtccttttcaaaaaatttttttaggaaccgtaagggtcccccttttccttccaggaaacccgccttaaaaaaaccgggaccgttcaattaccctcggattctccggcttcctactacctctt

SEQ ID NO: 703938 - DNA, 215 bp, Homo sapiens
acaggataaattaaaatttgtgttaatgtttgttatcaatgagatagaactgtcaggcacattatgttattttttttcttagcattttttcctatttccttgcgtgccatacaacaaacttgagtgtctgctatgtgctgaacactcagtatattacagttcatgatgggtaaacacacagtctgcacactcaggagtcttccattttattttag

SEQ ID NO: 703939 - DNA, 746 bp, Homo sapiens
cactctctccgtttctccgtctctctccctccctccctccctccagccccccaatcttttactaccaccatactcatccatctcgtctcttatctcttcaggaagagcctagtaggcgcgaaagcaccaacgaccgtctatgcacatgggaacatacacgtgagtacaatagtgacagaagaggaaacactcgattgcatcgttcccggattcccaggtggcctatatatgggagattctatactgacctatattgcctgtgatgcgaggatactggagatccagcgaggcactctggagatggagatgccaaggctgtccaacacatgtctgacagatattatctaccagcgttaagactcgacctgcgacatccctgagaatgctatatttggtccctgtgtcctgagccatactgccctatatgacggcatagcttgcatagcactcaagtctactgacaagagaacagtaccggatatactttcgggtatgacaacctcgagacgagcaaatggttcctcagaaggtctcatgtggctgcgtgtaggtccaatcgggcagagataacggaagagcagaaccttgaagcctagataaaaaatggacagattgttctaccgatctctccgcaggacttgccagagacgaggagtaactaggttaggacggggagaagaactgactgagtgactcttgctctgacccctactagatccacaacaaacatgcatgggcacgccccc

SEQ ID NO: 703940 - DNA, 511 bp, Homo sapiens
cgcgtacgccgtcagacgctgaactatgtgtatacaaaaacctgtacaagactgttcgttacagcttgatatgtaatagcctcagactggaaacaagcaaaatggccctcaataggtgaatggctaaacaaactgtagtaaatctataatatggaatactactcagcaacaaaaagaaatgaattatcgttctagcaacagtttggatggttttcaaggacattatgctgagtgaaaaaaccaacctgaaaagatcacacacattgggccaggcgcggtggctcacgcctgtaatcccagcactttgggaggccgaggcgggtggatcacgaggtcaggagattgagaccatcctggctaacatggtgaaatcccgtctctactaaagatacaaaaatttagccgggtgtggtggtgtgtgcctgtaatcccagctactcaggaggctgaggcaggagaattgcttgaacacgggaggcggaggttgcagtgagctaggatcgtgtcaatg

SEQ ID NO: 703941 - DNA, 874 bp, Homo sapiens
ggcacgttgccgcgcaggtaggtctacaagacgctattcccctatcatagaagagcttatcacctttcatgatcacgccctcataatcatttccttatctgcttcctagtcctgtatgccctttttcctaacactcacaacaaaattactaatattaacatctcagacgctcaggaaatagaaaccgtcttgaattatcctgccgccatcatcctagtcctcattcgccctcccatccctaggcatcctttacataacaagagggaggtccaacggatccctcctttacatcaaatcattgtggccacccattggtactgaacctacgagtacaccgactacggggggaataaatcttcaattcctacatatttcccccatatattcctagaaccaggcgacttgcgaattccttgacgttgaccaattcgaagtcgtaatcccgatttgaagcccccattcgtataataactaccttcaccaagacgtctgtgcaactcatgaggctgtccccacatttgggcttaaaaaactaggatgcaaattcccggacgtttaaaacccaaaacccattttccacgctacacgacggggtaatcctacgggtccaatgctctgaaatcctggtggggccaacaccacagtttcatgcccatctgtcttaggattaatttcccttaaaaattctttgacttagggccgtaattaacctaatagaacccctttaaccccttagagcttaaaaaaaacaaaaaccaaaacacaaaattgtgggcgccgcgccggaaaatcttcacacactcgtggcgccgcggccccaacattcagcatgccatgttcccacaacacggcacactggtggttcccccaaaag

SEQ ID NO: 703942 - DNA, 891 bp, Homo sapiens
  misc_feature (170)..(170): n is a, c, g, or t
  misc_feature (179)..(179): n is a, c, g, or t
  misc_feature (186)..(186): n is a, c, g, or t
  misc_feature (212)..(212): n is a, c, g, or t
  misc_feature (223)..(223): n is a, c, g, or t
  misc_feature (254)..(254): n is a, c, g, or t
  misc_feature (266)..(266): n is a, c, g, or t
  misc_feature (268)..(268): n is a, c, g, or t
  misc_feature (280)..(280): n is a, c, g, or t
  misc_feature (288)..(288): n is a, c, g, or t
  misc_feature (290)..(291): n is a, c, g, or t
  misc_feature (295)..(296): n is a, c, g, or t
  misc_feature (313)..(314): n is a, c, g, or t
  misc_feature (316)..(316): n is a, c, g, or t
  misc_feature (320)..(320): n is a, c, g, or t
  misc_feature (322)..(322): n is a, c, g, or t
  misc_feature (326)..(326): n is a, c, g, or t
  misc_feature (350)..(350): n is a, c, g, or t
  misc_feature (354)..(354): n is a, c, g, or t
  misc_feature (365)..(365): n is a, c, g, or t
  misc_feature (373)..(373): n is a, c, g, or t
  misc_feature (378)..(378): n is a, c, g, or t
  misc_feature (385)..(385): n is a, c, g, or t
  misc_feature (393)..(393): n is a, c, g, or t
  misc_feature (399)..(399): n is a, c, g, or t
  misc_feature (414)..(414): n is a, c, g, or t
  misc_feature (604)..(604): n is a, c, g, or t
  misc_feature (609)..(609): n is a, c, g, or t
gagtgccggcttcctcgtgtgaggggatctgccggacccctgcaaattcaatttctttcccattccgggcccttccctatcgtcgcccccttcaccttggatcatgtcaagaaatttgatgaaaaagaaaatgtgtccaactgcatccagttgaaaacttcagttattangggtattangaatcanttgatagagcaatttccaggtatganccatggcttantcaaatcatgcctaagaaagatcctgtcaanatagtccgatgncnatgaacatatanaaatcctnanngtanntggagaattactctttnnangacnangagnagggcctttttatccaaccctaanattncttcacaaatntccttttnatccngccaacnagcaggtngataanggagccatcaaattngtactcagtggagcaaatatcatgtgtccaggcttaacttctcctggagctaagctttaccctgctgcagtagatacatgtgctatcatggcacgaaggaaaacagcatgctctatgtgtgagtcatgaagatgtctggcagaagacattgagaaagtccaccaaggaatgggcattgcaaattccatanttaangatgggctgggcatttgacgactttactgagctcagaggatggctgggcctcctatggtctggcggaatcggtcgggtcgtgtgtggacgcatgacgacatgcctgggtatggcgataatcccccgctccaaacaacaaaacaaacaactcggcgccgcccaaaattaaaccacggggcggcacacatagcagtccgccaaaagggaacggggccaacaacgcgcgcgcaacaagttgtcgtcagcaagcgtccgcaccgcacggaaccctccgtccctccc

SEQ ID NO: 703943 - DNA, 1162 bp, Homo sapiens
cgtggtggcatgcgcctgtaatcccagctactctggagtctgaggcaggagaatcgcttgaatccgggaggtggaggttgcagtgagctgagatggttccattgcactccagcctgggtaacagagtgagactccgtctcaaaaaaaagaaacaaaaaaatctgaaagctaccactttcctatttataaactatattcaaatttctggcaaactgaacttccataaatataacacgagctgttcggcatacttcatccatcattggccttgggaaaataactgactataacactcctggctcgacgtagaaatgactgaacctttggaaatactgcataacactcactcggacagcttttcattctctataccaacacaaagaacctatcttgtgaaccgactcctggctccctttacatgtgagctcatcttcgcccgttcaccctaaagaacacgttacaacaggctcttccaaaggaatacactcatcactcccgttactccgctcctggccacagtctacagcggaacccatgtattgcgactataccctttccacactttaaccaccagcgagccacaaccagcgttaccgtggtccaaacactcaattgcggactcagctcacaaaaagccctacaattactcgcgcagcagcttgcgccttctatctacacaaaaaccttccgtgggatgctaccataaggcagagatcccacaaacaaggtttcgttactccaggcaaacagaggcaaagatgaaacccctcaatctccggagcctgtggtctaaccagacttagcgactaagttcaggccaaacgaggctatgcttcaagcttccgtaatcaccggacaaacatctacatgttgcccccacagttgtgacccacgttaagctttaacactctttaatagatagttttccgcctaggcgagccctcctctctgatcgtccctccagttcccttccccattaacactgcgaatcttcaacaccagctcgtcgcctgcaacgacaacatgacctcatcacggggtggcactcagaagcgggaaaaccaacccggcgtgccaatttggcggacccactcaacatggagggcttacacaccgcgaatttctaacggctctctgaccacgtacggaatactcttcccgc

SEQ ID NO: 703944 - DNA, 107 bp, Homo sapiens
accacacacttgtgcatctggctggtctcacgtggcgttaaatgggctgaaccctcactgccactttcacctgaggcaccagccatagctccagacactcctgcccc

SEQ ID NO: 703945 - DNA, 447 bp, Homo sapiens
gtagaggcagggagtcaagatttctataagggcagctaacaagggagaagacaagaaacatcacttggaaaagtgccacggtatgaggtcattcactgaaagaacaagctaagccctgcattcttagaagttcccgaaagcatcactgaattacttattggttcatccaaattccttgatatcactaagaaatggtctccttagcctccttatgctctgcttaataagacagaagagtgtgtaaagtgttttagaagtactcccatttgaaataatgtttttaagccaattgcattttgttattgaaagaggtatgtttcagataactggaaagttaatttatgtggaacaccaccctatctgcattactttatccccagcaatattatcttgctgtaagaacctgaaatttatattaaactcagggcatgtgcactaaaaaaaaaa

SEQ ID NO: 703946 - DNA, 370 bp, Homo sapiens
  misc_feature (4)..(4): n is a, c, g, or t
  misc_feature (24)..(24): n is a, c, g, or t
  misc_feature (92)..(92): n is a, c, g, or t
  misc_feature (100)..(100): n is a, c, g, or t
  misc_feature (357)..(357): n is a, c, g, or t
  misc_feature (362)..(363): n is a, c, g, or t
aganaaaaaatgaagttaagattnagcattgcctggtagttttaatgaacatataataatttagtaccagctttaggcccatatttcccatntattttantcagattttactgagagtgttgtttgtttggggatgtagaatatcagcactttcgatttgctttatttctcatttgtaggctatggctgtaatgaatttctaataattatgactgagtaatatctccagccgttctggcaacttgaatgtgttactggatagtctgtttctagtgatgattgtttatttatttaaggactttttttagatgcttgagatgtgagttactctagaatataattaagagctatggttantactnntgtgtaa

SEQ ID NO: 703947 - DNA, 230 bp, Homo sapiens
  misc_feature (11)..(11): n is a, c, g, or t
  misc_feature (15)..(15): n is a, c, g, or t
  misc_feature (24)..(24): n is a, c, g, or t
  misc_feature (28)..(29): n is a, c, g, or t
  misc_feature (50)..(50): n is a, c, g, or t
ccggaagaatnctgntggtgatcnggcnngacgtcgcggaggatctgggnacatcttactggtccatgctactgagactgacaggaaagatttggtgttgtactgcgaggcattcctgatcaccaccaggaagtaactgcaggtatagtgataatatcaaggaaattagaactaaaagtggagcctgaagatgtgactgaattgcttcagtctcacgataaaacttgaac

SEQ ID NO: 703948 - DNA, 350 bp, Homo sapiens
aatcaggcgatcacactgcctcattctcccaagtgctgggatacaggcacatgccagcatgtcagctaagtttttgtatttatacgtacagacgggatttcagtatgttacccagactggtcttgaactcttgacctcaagagatccacctgcctcggtctcccaaagtgcttggattacaggcatgagccactgcagctggctctccactttctgtctccatgagtttgagtacgccaggcacctcatataggcagacttcatatactacgtgcccttttgtgactggctgatctaccttagcataacgtcctcaggtttcatccacgctgtcgcatatcacaggattt

SEQ ID NO: 703949 - DNA, 986 bp, Homo sapiens
gacagagggctgagctgccggtcattcagctgaaggtcaggccaggtctcagcctcccctagagcctagttgtttgctcacctgtgacctatgctgtcttatctcattcagcagacaaccagacggccttgatgggttcccgttgaattcgtatgcgtgggcacccaggagtgtgaccttgccttgctcttacaggagatcctcatgagagacggtcggggctcagagcaactagacttgatgtcatatgtcgtggtatgacctgatgtctaagttgacgcgcgtattcctgatagactcttgagaagggatcacagcattccattgtcaagggaagactccattaggttgtgcaaccattgttgcgcatgttgcttctgaacgaaatgagtaagggcgctggcatgacctcacatggggagtaacacgcgtttgacatgggtgaagctggagacacgcatgggtgaatagcttatggctggcatgcaaatatctcccatctttctctcccttactttccaaagcaagttaggtacgctttcccaatggggattctggcctgtgtggttaggaaagggaatctccctgtggtcccatgtgcatggttgtcgaacatcaccctgttcgctgcagaagggaggcctacgggccatctccctcgtggtaggcctctgactccacctccacctggggccctcagttttctcgggatgcgaccagtggaggatcgttccctccgcggactcaaggggaggatagcctgggccagacgcgcgggacgagccccggggaacacctcacaagggcgggttttggggctcccgaaaaatccccaccgggatagggctcaaccccaggttacggccggtgcgtgagagtccaaactccgtgagggaccaagaaaaaggcgggccaaagagagtacaccctgcggcgtggcgcccagaggttgaaaacacggcccaccgaaagggggcaccgagata

SEQ ID NO: 703950 - DNA, 869 bp, Homo sapiens
ccgaggagtgtgggctgttggactctttgctgatggaccccgtgctgtgctggcccgtgggtgaagtgctgtgcctgatgtgctgtgcgtgctgtgctggctgtgccgtgtggtgcgacatgtgcgtgatgtgagcagtgacctatcgtgagtgtggagctgagcccctggttgtgctctgtgatgtgatgcccctgcttgccgtgtacccctgtgtgtgatgctgctgccctctgctagtgtgccctgactggctgtgctgtgctgtgctgtgatctggtgccttgctgagcacagccctgtgtgtgccattggtgctgatggcttggggcaatgtgtcaaatgaatgtgatggcatgcatgtgagctgtgggcgatgttggctgtgactgagtgatcaatagtatcccctgtttgttgcagttcctgcgaggtgcctgtcatgccagcgtgtgcttcatgctggctagctgacttggagctgcttgtggtgccccatttgcccggtgtctgctgtcaagctgtgctggccatgccaaaatgccaatgcctgcactggtcaatgctggcccattgagaactgccttcagtggttgttggtgctcatggtgcaggctgccgcaggtgaatggcttcgctggaccagtgtaccctgcaccgtagcacagacgcctgagcttccatcacatgaacgccttgtgggcaatggctcttggaattgcttgctttgaactgaagggtgagcaaggctggccccttccatctgaggggaggctttgttgctggattcctgtatttgcagccacacatcaaacggaccaccctgggactaaaagttaccagcccaggcggctggaggacctgggtgg

SEQ ID NO: 703951 - DNA, 887 bp, Homo sapiens
catcattttgcctctccctttttttttccatttgaaagactacttcattttagttttgcttcaataacacaagccatacttatactatatctgcgggatgaaatctgcgaaacctactagggtgtcaaaatttaacttctcatgaatctgtttggcttccaaaacatactcttggcttcccagaacagattcagaattcaaaagaatgatgttacggccatgctggtgatggctcatgcctgtaatcccagcactttggtgaggccaaggtgggcggatcatcgaggtcaggagatggagaccatcctagccaagcatcgagtgaaaccccgtttactactaaaaagtgcaaagatattatctcgggtataggatgagtaccgttgcattcggagtcccacgctatctcgggaggctgaggctggagaatcacattcaacctggaaggacgagaggattgcacgtgtagctgagacttgtgtccactgcactccaacttggtgacagagtgagactctgtctctatacagaatgaatagataataactagacaataatacatactggtactaaagtgcccatctaggtaagaaggcctatatatcatcctagaatgagacaacagcctactataaatagtatacttgttgccgcggatgcgcgtggctgcacgcgcttgtatatcctcactcactctggtgaggcccgagcgcgggcagatcaccgaggtcaggagttcgaaaccagcgctgaccaatatggtgcaagccatgtctctactaaaaatactaaaattagctgggcatggtggtgtaataccaacatactcaggaagactgaggcagtagaattgctgaacgcgggataccagcggggcgtggagacca

SEQ ID NO: 703952 - DNA, 115 bp, Homo sapiens
gatgacatacattacgccattgtgtgtggattccgctctgatagtccctagttactcgcgcgtacgacgtcgcaattcttgagattgagcgttatcccgggtaagcgtggcatct

SEQ ID NO: 703953 - DNA, 210 bp, Homo sapiens
tgctgacctgaggattccccccgtccgatggccatgcacggtttgtgtggtggcttggtatgtgctttctcgtgttacatcgcgccatcttggtatatgttagtgtgttggttagtattgcctagtctgcggcgcgttatggagtggcagtgaaatcacattgctaggccggaggtcattaggcgggctgagagggcccctgtaaggggt

SEQ ID NO: 703954 - DNA, 1056 bp, Homo sapiens
  misc_feature (4)..(4): n is a, c, g, or t
  misc_feature (26)..(26): n is a, c, g, or t
  misc_feature (92)..(92): n is a, c, g, or t
  misc_feature (96)..(96): n is a, c, g, or t
  misc_feature (119)..(119): n is a, c, g, or t
  misc_feature (127)..(127): n is a, c, g, or t
  misc_feature (155)..(155): n is a, c, g, or t
  misc_feature (177)..(177): n is a, c, g, or t
  misc_feature (218)..(218): n is a, c, g, or t
  misc_feature (244)..(244): n is a, c, g, or t
  misc_feature (259)..(259): n is a, c, g, or t
  misc_feature (283)..(283): n is a, c, g, or t
  misc_feature (319)..(319): n is a, c, g, or t
  misc_feature (381)..(381): n is a, c, g, or t
  misc_feature (392)..(392): n is a, c, g, or t
  misc_feature (400)..(400): n is a, c, g, or t
  misc_feature (406)..(406): n is a, c, g, or t
  misc_feature (413)..(413): n is a, c, g, or t
  misc_feature (460)..(460): n is a, c, g, or t
  misc_feature (475)..(475): n is a, c, g, or t
  misc_feature (479)..(479): n is a, c, g, or t
  misc_feature (488)..(488): n is a, c, g, or t
  misc_feature (492)..(492): n is a, c, g, or t
  misc_feature (524)..(524): n is a, c, g, or t
  misc_feature (527)..(527): n is a, c, g, or t
  misc_feature (530)..(530): n is a, c, g, or t
  misc_feature (532)..(532): n is a, c, g, or t
  misc_feature (534)..(534): n is a, c, g, or t
  misc_feature (545)..(546): n is a, c, g, or t
  misc_feature (561)..(561): n is a, c, g, or t
  misc_feature (563)..(563): n is a, c, g, or t
  misc_feature (565)..(565): n is a, c, g, or t
  misc_feature (588)..(588): n is a, c, g, or t
  misc_feature (590)..(590): n is a, c, g, or t
  misc_feature (592)..(592): n is a, c, g, or t
  misc_feature (599)..(599): n is a, c, g, or t
  misc_feature (614)..(614): n is a, c, g, or t
  misc_feature (620)..(620): n is a, c, g, or t
  misc_feature (623)..(623): n is a, c, g, or t
  misc_feature (626)..(626): n is a, c, g, or t
  misc_feature (640)..(640): n is a, c, g, or t
  misc_feature (644)..(645): n is a, c, g, or t
  misc_feature (656)..(656): n is a, c, g, or t
  misc_feature (660)..(660): n is a, c, g, or t
  misc_feature (662)..(662): n is a, c, g, or t
  misc_feature (669)..(669): n is a, c, g, or t
  misc_feature (689)..(689): n is a, c, g, or t
  misc_feature (693)..(693): n is a, c, g, or t
  misc_feature (695)..(695): n is a, c, g, or t
  misc_feature (714)..(714): n is a, c, g, or t
  misc_feature (716)..(716): n is a, c, g, or t
  misc_feature (729)..(729): n is a, c, g, or t
  misc_feature (731)..(731): n is a, c, g, or t
  misc_feature (753)..(753): n is a, c, g, or t
  misc_feature (764)..(765): n is a, c, g, or t
  misc_feature (775)..(775): n is a, c, g, or t
  misc_feature (783)..(783): n is a, c, g, or t
  misc_feature (795)..(795): n is a, c, g, or t
  misc_feature (854)..(854): n is a, c, g, or t
  misc_feature (872)..(872): n is a, c, g, or t
  misc_feature (889)..(889): n is a, c, g, or t
  misc_feature (918)..(918): n is a, c, g, or t
  misc_feature (920)..(920): n is a, c, g, or t
  misc_feature (928)..(928): n is a, c, g, or t
  misc_feature (931)..(931): n is a, c, g, or t
  misc_feature (935)..(935): n is a, c, g, or t
  misc_feature (952)..(952): n is a, c, g, or t
  misc_feature (967)..(967): n is a, c, g, or t
  misc_feature (1015)..(1015): n is a, c, g, or t
aggngtgggggctggggactgcaccnccctcctactcatgggggacagcagtggggactagggaggggcaggagagggggctgaagcaaggnagcngtaatggggccacgacgccacanagccagcnccgtcctctcccagaccctggtgggagntcctgtggcttggggtggggantgggggacccaccccaggccctccctctcccttcctcaganagcctcctttcgggctcaacccattncttccggcaggagantgaggcacaaagagaggaggaagngggagaggaggacgagggaggggcagggtggcagcncaaatgaaggcagaggtgagaggcgtgggcaaggccactccacccccacacccaccccaganaggggcgaggnagcaacancatcangcagcangtgggggggacaaggcggggtttaaggctgaggggcccggggcaggnggggcctcgggcctnagtnaaagccgtnccanttgctgttctctgagttgtattccagcccggngcncanananttgaaaacatnnagcagcatgggcgtncngnggtgccggttcatgaagcgggcntncnccgtcangcgcacacaggtgcnagttcnaanttngcaggctagcagtntctnntctttgaggangccntntttgtgngcagagttctcacacttganaatntnaccttcagggacgggcacnangctgaggagcttnangtgcaggctggggacaggtgcnttgcggacatnnttgcacagcntgttcacngggggcagagtnaaggtaatctcaaaactgttcaggatcttcaggaagccaactttgaacagaaagctgcngttacttttctgggttancatgaacaccgagttangcagcttctcaacaaagttgacgtggctntnggaacctnctncatngtggcctgccgcaaagngagtactccggactntgggcttgttgccttgttggctgcagcatggacgcctcctgccaagcnctcctgccagaaacgccactaagctcagcagccttccatgc

SEQ ID NO: 703955 - DNA, 636 bp, Homo sapiens
gtgagaactgctttatggatgctgctggtgtggcctctctgttaactacgagcagaagttgtagtctacagaaattcctaagagaagagaaggaccctgtgaatgggtgcaatgggtggaatgggaggtggtatgggaggtgggatgtgcgtaactcgctagactagtggtttagcatttattaatgaacgtgtgacaggaagcgcaaggcagtgttcctcaccaataagttcagagaagtcagtgggtagaaaatgaagaacaaaggctgggtggaaaatcactatgaagcatcagttactggttgtcagtttgacaaagatatatagtggttttactgctgtcgattgtccatgcctagcagtatagattggatttggtgattgtttggaagtaaggaaatcatttgtacatgtcctgatacttgggtacgaagagccgatgtaccagtgtacttgctttcaagttagatcactgaggcatttttacatagtattctgttaagaatcaggatgtggagtgctgtgccagcaggcagatgagaagttaagcgagcctttctgtggagagtgagaatgattgtggtacaacagtagagaagtatccaattatgtgacaaccgttgtgtaataggaa

SEQ ID NO: 703956 - DNA, 322 bp, Homo sapiens
  misc_feature (53)..(53): n is a, c, g, or t
  misc_feature (196)..(196): n is a, c, g, or t
  misc_feature (304)..(304): n is a, c, g, or t
ctgagaagtatcattgcttgttttgaaagaatacaacaggatttaagtttctntttaaaaattgcactgaagaaaggccgggcgcggtggctccccctgtaatcccagcgctttgggaggccgaggcggggggatcacgaggtcaagagatcgagaccatcctggccaacatggtgaaacccgtctctaataaaantacaaaaattagccgggcatggtgacgtgcacctgtagtcccagctactagataggctgaggcaggagaattgctttgaatccgggggaggcggaggtttgcaagttnagccgagatcgtgccact

SEQ ID NO: 703957 - DNA, 481 bp, Homo sapiens
  misc_feature (333)..(333): n is a, c, g, or t
  misc_feature (408)..(408): n is a, c, g, or t
  misc_feature (445)..(445): n is a, c, g, or t
  misc_feature (449)..(449): n is a, c, g, or t
  misc_feature (456)..(456): n is a, c, g, or t
ggtacactgagactctgttcctaaaaagaaaaaaaaatgtatgattatttttccacttcttaagatttcatgtctttatttttcagacattctgtgggattttaaaaaaattttttatttgatatgtggttatgtttccatatcctcttttattttactaaatattgaaaacattttatattcagcctttcacacttcatgtggttcagcgtcttggtggtcagcttctgctgtctgttcttcctcctggtgctcaggatggcatgtgtccttgtgagtttggtgatttgagattgtgagctcatgttcagcggggattgggctgtgagaatncaccggccctgggatgaggctctgtcctgctgggggctcatgtctttgtttctgtggggtggcccagagccttangaatctgaggcactttaacctaattccttgtcatttnggtntcacaanatcgcaagcggtgtgcatgggatca

SEQ ID NO: 703958 - DNA, 854 bp, Homo sapiens
  misc_feature (308)..(309): n is a, c, g, or t
  misc_feature (724)..(724): n is a, c, g, or t
gataaatattatactaagcatatataccatactacactatactaagtgaataactaagtaataatactgctacacacctacataatacctaccctaaactaatagcctaagaaagtgaataaataactaattactgtctagttatacaatataataatgctaactactacataaaccctacaacacccactaccctactataatgccaataatatagtagcctaatatgccataactaagtactatatagcctgcctagcgaagcagctggtagtgcctaagccctaactaagtactacaatactacnncaacacataataagtgctctaaagactaactgtaacataaacctaaaacctaactaccaatagctaaaaactaaatacgtacccaacaattaataattaactaaccacctagacatagactactaccaaaaaacacataaattttgaatacaacacaaccacccacagcctaattattagcatacataccccctaactattttttaaccaaatacaacaacaacctaatttaactgtatccccaacctattacctaccgaccccctaaacaacccccctacctaatactaaactaccttgactactaacccctacacaatacatggcaagccaactgccacttataccatgtgaaccactatacacgaaaaaaactactaacctactactaataactaaatactaccctaacaanatactaccttaaattaataaacatatcacagtccacagaactaaatacatatatttatatactatactacggaaaccacacttataccccaacctatgtgctatacaagaaaaataacaacacaaggggg

SEQ ID NO: 703959 - DNA, 981 bp, Homo sapiens
agaaattaaaatggtatcagagggttttctctaatcattttttctatttgtttttttggtacttctagatgtttgggtatatacagcttcatttatagatgagcattctatatttttggtttggttggcccaatttccttatggggttttaatagtctatagcattttaaaacggctgatgtggtaggcataatttacaggctaaaaacttagtagcatagagttggtctggcgcacagccttctggacaaagtttacagttattaaagtggcagtatccttttaaatggctagtaatcaggcactctttctttttatttttaaatagaagacaggggtctacgcagggttgccaaggttgggtctgaaattcctgtggatcaagggatcctcatgggcttagtctccaagagtacggggataacagggctcttatcttttaaaactataaaatgtttaaaatggggtataaactctggtactctggcccataaatgtgtttaacgattacggtgctggtgaatcatgagtacgggtagagagattgtctccataagatgaacttcatagggaaatggcctaaaagaatctcacaagagcggcgcactcccgggttaaacccagggggaattgttgtcaaaacacggttcaactcgcgacaacgcaggcacaccggggagccgccacttccactgcgctattgttaccccagcaatttcacaacgtgggcgccaccagtcttattgaacaccccggcgtctcaaccaacaggggcaacaagcagcgtggcgtaaaccaaccgactggtacaaaacatcaccagcgctcgcaacgaggacggcataaacacaattgcgcgctcgcactatgggcacaaacccagtgcaggggaggcaaaacagccaacagtgttcacacgaacgaacaggtgtcacaccgcggcgagcacagaagcaggcgttgcgcccccacacaacacgg

SEQ ID NO: 703960 - DNA, 520 bp, Homo sapiens
  misc_feature (192)..(192): n is a, c, g, or t
  misc_feature (194)..(194): n is a, c, g, or t
  misc_feature (199)..(199): n is a, c, g, or t
  misc_feature (201)..(201): n is a, c, g, or t
  misc_feature (207)..(208): n is a, c, g, or t
  misc_feature (218)..(218): n is a, c, g, or t
  misc_feature (235)..(235): n is a, c, g, or t
  misc_feature (245)..(246): n is a, c, g, or t
  misc_feature (374)..(374): n is a, c, g, or t
  misc_feature (376)..(376): n is a, c, g, or t
  misc_feature (378)..(378): n is a, c, g, or t
  misc_feature (393)..(393): n is a, c, g, or t
  misc_feature (510)..(510): n is a, c, g, or t
ggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctntnagttntntccctnntacttccagngatctgagcctgttttnagcttccttnnttacccaccctgggagactcttggcctgttagattgttccttgagttttcatggtatttcttaagaagggatttttacttgttttcacttagtagatgagggttatgtgttttctgtcctccttaccngncntttctgtttaacccntgcatgcctagcttccttctgctccatttcctcacctcagtcctttgaagtggtgttgtttctgtgaagttgttttctcttctgcttggagtgtttttccttttttgtcttggaaantgtgggcagc

SEQ ID NO: 703961 - DNA, 1005 bp, Homo sapiens
gtcccgtattttaatttgcccaggtaccctccaagaccatttcataaatgctgaagttcttcaatttcaccaatgataacgacacacgcgtttttaaaacagctccgtcggccccggattcatttaacagttcggtggaacctgtcctccatacttaaagtacctggtaggaccaccttaaaccatcccaaccagagggaagtatgcatcttgatgagttccccaccatgcacggagttacaggtagtgagttccaatacctcaggtgtagcattcacacctctgtcatatacctgacatatatatgacgtgagtatactggccactgagtcctgtaactactgactcattcttccaatggtcactggggcaatcactttatcttccacctgatgcctgcacctagatatgtactgttgcgtggacgaaggattctcacacttggtggcatcagccaacaacgcatttattatctcactgatttctatggactcacaaactgctaggcatcagtcttaacttgtgtcgctcctgggtcaaggtctttgttgacgcttgccacgcaaactattggccagggctgtggtctcatctgaagcgccatgagacgagaccgcacgaaaaaggggagggacatctgttttcaatttcacttacacaatctattggcaggtccttctacgctgggctgaatgacaacatggtagcctgacttcccatatgaatagagagcactaagataagcaggatgtgagagaagtgagagtaagagacacgcacaagatgagagttgagcaagaatcactcgtgcagaccatatgcacccaaatgtgcaccagagacacagaagtcacaatctttctgtgatctaatcttgaagtaacatctcatcattgtattcatcacttagttagaagcaagtcaacttcagcacataaccaggagaggaaatacacaggttgtgaaataccagaacctggctcgttgtgatcctcctagggagaa

SEQ ID NO: 703962 - DNA, 164 bp, Homo sapiens
taaccgtattctgatcctcatgtcctgtgcggtttcagccgtgcaggacaaagcctatgtgaaaatagtggcgcactgaatgtcgacctcgagcctcgatcttgtccggcaatatccgatcgtgcgtgccagcacgatcgcgatcctgttttttggtttcgcgg

SEQ ID NO: 703963 - DNA, 429 bp, Homo sapiens
acttctttcaagatgtagccatcagttactgcactgctattactgacttaaatggacctttttgcttttacaaactatacttatctatggttctttgttgaagaactcaggagttcgacattaatagaaattagaaaattttataatgtattataaaatccattactaagttgaaagtatgcttttaactctgtgtatcaggggatgtatgtttgtgtggagatgtttttttctgtctgtaggcacatgtatatatcccagtaagttcttattttcatttcatttctacatttttatgaacttgttttataagggtactgtttagttgtgataattaaatatatataaaagctttctgagagattatttactatatgaatatattttcagctggctgatcaaaagtatttttaaaattttgtttttagc

SEQ ID NO: 703964 - DNA, 192 bp, Homo sapiens
cagcatcgctaaccagggggctgccgattacactcaccctttctgtaaattaggaagtttcaaggaatgatctcttgctttctttctttttaagtggagtcttactctgtcgcccaggctggagtacagtggcaagatctcagctcactacaacctctgcttcctgggttcaagtgattctccagcctcaga

SEQ ID NO: 703965 - DNA, 258 bp, Homo sapiens
gcgctgtgagcagtgacgcgcgaggctttctgaggcaggataatcactttaaccctgtggggcgggcaggttgctgtgcgctgagatcatggcagtcacactctagtcctgggcgacaagagcgagactccgaaactctatgctaaatgttttttgtggtatctctctcttaggaagagaaccagaggctttttttcttggttccaatttggggggggtcccgggggcccaattcggaatcctgggcttggggttttc

SEQ ID NO: 703966 - DNA, 274 bp, Homo sapiens
gaccagcgagagtacttgagcctgggaggtggaggttgcagtgagccgaacgaaattgagccacttcaccccagcctgggcgaaagagtgaaataccattcaaaaaaaaaaaaaaaaaaaaagggttaggggctgggattaactgggggggcgggttgtgggaaaattggatttaagggaggcccaaaaaaaacagaaagggctgggcggggcgaaccaaggccttatatctccagcatttgggagggctgtgagaaggggggaatggctgtgg

SEQ ID NO: 703967 - DNA, 641 bp, Homo sapiens
gcttggcaaaatggtattttggaatgtgaagttcaaccttgtggcagtaggttgttgcaatagtgatctggcactatgtgtgccagtatagccacatagcggttatttacacttaattaaataacatgacaaaatttatatttttccagtgtgcattagccacatcttaagtgtccggtaagccacatgtgacctgggtggctaccattattacgtgcagatatagacaacgaacatttccatcatcacagaaacttctcttaattctgggtctagaagataacccttagtactgtggtaagacaatttttggacaggcttatatgaccgacaacagttgtgtaaccccttgagtctttgggtattgccccaaaaagaacaacattagggtaatccctttttcaatattattcgagacccagaagaaagctggttattccagccactatttcttgggacaatggctaagtatttgtgagcgtcttattggccatataccacgctcttaaaatttgttgcccaagatctgtgttcgtgggaacatggcttaagttttcctggatcttaccagagaaattttaccgagcgaaccattaggttaggaattaattgccttccaggtaaagagctggctttaaaaa

SEQ ID NO: 703968 - DNA, 972 bp, Homo sapiens
ggagagagagaactagtctcgaagtttttgttttttttgtttttaaacagtatttcttcagaactttattaaaaaatgacttaaagtgcatcttattaaaaaatgtttaaaaaccacataatttcagggccccgttgttgctgggcagctgcttgatactcccttagaaggtggaggaaaggtgagaggatggcagggtgaacgtggggacgtggggagcaggaccagtggttgcgagtcagtcccgtcgtgtatgaagatccaagagcatggcgcgaggtgtgtatactggtgggcaaggggcgacacgggattcctcaggcacaagaatggcaggcagatggcaggggaacgagattgtcattcccatgagaattctgcaggcgcaaaggcgatccatttggtcccaggaaagtcctcgtcctgaagcctcggagctgatccatcttgcggtagtggccaagaggcacgtgaattaccagagctggaaaagaggtccacgcgaagttgggttccgagacccaggaacctggatgagggccgtcacttgccagacttaagccctctggtcccctgagagtggtgagaacacacggacagcaagcaaagttacatcctcggtctgactgggcataggcagaacgcacggaagcccaagctggtccctgaatctgctagtgagcacagggcagccggttggccagcgggaataatgtggcacacggtgaacaggccagttggcgaagggtaaaccaactcagttcctgaaaacaacaccaatccaggatgacattccaaagacaccccacgggagaaggacacatagcacatgcgacacacgcaggacatatgcaagcaatgccaagcctaaccacaatgaccacacataaaactacaacaattagcaaaaagcaacaaaaacaacagggctaaataaacatacggagacagtcccacaacaaaaaagagcca

SEQ ID NO: 703969 - DNA, 409 bp, Homo sapiens
atctatatcatgggggcagttacccatcatgctgttcttgtgatagtgagtgagttcgcatagatctgatggtttactaaggggctcttcctgctatgcccggaacttccccttcctgccactgtgtaaagaaagatgtgtttgcttcttcttctgccatgattgtaagtttcctgaggcctccccagccatgtggaactgtgagttaattaaacctcttacctttgtagattactcagtctcaggcagttctttatagcagcagttaccagagagtattcaattatatgaactaatacaccacacaatggaatgccctttggcaacacaaagagcaaactattgatacattcaacaacatgaatgaacctcaaaaacatggtatcatgatattaagtgaaagaagtat

SEQ ID NO: 703970 - DNA, 328 bp, Homo sapiens
cacgaggttttcttttatttttctaacattggcggacgtttactcacacacggttgcgatgaataagttaactcagtcactgacatttttgctacaccaacattcctttgactcctatgcttacacccaaccccccatcatagcacaacatcgtcctttcttcaatcacaattggagcacaaaaggtcttttcaatcccttttcccataaggtttacaattttacacagcaagttaactatcactatgttacatcataacacatcgatttggtcaatcatatttccatcatattaacgatacttgttgagcatttttcctttaacacg

SEQ ID NO: 703971 - DNA, 102 bp, Homo sapiens
ggtaggcctgggagcagtggtggctggaagacgaaggacctctggttatgctcgacagatacggaattatgtagtgatgaaaagagtcgtcgatcgagtcac

SEQ ID NO: 703972 - DNA, 322 bp, Homo sapiens
  misc_feature (38)..(38): n is a, c, g, or t
gtttattaatatttaaacatattaaaataatacatgtncataatgaaaatgaaacattacaaataaatacacaggaaaggcagtattccccttccagttccactcttgaaataaccagttaacaagatgatgaacatctttccatgatgttctccaagattcatattatttttgcaatcatacaatggcatatacagctcaggtgcggtggctcacgcaagtaaatcccagcattttgggaggctgaggcgggtggttcacctgagatcaagagttcgaggccagcctgaccaacatgaagaaaccctgtctcttactaaaa

SEQ ID NO: 703973 - DNA, 140 bp, Homo sapiens
  misc_feature (8)..(8): n is a, c, g, or t
  misc_feature (14)..(14): n is a, c, g, or t
  misc_feature (24)..(24): n is a, c, g, or t
  misc_feature (35)..(35): n is a, c, g, or t
atgggtgnccattnacggtgtttnccaaaaaccanaaaaagtgttttcctgagagttcgtgtcattcgtgacttttttgtaaagaagttgtgttttcagaggtgattttatgacaggaaagtgaaaaaattagttttgca

SEQ ID NO: 703974 - DNA, 289 bp, Homo sapiens
  misc_feature (41)..(41): n is a, c, g, or t
  misc_feature (147)..(147): n is a, c, g, or t
  misc_feature (203)..(203): n is a, c, g, or t
  misc_feature (226)..(226): n is a, c, g, or t
  misc_feature (244)..(244): n is a, c, g, or t
  misc_feature (266)..(266): n is a, c, g, or t
tcctccttgggttaattaatgtgccaaagcccggaattacnggaaatcttctctagcaaccttgcaacctcttgtgatccctgtccatcatcccccgtcgccgtccctgccatgaccggtcatcctctcttcggccatggtcccccnagtcacgtctgccctggggggaggaggcagccccggccctcgctcatcctcttgtnagagccatagcccccccagccantctgcgggagtcccgccngtgccctctggtcctccattgntgttctgggtaatgcttgtcctt

SEQ ID NO: 703975 - DNA, 853 bp, Homo sapiens
agcgggaacgggggcttccgctcagcagagaggcaagatggctacggcagggggtggctctggggctgacccgggaagtcggggtcgtccttcagccattcttgtatttcgtggcgtccgtaatagcaggtttgtgcgaggggaaactcagtggagacggaagatatatatccccttaaataaaacagctccctgtgttcgcctgctcaacagccaagtcatcagattggctgccgagtcttcaattagtggagacacaggggttatccacgtacgtagagaaacgaggaggacctacagtgggtatcgactgatggcccaacccccttacatggttctgctggagagcaagcattttaccagggatttaatggagaagctgaacggggagaaccagccgaattgctggtcttgcacgtgtccttgaccaagcccagtcctgcctcaggcttctctcctagtgtacagtgcccaaatgatgggttaggctgtttactccaattcctatgggcccagagttttgctcactgcaagagaaataccgtggcacttccgctgggcaaatggttgggcttcactgacgactttagttttccccatctttcttcttggaagatgaaaatgaaacccaagagtcatcacagcagtgctaatccaagatcacaacctgagtccagaattgtgctcagggacaaacttatcccagttatgtgcccatggcagcgctctttgcacacattgcattgcttgtcaatcagtcactgcacaccttgaattgcggcgcagttcccatacaagagcaacgttcagcgatcaacccagagaatcgtctgggacccctgtctggatgacc

SEQ ID NO: 703976 - DNA, 738 bp, Homo sapiens
cccctttaaggtgattttccgctccacaacgaagtgaagtcatagagtggtcaacaaccacagtgccgccacaaattggccaaaggtttgatcgtacaagtcagggtgccctcagaaccctctgcgacgtccagggctcctcagtagcattcaagtgcatctacgtctgtcacggtggggcaagcagatcctaagccgccttgttattgacctacgtgcaccaggaaggcgtatggatccacgaatacagggattgctcctttccagggtagaagttcattcatcaaccacggatccgcagcgtattacatcagcccctgtggtggcacacagccagagcaagggtgatcagtgtcctccctctatccacacaaactctagtaggttcagccgtattctgccgattgcgtatatgggggccacctttagaagcactctctcgagccctgtaacacccatactgcaaattagtgacaacacaggggcctggctcccagcacatcatgcaatgtcgaacaatcaagtgcaaataaccggcggtaatcacaacctgaagggtcccctcaaatcccttcaacacaagcgtcatgagcaggattagtgtccgagctgagtatgcaagccctagagtagaataatccaggccgtctgttaagcctggggaacacaacggcaactgggaaatttgtaagtgaacgctgtttcataaaaatatgcttcagactttctaaacaagta

SEQ ID NO: 703977 - DNA, 1172 bp, Homo sapiens
  misc_feature (336)..(336): n is a, c, g, or t
  misc_feature (562)..(562): n is a, c, g, or t
  misc_feature (676)..(676): n is a, c, g, or t
  misc_feature (779)..(779): n is a, c, g, or t
  misc_feature (875)..(875): n is a, c, g, or t
ctggtgtgggtcgatggtcgactagctgattagcgggggcacgtcctacgtgctagacgatagactcacagtgcacgcgaggctctgtgcaactgacggaagacagcgcgcatactacccatacgaatggtacttgtcttcattgcttcgcctggtgataatcattcgtagctttcagcctgccaaggaacaccatgggtagggaaccctgaatcgtatgcgtagtctttcttggaccaccaggatgaatagaccatcgaacgtgcatctaatacgaacctcgcacaagcatgtggtgtattcccttccttgcactccaatagagcaccaagcaantgtttcgacccatgaatgggacttgggggcattaggacaccagttacgacaaaagtaggtctgacctctggacgacgcgacagtgtgattctgcgacatatcgaatacacaaacgcgagcatatcttgtaacatacttagatattctccaggggacgcgaaattggcagacgttctccgtgcaacaggttagacatggagacacattagttgtagaccaaggaggntaatttccaatacgagccaagaaaacgcacttggtttggggctaacgcctaccaatgtcgcccaaccgagatggggacttcctggcggttggggcaagtgggccattggatatngtctcccgtagggggtcacgacactgcggtccacaggaggcatttgtggttccctttccataagtccagcggatgaaatggcaccatatctttcgaaccacgnacctatcaatggggccaccgctgggcatggggcaggagatgcctcttgccctctcggagctttggggcgggctaatgcagattctggcgcttcaangaaagtgtgtagcgcatttttgcactatatttccttccactatacgtatgaggatgagcataacatcatagaatctggttagcggtctgctgggcaaaggcacggagtaagtattgactcaaggagcatgggcgaacggggaactggtggtggtctgggtaacgccaccgttggtaaggagcaagtcaaaccaactttggatagggaaatggccaaaattaagatatccttggcttaaggcaggctggccgactctcgacagtaacatgggccctcttgtttttagccccccaatgg

SEQ ID NO: 703978 - DNA, 196 bp, Homo sapiens
  misc_feature (180)..(180): n is a, c, g, or t
ggtgactctagaggagcttcacactgggttcgagttcgaacagctgaggttgaggatagtgttataagggccttccacggtgacctcaatttcaggaacctttgaatactcccaggacttcgtggtcttttgggggactgcaaaggctttaggtgtttattttcactagccatcccaggnaggcaagtacggagat

SEQ ID NO: 703979 - DNA, 516 bp, Homo sapiens
  misc_feature (297)..(297): n is a, c, g, or t
gggaacccaaggagccagccccagaaacagctgatggcccctacctggtgatcgtggaacagcctaagcagagaggcttccgatttcgatatggctgtgaaggcccctcccatggaggactgccggtgctccagtgagaagggccgaaagactatcccactgatcaagatctgtaactacgagggaccagccaaggatctgacggtggaccttggtaacaacgaacaagttgaccccaacctcgtgctcatgccccacagtcttggtgggcaagcaatgctcggagcttggggatcntgcgccggtttcttgtggggccccaaaggaacatgactgcccaatttaacaaacctgggtgtccttgcaatgttgactaaagaagaacatgatggggactatgatacaaaaacttcagaggcagcggtccgctctaggccccaggaccttacggaggccgagacagcgggagctggagcaagaggccaaagaactgaagaaggtgatggatctgcgtaa

SEQ ID NO: 703980 - DNA, 176 bp, Homo sapiens
catggatttgctggtgcagtacaactaggcttaatagggacatgtctgtataccaacagctaacaatctgaaaaagaaatcaaggaagcaatcccatctgcagtagccacaaataaaataaaatacctaggaaataagttacccaatgaaacgaaagggctctacagtgaaaacta

SEQ ID NO: 703981 - DNA, 129 bp, Homo sapiens
tgaagggtcatcccagatgctgtggggcaagtacatccccaatcgtggcctctgacaagtggcgggcctgaatcatgagggtaccaatgtgctgcccccctcttaatactcaccaataaattctacttc

SEQ ID NO: 703982 - DNA, 402 bp, Homo sapiens
gcagcattaagaatagcgtcacgtgaccaagaacacacatttcttacaaatcagcagccccaatacatgatgcctaagatgtcccaaaaaggccaggtacggtggctcccacctgtaatcccagcactctgggaggccacggtcggagggttgcttgaagctaggagttcgagaccagcctgggcaacacagaccctatctcgacaaaaatcaagaaaaaaattagccacgcgtggtggtgcacacctgtggtcccagctactctggaagctgaggtgggaggattgcttgagcccagaagttcaaggctgcgcaagctgtgatggtgccactgcactccagactgggcaacagaatgagatcctgtctctaaaataaaattgttcataaagatctccccca

SEQ ID NO: 703983 - DNA, 705 bp, Homo sapiens
gcaaggaggcggcggcaagacgctcgagtggcgagtagtggaaccggttgcttctgaggggagtccaagatgaccggttctaactgaatgttcaaggttgaaccatgctagccagaaggatagagatctcctccgtgaagttcaaccccgaacacctcccatgtgtcctgcttgtctcctcctgggacacgtcctgtagcgtctttactgatcgtgtcgggcaactccattgcggttcaaggtaccagcacgaccgggcggccgtgcttggactgcgccttctacgatgcaagggcatgcctggacgtggaggactagatcatcaattgaaaatgcatgattcgaacacgtgatcgagaaccatcttgtggggacccatgatgctcccgtatcgagatgtgtgaatacgtggtccagaagtgaatgtgatggtcgactggaagttgggatcagacagttaaactgtggggatcgcagaactcctgtgtaaggctgggaccttctctcagcctgaccaggtatataccctctcagtgtcttggagaccggctgagtgtgggaacgagcaggcagcagagtgtaggcgtgggaacttacggaacatgggttacgtgcagcagcggcagggagtccagctgaaataccgagtgggtgctacgagcgttcaaaacaagccggtatgtattacgtctattgaggccggtg

SEQ ID NO: 703984 - DNA, 690 bp, Homo sapiens
gcaggagctgggcttgccctgcggagcagtagctaggaacagatccacttgctgggttgctgttcccagccatggcttctgcgctgctggctgctggtgtggtgctggtctggctgtggcctcgtgacccggctgcctccctgccgggagcacccctgatgagaatgacccctccatgatctagtgtaggttgtgtgcatgttgagcccatgctgtgctatctacactgtgcccaacgaccttgctaaattgcaagcaccacccatgtgcccactgatgagaacaatctacagatgagaatcatgaccgtagatgccctataatgagccatagtgatagctgcatataatgagctagttgtgcaagcctagaatcatcccccgaaggcgctgcaacgaccgtgacccagtatcttgagcacagcatagtagcctatacttgtgtgcgcaagctgtagggagcgtagagcgcacggggaacctgttagaactggcttgccctgggaatgcctagctagagagatgagacctaccccgaacaagctaagatagcagtttggcctttggacggcgataccacttgtgagcgccaaggaggggaagacaaattcagaagtacacccttaggggaaaacatattaccatatggggatggaccgcgcatagacttatggcccaaagtggataggtt

SEQ ID NO: 703985 - DNA, 291 bp, Homo sapiens
aggtaaatccacaggcacagacagcagattagtggttgccaggaactcagggagaggggtatggggagtaaagggttaataatctgagtttcctttttggtatgataaaaatgttttggaagggttaattttatgttatatgaattttacttcaataaaatctagggccagtcacagtggctcacgcctgtaatcccagcactttgggagaccaaggcaggaggatctcttgagctcagaagttcaagaccaccataggaaacatagcgagatttcatctctactaaaact

SEQ ID NO: 703986 - DNA, 189 bp, Homo sapiens
tctataggatccccgatgaacagcatcgccgggtttgagatcaggtgccgtcatttcttttattgattgttcggtgaaatgagctttgatgctggaatttgacagcccatgtttttgcctctgcatctactgctgtggctgatgggtctggctggctgatatcaacgcgtacaagccgaaagtataaga

SEQ ID NO: 703987 - DNA, 296 bp, Homo sapiens
  misc_feature (221)..(221): n is a, c, g, or t
ttcaataaatagtattgaatacctattctgtactatacaaaacactggtgataaaacaatgagcaaaacaggccattcttggattctgagaccattcctcctgccacacacaactccccgcaagaacacttagctatcagtgggaaaaatccagtgtctttctcttgctgggaccgtcatgtccatatcagtcatatacaatatcacaggtaaccctgggngggaggggaaagggggatggggaaccaaaatgcaaaggacctgggtgctaagcgccccatccttatttcatggca

SEQ ID NO: 703988 - DNA, 378 bp, Homo sapiens
  misc_feature (98)..(98): n is a, c, g, or t
agcaaatccaggtttttgaagagttaactcaccaagtgcaagaaaaagattctttggcctcagcagctccatgtccgccacgttgccatcgaacagcntctgaagaactgttctaagattccatgtctgcaagtagggcgaacaggaatgaagtcgcacctacccataaacaactgacctaaacagacttacttcgatgccctgccctttattggtctcccagacatgcaaactttgaagaagttgaagaaagttgtggcattttatggcattaaatttgccaacataggcagtattacactattgcaataagcagatcataatactcatatataattagcatcaaagagaatatacatggacgcagcagccacagag

SEQ ID NO: 703989 - DNA, 639 bp, Homo sapiens
  misc_feature (60)..(60): n is a, c, g, or t
  misc_feature (119)..(119): n is a, c, g, or t
  misc_feature (161)..(161): n is a, c, g, or t
  misc_feature (187)..(187): n is a, c, g, or t
  misc_feature (202)..(202): n is a, c, g, or t
  misc_feature (214)..(214): n is a, c, g, or t
  misc_feature (225)..(225): n is a, c, g, or t
  misc_feature (233)..(233): n is a, c, g, or t
  misc_feature (356)..(356): n is a, c, g, or t
  misc_feature (361)..(361): n is a, c, g, or t
  misc_feature (498)..(498): n is a, c, g, or t
  misc_feature (521)..(521): n is a, c, g, or t
  misc_feature (525)..(525): n is a, c, g, or t
ggcggcggggaccatgttgcttccgaacatcctgctcaccggtacaccaggggttggaanaaccacactaggcaaagaacttgcgtcaaaatcaggactgaaatacattaatgtgggtnatttagctcgagaagtctgatcatcggatatcatggagtctngcaagacggcttctcccaagagcatnccgaaagatgcacanatgatggcacanatcctgaaggntatggggnttacagaatatgagccaagagttataaatcagatgttggagtttgccttccgatatgtgaccacaattctagatgatgcattggcaatccagtgccgcgctgatcagtcttttacctctcctnccccnagagattttttattagatattgcagggcaagaaatcaaacccctttgccattgatcaagccatattcaagtcctaagttgccacctgattaatactgcttaacagctccaaactataggctgaaatctttacagaanaagggcataacctcttgcggaangaantacaatcccgccggtaaatgttggttcaagtactaacagaacaaatacctccacactttggacaaccaaccccacaaacatgtctggtttaacttggggacttcctgttccccc

SEQ ID NO: 703990 - DNA, 732 bp, Homo sapiens
gtgactctagatgatccccaccagacattgggctcgacacggatgtcaccttcgcctctgacatttcggatctctgggccctctttgctcacttgggtgacgggcaagcgatcggtcttgcggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcccgccacctcactggctgaccaggacatcttcaacgctgtgatcaaggagcacccggagctagtgcagcgtctgccttgtgtctggaatgtgcagctgtcacatcacacactggcccagcgctgctactctgaggcgtctgacctcaaggtgatccactggaactcaccaaagaagcttggggtgaagaacaagcatgtggaattcttccgcaatttctacctgacccttcatggatccaaatggtaaccctgctgcggagagagctctttgtgtgccacagccagccccaacctggcgctgaccactggggaaagcgcatgcaccactggcccaggaaaaatccttgcttttatgtacggcccgacccacctcactcacaaacatcgaccaggagcgtatcgtgcacccatgaaccaccctcactataggacttaac

SEQ ID NO: 703991 - DNA, 805 bp, Homo sapiens
  misc_feature (491)..(491): n is a, c, g, or t
aggtaaacgccctttcagaagcaactgcgtttcattggataactcataaccctccagagtgtactgattacaagtccaggcgcgggtgcttgggaacaaaagtaacatctttagagtcgggcatttaagcaccatatcttgctaccaaacgatggcagatgcctccactgagcttcagcaagtcatcctgatctcgcggggaacattttcgatgctgtcggtgctggcaggagggggtgtcttcctggtgctgacctatagaggcctgattaaatactggtttcacactccaccaggcatgccattacagatagaagagtatttaaaagacccagctcaacccatcttataggccttggacaaggacagatcaccacaggatgacgtctgggactctgtgtacattatctcgttaccggaaaaggagctagaagatgttctccaaacgctttgaaccagagcatggggcctagcccactggctccctggangagatcaagccttcggagctgctagagttctggctggactatgcagagaccagtattccctgttgctgcctctaagaggcctgtccctgcagacatgagagacaggatgtctcatgggggtgacaagcttttttttttcttcttaaagaaccttgaaaatcaaattccacagtggagttacgggagatatcccaggaaaataaagggtgcctttaacactaaaaggggctatatttgcttggtggacaaaagggtatgacacagatccgaaacttttttcattattggggggggttggccatctaaagaccggt

SEQ ID NO: 703992 - DNA, 117 bp, Homo sapiens
gttaccatcgttcacagtgtgccagcatttatgttctctcctccgccatgcatctactaggtgcgcgtagaggatataaacaaaagcagcatctgttgcacagcattgtatcacctc

SEQ ID NO: 703993 - DNA, 81 bp, Homo sapiens
tgtgatcgacgcgtgtagatgaaagatgggttgcaacatgttggtcaggctggtctagaaaacctgagatcatgatcaacc

SEQ ID NO: 703994 - DNA, 449 bp, Homo sapiens
ccgaggcgagatgcaggccgacaccggcgatgaccgcgacgctgaaggccagcacgacggcggcaccgcggccggcgagcgcggcgaggatgccgacgccgacgatggccgcgagatggtcgacgccgatcaccggatggccgacgcccgacagcaggccctgcaggaacgtctcgggcatcttgccgcccatgacgtggtgggcccatgccggctgcgccgccacgatcatgatgaccgcaagcgcgccgagcctcctggatgaaaacaccatcgcttcctccgtcgtcgcgagcccgaaggcccgaatggatgccgtctccgacggagcaccttcatccagcccagcggccggacgaaaagcgttgcctcgaccctcgctgcgccccgcgcgacggttcggatgcggtgttcgacggcaagtttcctggctctcgggtcttcgcctt

SEQ ID NO: 703995 - DNA, 100 bp, Homo sapiens
acttctcgtactctccatcgagagaatggtggcaagaccacgtcgctggccagaaagttgtgcttgaacccaaaatgaatgctgaaagtctgcacgcgca

SEQ ID NO: 703996 - DNA, 202 bp, Homo sapiens
cagattcactcactgggagaaaaagagaggagacgttctgcatctcctacaatatattctctacgcaccactagaattaagcagggattcacagatacaatcactgggagaaaaagagaggagacattctgcatctcctacaatattatctctacgcagcactagaattaagcagggattcacagattcaatccccggtcga

SEQ ID NO: 703997 - DNA, 383 bp, Homo sapiens
  misc_feature (127)..(127): n is a, c, g, or t
  misc_feature (131)..(131): n is a, c, g, or t
gtttttcctcgtctctagcaggataccccggtccgcctactagacttctcatagtgctgggattacaggcgtgatccaccgcgcccagttaaacttcagtttttcatgttccatgcattggtcaggntctnagggagtgattcattctagcagaactccctggattttaaggcagatgttccatttattaattgacaaaggaggcatatttctcccctggtaacccaaagatttaggtcattttcccagagactccatttccactgtgagggttcttggaaaactaagcagaggatgaggaaaagtctgtgaacaagcttgctggtctcttcctgtcctacaaaagagcatacctcttctgtaaccagaaggccctcttgatt

SEQ ID NO: 703998 - DNA, 158 bp, Homo sapiens
gtgtttgcttaggtgcagacgtggaagcggacaaacatgtcagtggcccggagctgggtttgtcgcaaaacttatgtcaccccgcggagacctttcgagaaatctcgtctcgaccaagagctgaagtagatcggcgagtatgggctccgaacaaacgt

SEQ ID NO: 703999 - DNA, 272 bp, Homo sapiens
cagaacagctcttctaagaagggatataaagcaccgccgggtccttggagttaaagctgggggtcgtagggttctgggcgagcagtttggtggattaaccggtggaggttaagggctaagcataggggggtatcaaatcccagttggggtctaagctatggggtgtccagatatgtgaaagccactttcgtagtcaatttggggtcaccgggagtttttaacaactcaggggagtttaagcttaatggccaatcaacataggggggtaccga

SEQ ID NO: 704000 - DNA, 478 bp, Homo sapiens
  misc_feature (44)..(44): n is a, c, g, or t
gagtgggagggggaggtacctggaactgggagtgatgtcagctncccaagctcgggttgccctgtccctggattccttgacaatgggtggtagtgcaggcagggtggtggaaaggacggggaaggactcgtgtgctgcgagactggggtcgggccggaatgtcgctgggggcgcttggaaactccgagaggaaggttggaccagaactttttggaactagtgccggcggtctccaccccccagtataaaagaacgtgtggatcacttttgctgagtacatccacagagtattggagagactggcaataaatccagtttaaacctgctttttaaacaatatctggggtggaattgtggccctgacaaataataaaatggatgagtgatgcaagtgacatgttgggtgcagcgttggagcagatggatgggtatcatagcaggttctaaggctctggaatattccaatgggattttgatg

SEQ ID NO: 704001 - DNA, 432 bp, Homo sapiens
  misc_feature (156)..(156): n is a, c, g, or t
ggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctntaagctttggcacctgtgaagccctttaaacacccttaagccccaggctcccccctccccgattaaaaagacacaaaaatagacgtctctgaggtaaacggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaa

SEQ ID NO: 704002 - DNA, 151 bp, Homo sapiens
cgatcccggtgtcatcgatgccaccgtaggcaaaagcaacatccacatctcactcctcccggtgcttttggcggtattcctgcagcgctttctccgccacggtctccataaatttagggttcttccgggagaccggggcatcgataaacag

SEQ ID NO: 704003 - DNA, 371 bp, Homo sapiens
  misc_feature (93)..(93): n is a, c, g, or t
  misc_feature (173)..(173): n is a, c, g, or t
  misc_feature (192)..(192): n is a, c, g, or t
  misc_feature (194)..(194): n is a, c, g, or t
  misc_feature (228)..(228): n is a, c, g, or t
  misc_feature (249)..(249): n is a, c, g, or t
  misc_feature (348)..(348): n is a, c, g, or t
catttgccaagaaatggtcatgcttcagggcctttgcacttggcgttgcctccccctggaatgtggtctcccagctctgtccatggttgttgntttctcctccctggggtttaggaaaagacccttctcagagacggcactctcaaacaccagcccctctatcggcagcctgnctgaagtctttgaagcccngncactctcttgaaaggtctggcttaatcataaagngaatgaagggccctacttcanttggaatataccagaagcctggagagcaggaccttgctggctggtcatggttctctcttccagactgggacatgcaagggcccggtcttaaaataaaanatgctgggaggataactttgttg

SEQ ID NO: 704004 - DNA, 562 bp, Homo sapiens
taggatccccacgctgtggagtgaggctgcagcaggcacagcaggtgcgagcggacaggggacgtgagcaaggccagcgtagacaggcctgagctggaacactgagttacactctcccctgatagacaactgccaaggcattgaaattttccttttttgaaacagggtctcattctgtcacccaggctggtttgtaggggtgcaatcacagctcacggctgccttgacctcctgggctcgggtggaatttctaggagagaaattacatgccacatagaacacattggccttggccgcgagaacagatagaaggaagcgatgtccagcaggggagacactgaatcctacctgattctagccaaggtggcagatgaggaaaccaagggcacagagaggagagcttgtttgccccaacatcagtcatctagaaagtgaaggaatcacatgtgaacttgagttcatcacatggcagagccgagcttctgggcacctatgcaagccacttcccatctaggtccctgctaggttcaccagtctgttggcccacaagcgcctgggggta

SEQ ID NO: 704005 - DNA, 1202 bp, Homo sapiens
tcttggtttggttttcccggtttaaaaaaggaccccaaatttaagggtagggaaagggacaagagggaacattacccctttaggtggtagagaaagtgggaaggagaaggagaagcctcaaagaggagagggtgggaggggaagtgtcattagggcagcaaagttaatctcgtgttaaaaagagtgggggaggacccttcacatatagcctcagagattaagggcaagagatggccctctacgaggtggtccagaagggaaatgtggcagctttgtcttccttccagtggcagccacttccattgggcctcacctcgcgggatataccttcaactcctttagtggtagaatcaagagaggtgcgtgcagaagcctcgaaaagcgggcgagaaaaatctcgcgtgggtggtgggttttaacagagctcagcaattctccaagaccagcagtgtggtgcctccgcgaagacccgtcacaatcttacaggtataccaaccgaaggtggcaactggggggcgggggcccttcggggggggaaaagggacctccagcgggggacagggaaaatacactcgtcgagagggcccagacatccctcgtgggaggaaagccccaaccgagggtcaaaaagaatttggggcccaaacgtgggcacggcactacacagaaggttccccacagaaaagaaggaggcatttccagaaagaaaacaatcctcgtggcaaaaggaatacaggccaaaaaacttcccaatgtgggtcccaccagcggtgtgtgcgcaaatacatgtgggaccctggcgaaaagacaaccttccggagaagacccggggtacccagaaggtgtcaccaacccaacggtgggtcacagtagacaacggggggacgctgaaaaactcctggggcaagggcaaaagtccgccagctttagatggtggcccaccaaatgggacccaaaatttggccgggagccaaaacctcggcggaccaccagacatgcggcgtaaaaggaaatcataggccctttaaacaagagggggcacaaaaccacgtgcggcgcagacggggaaaccagcgggggagatacgtacgaactagccaaagacgggcacaagcgtacacaaggagtgtgaacacccaccgtagcgcgacgagcccaccacccaggacaaagagtgtatacgacccaacagaagaaaaacg

SEQ ID NO: 704006 - DNA, 187 bp, Homo sapiens
gtacctgggccggatgagcggctaacgccggatcgttacccactgagcagggcaggcaccgaacctgcaacctcatggttcctagtcggattcgttaaccactgcaccacgacgggaactccccctataaattcttatatcctgttttaacattttattttccacgtagagaagacacttcaacact

SEQ ID NO: 704007 - DNA, 260 bp, Homo sapiens
cgaacccttgcactttgagcaggtcgatgatctcgacggccgggttggccttgacggcgtaatacaccttggcgaattcgaaaccggcgcgcaggtcatcgtaggcctggctgatcatcgcggtgtcgatcaccacgaacggggtttcctgggtgtcagcgaacgccttcattttgtcaaaagtggcgcgcgcgaaatagtcttcgacctggatcgacatgctgggaactcctactggcaaactaaattgatcaatgggt

SEQ ID NO: 704008 - DNA, 822 bp, Homo sapiens
  misc_feature (1)..(1): n is a, c, g, or t
  misc_feature (75)..(80): n is a, c, g, or t
  misc_feature (86)..(86): n is a, c, g, or t
  misc_feature (99)..(99): n is a, c, g, or t
  misc_feature (130)..(130): n is a, c, g, or t
  misc_feature (156)..(156): n is a, c, g, or t
  misc_feature (167)..(167): n is a, c, g, or t
  misc_feature (175)..(175): n is a, c, g, or t
  misc_feature (238)..(238): n is a, c, g, or t
  misc_feature (304)..(304): n is a, c, g, or t
  misc_feature (337)..(337): n is a, c, g, or t
  misc_feature (415)..(415): n is a, c, g, or t
  misc_feature (438)..(440): n is a, c, g, or t
  misc_feature (454)..(454): n is a, c, g, or t
  misc_feature (456)..(456): n is a, c, g, or t
  misc_feature (468)..(469): n is a, c, g, or t
  misc_feature (502)..(502): n is a, c, g, or t
  misc_feature (505)..(505): n is a, c, g, or t
  misc_feature (515)..(515): n is a, c, g, or t
  misc_feature (528)..(528): n is a, c, g, or t
  misc_feature (638)..(638): n is a, c, g, or t
  misc_feature (688)..(688): n is a, c, g, or t
  misc_feature (719)..(719): n is a, c, g, or t
  misc_feature (757)..(757): n is a, c, g, or t
  misc_feature (804)..(804): n is a, c, g, or t
naaatcaccttgattaaaaggatgggaaaatccaccctcagcagaaaatgatacagtttatagaaaacctccccnnnnnngggggncccaattaaaaantacaaaaaaatctcccctccttccctacgangtcatggtagtctgactcctccagtngcactgcagcnctggagtngccagctcaccacagccccctccacttcaccttggggagaggagggatgctggtggttaaggnggttaaaaccattagttccagtgatgccagtgcccaaacatgcacttccttcctttcccccaaggnctgggaccaaggagaaagggaccgaaatgagcncagccatgaggagcaactcgaggagagaaaatatagcccaaggaggttagaagagttccaatatacctcctccctccnaccacctcaaaaaagaaaaaaannnagtataaaaaaaananaaaaaaaaaaanngttccccctcaggcctgagataaagaccaagangtncagtcttganggagttctgaganactcagagctcatctatccttgagcctccattaatttcatctccagggcaatggctaaactaggtcccttttcttggcaacctgcactgtccagaactggagatggaganatacagggcgaggacatcaggagggcaccccaggcccaggggtccccctnggttccctcagtcctcgggtgggatgcgcanggcagaatacaccatcacccgactgttctcctgccgtnggcacaagaggctgcgctgaatacttcggagggaccctccagctgtnatgaaggccgagagcccc

SEQ ID NO: 704009 - DNA, 856 bp, Homo sapiens
gcatggacgtttgcccgtgacggatgtgccatccagatgtgaagcaacgactggtgagaacgctacgtggactaggattcactacacaggcaactcggtgcattatggacaagcacctgtgaagcatgcctgcgtcgcacgagtgtctacgcatagatggtcggcatcgcgcactgtactctgtttgcgcgaagttgacacagactgagtgtactcaagagcacaggtatgggtagtgacagccttttatgctcctatgtagagggtaccaagaggatacgtgaccatctggttgaaaactgtgaccaatgatagctgtacgagttgagcgctcttacctggcggagcgaatgatgtgcttgtcaactgatccaggaactgtggtcttggcaccgcgatgatcgacgtggccacgcagtcgggcgacgaactagcagaacatgacccccagcaatggcatcccagatgagagtcagtggctcagggtgggtcatcctgtacaagtacagggacacagtagggaccgtaatacgtgttgtatggacctgcgcagtggtgcctttggctgcatgtggaggagcagaagaagcatggactcgcaaatggtaaaagcttggagatgaccttaattttgcagttgggatgctgcatgttgagatgtccggaacccatgtggtgggagactccaaaatcactgtgatgaagggggtggaagaggaaaatgcgtgagtctccagggccagagtctttatgggggcgagtcggatcagagagaatcataccgatcaaggaaaacagagataatagaagatatcagttgctgtttttatcaactaataaaaacatagagcgaacg

SEQ ID NO: 704010 - DNA, 622 bp, Homo sapiens
ccggctgggcacggtggctcatgcctgtaatcccagctgcttgggaggtggaggttgcagtgagcagagatcatgccactggactccagcctgggtgacagagcaagactcagtctcaaaaaaaaaaaaaaaagtatttggccatttttatgagttgtaaacccaaggggcctgtcaaatttcatagggtgttaaaattttttcttttcttttttataaaggaccagggttatttactcttattcggcccaagccttgggtctactaacttccttgatgctttaaggccattcccaattcccaaaggtggctagggatttacagggcgtgaaccaccacggccttgggccttaaaaaattattttctgggcaacaccaggtctggggcttgggtgggcacaatggcctggtggcgttctaggctaccctggaagaaagacctaagcggcacacagaagatattgcgtttgagaggcctgggagagggtcaaggggccgagaactgtggactctgtggggattggcgcccattgggcactcttcaacctgggggcagacaagtatgtggaagacccctggttctccaaaacacatacatatctggtcatggtaaacgctggtc

SEQ ID NO: 704011 - DNA, 167 bp, Homo sapiens
aatccaggaggtcaggaggctgtgatcttaagctgtgatcctgcgactccagccgcaagctaccagtggcggactgactggtcagagcctccctatgactcacaggttgcagctgtccaaaaccaacaggaccctcgtttatactttggctgtcacaagagtatatt

SEQ ID NO: 704012 - DNA, 171 bp, Homo sapiens
aggagccaacgagcagacactggatagctgagaaataggctttgcggagcctgctgggagtcctcccagatctcgtagtcgaaattcttggggtgaacaaatgccggttgagctggggtctagtcctggagtcattacaacaacgcctctatgaacaggcattcgatagag

SEQ ID NO: 704013 - DNA, 979 bp, Homo sapiens
  misc_feature (29)..(29): n is a, c, g, or t
  misc_feature (119)..(119): n is a, c, g, or t
  misc_feature (132)..(132): n is a, c, g, or t
  misc_feature (150)..(150): n is a, c, g, or t
  misc_feature (225)..(226): n is a, c, g, or t
  misc_feature (228)..(230): n is a, c, g, or t
  misc_feature (232)..(232): n is a, c, g, or t
  misc_feature (264)..(264): n is a, c, g, or t
  misc_feature (268)..(268): n is a, c, g, or t
  misc_feature (275)..(275): n is a, c, g, or t
  misc_feature (293)..(293): n is a, c, g, or t
  misc_feature (304)..(304): n is a, c, g, or t
  misc_feature (306)..(306): n is a, c, g, or t
  misc_feature (315)..(315): n is a, c, g, or t
  misc_feature (323)..(323): n is a, c, g, or t
  misc_feature (326)..(326): n is a, c, g, or t
  misc_feature (331)..(331): n is a, c, g, or t
  misc_feature (376)..(376): n is a, c, g, or t
  misc_feature (381)..(381): n is a, c, g, or t
  misc_feature (388)..(388): n is a, c, g, or t
  misc_feature (391)..(391): n is a, c, g, or t
  misc_feature (396)..(397): n is a, c, g, or t
  misc_feature (419)..(419): n is a, c, g, or t
  misc_feature (427)..(427): n is a, c, g, or t
  misc_feature (431)..(431): n is a, c, g, or t
  misc_feature (454)..(454): n is a, c, g, or t
  misc_feature (461)..(461): n is a, c, g, or t
  misc_feature (500)..(500): n is a, c, g, or t
  misc_feature (506)..(506): n is a, c, g, or t
  misc_feature (521)..(521): n is a, c, g, or t
  misc_feature (534)..(534): n is a, c, g, or t
  misc_feature (536)..(536): n is a, c, g, or t
  misc_feature (539)..(539): n is a, c, g, or t
  misc_feature (542)..(542): n is a, c, g, or t
  misc_feature (544)..(544): n is a, c, g, or t
  misc_feature (559)..(559): n is a, c, g, or t
  misc_feature (890)..(890): n is a, c, g, or t
  misc_feature (955)..(955): n is a, c, g, or t
ttgaaatggggaaaaaaaagtagtaaatngaaaaaatggagtgagttagaaataagaaatattaatatagtgagaaatatggatgaatgttaaatgtattaatgataggaaaagaagtnggtatcaaaatgntaaataaaatataatttnatgtatataaaagtattaaaaagaagaaaatatatgggcggaaagggtggttgaggcatataatcagaggagttnngnnngngggggagaagaaagaaagtggggaaagggttntttnaatatgnagatggttgagggagaangaaactatttnantggtattcncccgtacnacnggaantggtgcttggaggggaagggaagtgagatcagtcgattagtcacnaacancatcatnagnattgnnagagaggtggagaggagagatnatggaatnaganaggttggtggggattttatctgnacgtttntggatcttcttcttatttttgaggggagatggcagagcntgggcntgttggagggggtgngtatgcatgatcntntgnagnantgaggggcggtgcantgagcagagatggaggatagtgttggtcttagggcggtggtccacattgcgtttagcccaccccatctgatgacggttcggattggtgcaatacccagtgagatctccaatcttatacacggtggttttattttcaatggcatctgctattttcgtcatcggagaatggagcaacttgatctccatttcaagtgggtccgtgtcacccaacagctcatcagattctccggtggccaagcattccatggtgtcttcattggcctgctcagtatcctcgatgtcaaagacctcggtcatttccttaacgatctcagcactgagatgggtgggnagagtgtgagtggctggtggtggtatatagaagctgatcttcccgctcacccagttagctagganagctttggcggctgttcctgacta

SEQ ID NO: 704014 - DNA, 248 bp, Homo sapiens
caagctttagcagcacggtatgtgaaatatttcatagccagtattcaatcatctaatatagatagataataagagaggatacagggtggcagtattagagtgctaagagcgattacattcaaaaagtgatcttgattttatattgtgaggtggagtctcgctctgtcgcccaggctggagtgcagtggcatgatctcagctcactgcaacctccactcctgggttcaagcaattctccctgcctcagc

SEQ ID NO: 704015 - DNA, 357 bp, Homo sapiens
attcgcggccgcgtcgacacggcgttgtcgggctttgtggctgtggccgcggtggcgttcttcgccatgtggtcggtgttgtcgaacctgctgtgcgccattctgatcttcaccgtcgggccgttccgcttgggcgacgtggtcgagttggtggacaccgtcgacaagcccggcgtcaaaggccgggtggtggcgatcaatctgctctacaccacgctgatcgaagtggaagaggccggtaccggcagtgtcatggtgcaagtgcccaacagcctgttcttccagcgctcggtgcgccgttggcgcggcagcgacatactgccttaacctttggcgagaggtcgacgcggccgcgaa

SEQ ID NO: 704016 - DNA, 1116 bp, Homo sapiens
  misc_feature (4)..(4): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtgtagtccttcaataggaaattgtaattaaaatataattttatagaaccatttttatgtaatctgatttgaatgttatagttgataataataaaatcacttacttggttgactaaaaaaa

SEQ ID NO: 704017 - DNA, 150 bp, Homo sapiens
ctggactacagacggccaccatctctacatcctcactctcactgatgaacagtttctggtgcaggatcagttcccagtgatgcccgtgagcacgctgtgtgcagaggccaggaaacggcgcggcggctgctgacccactacgtgaaggtg

SEQ ID NO: 704018 - DNA, 1079 bp, Homo sapiens
  misc_feature (4)..(4): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtgtagtccttcaataggaaattgtaattaaaatataattttatagaaccatttttatgtaatctgatttgaatgttatagttgataataataaaatcacttacttggttgactaaaaaaa

SEQ ID NO: 704019 - DNA, 470 bp, Homo sapiens
gattgtaaccatgattcgatgcggtaaccctacagactctggtctcatggagcgctgatcggcggatctcgatggccgcgcggaaacctctaaagtcgagtcgaaggtattgatcacctggtattggccgctgcaacaagagttcgcgactgctcctctccggtagtccggcccctgacccctttccccagtacccacttcctgcctctctcattaacccttccgtagctgctcaccatgaccccatcagaatccagttaaaagactcttccaaatttctcagcgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctc

SEQ ID NO: 704020 - DNA, 1275 bp, Homo sapiens
  misc_feature (4)..(4): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtgtagtccttcaataggaaattgtaattaaaatataattttatagaaccatttttatgtaatctgatttgaatgttatagttgataataataaaatcacttacttggttgactaaaaaaagaacttgactctcattctgttgaatcagaaaataaaaattggagatagttttctttttatttgttgctacaaatatattcctgtttcgttctactccaagaattttctttttgtgcgaacacccttgcgttcaaaatgtgctatcggcttaaatacctg

SEQ ID NO: 704021 - DNA, 150 bp, Homo sapiens
acacagttaaaggcaagagcagaggcagcgggtgccaggccgcactgggtgcaagagaggtagcaagcctcacttgcccaaccttctccagcctccctctccagccgcagtacatacaaggctgatgtaggcagcgccagcttctcctcg

SEQ ID NO: 704022 - DNA, 725 bp, Homo sapiens
ctcaccctttcactctatatacctttaccttgctttaaaaaaaatagtgttcatgtatcacctgaaatgttatgtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtgtagtccttcaataggaaattgtaattaaaatataattttatagaaccatttttatgtaatctgatttgaatgttatagttgataataataaaatcacttacttggttgactaaaaaaa

SEQ ID NO: 704023 - DNA, 155 bp, Homo sapiens
aagtctctcttcaccctgccgtcatgtctaagtcagagtctcctaaagagcccgaacagctgagggaggcttttcattggagggttgagctttgaaacaacctaatgagagcctcaggagccatttttgagcaaatggggacggctcacgggcct

SEQ ID NO: 704024 - DNA, 993 bp, Homo sapiens
  misc_feature (4)..(4): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgggagtaaacaaccggtacagttcaggacgtggttgatggaccgaaacacatgtggggaaagggcacgaaagggataggcctttcactagcacatatgaatagaat

SEQ ID NO: 704025 - DNA, 489 bp, Homo sapiens
aacacttatgaagtattagtaatttattgctaagaaagatattttaagaaaattaagtctaaatttttttttaatgtagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtgtagtccttcaataggaaattgtaattaaaatataattttatagaaccatttttatgtaatctgatttgaatgttatagttgataataataaaatcacttacttggttgactaaaaaaa

SEQ ID NO: 704026 - DNA, 410 bp, Homo sapiens
agtgtttgtagctatttcttggtgaacagttatttttattttaaattggaaaaataatcctcatcagtcaggagaaaacaaaataatgattcatgaagaaatatgttgattttttctttcagacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtgtagtccttcaataggaaattgtaattaaaatataattttatagaaccatttttatgtaatctgatttgaatgttatagttgataataataaaatcacttacttggttgactaaaaaaa

SEQ ID NO: 704027 - DNA, 338 bp, Homo sapiens
gtctttccttctttattgagcaagtttcatctcctctagggaactgccacccatgctttgcttgtgttactgtacttcacaactggactgttgtgattatttgtctcttagtagtacactgctatttctgtttcttaatttcctgaatttgtgtctccctcttcggcagggattcttctcaatatcttatgttgtttatatggattaagttttttcaacatgtttgagtattcttaatcagtatagttaagattatttgagtcatcttattttaatctcatatggtgtgtatatttattattaccctgcactaactcagtctgagttaaatgttcgca

SEQ ID NO: 704028 - DNA, 340 bp, Homo sapiens
ttcactcgcactgagtaccgagttgtttaatgagggaggagaggcaccctagacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtgtagtccttcaataggaaattgtaattaaaatataattttatagaaccatttttatgtaatctgatttgaatgttatagttgataataataaaatcacttacttggttgactaaaaaaa

SEQ ID NO: 704029 - DNA, 682 bp, Homo sapiens
  misc_feature (21)..(21): n is a, c, g, or t
  misc_feature (23)..(25): n is a, c, g, or t
  misc_feature (27)..(27): n is a, c, g, or t
  misc_feature (29)..(30): n is a, c, g, or t
  misc_feature (32)..(32): n is a, c, g, or t
  misc_feature (36)..(36): n is a, c, g, or t
  misc_feature (39)..(39): n is a, c, g, or t
  misc_feature (654)..(654): n is a, c, g, or t
  misc_feature (656)..(656): n is a, c, g, or t
  misc_feature (658)..(658): n is a, c, g, or t
  misc_feature (660)..(660): n is a, c, g, or t
  misc_feature (664)..(664): n is a, c, g, or t
ggatcccccggactgcaggantnnngnannangtcnagnttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaggtcangnangngtantcccttcataggaaattc

SEQ ID NO: 704030 - DNA, 322 bp, Homo sapiens
cgtccccatggtaactaacaggagacctccaggtagactaaccaggatataggcttactaaagtgtgataacgtaggcttggattacggcgacagcgatttctagtgatagtcagtagaattataattgtgaagatgatgagtgtggagggaagggtaatggtggatattgctagggtggcgcttccatatgaggtgcgtgagtaggtggcctgcagtgctgtttagcggtgtagcgcgtgcgggcaggactatgggttgagtgagtaggctgacgggttcgatcctcactagtatggtctacctgggttaagtctacctgg

SEQ ID NO: 704031 - DNA, 104 bp, Homo sapiens
tcgaatcgagctccgtccgttacggagcatcagtaacggagtcagtaagtgagcggtcacgcctgctgggggtatgttgtgttgggtttgaatctaatcttgct

SEQ ID NO: 704032 - DNA, 982 bp, Homo sapiens
  misc_feature (4)..(4): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtactaaacaactgttacagtgcagaaccgtgtttatgagactgatcactgggcggaaggtcatgtagggatagtccttcaataggaattggacataaagatact

SEQ ID NO: 704033 - DNA, 238 bp, Homo sapiens
gatctagaggatccctacggcaggtgtactaaacattcagagaacagatacaacacaaattctttcagtaaattaaaaaagggactcatcttcagttccttttttttttttgtaggacggtctcgctctgtcgcccaggcggcagtgcaggggcgcgacctcgactcactacaacctcggcctcccaggttcaagcaattctggtgcctcagcctcccaagtagcggggataaccaga

SEQ ID NO: 704034 - DNA, 603 bp, Homo sapiens
agcgggcgggtcccgcggcggcgcccgcggtggcagccgtgaatgacgacgaagttatgaggaatcgtctcatcgttgaagaagatggtgcagaagatgatcggataattatgtctgactaatgcaagtagctttcataagagtggctgacatactgtctgggtacccagagaagaaggaatatataggccagtagccgagaagtgtatggatgaggcagcgctggactctcgatgtgctgtaattatgtcaaagtgggcaaaaacatttactagtatagtactgatgtatgaattcgtcagaagatgcatctggaaataattactgaagaataaatattatagggaaggaaacaaatacgtaagtgtagtacgaatagacaaggagacatgatgcacagaatagattgtgagtgtaggtggcaagtaagaatgaattttctgtgcaaggcatagaacgtaagtacgaaacaaccagatcgaaccaaagtaaagtaatggatgacgtgtgggaggagatgatgactgtcaagctagacaatcgcaggacaggggcagttaaggactatttgagagagagcatagaaggttgtcggaggaagaa

SEQ ID NO: 704035 - DNA, 386 bp, Homo sapiens
  misc_feature (6)..(6): n is a, c, g, or t
  misc_feature (22)..(22): n is a, c, g, or t
aaaagntaaaaataagcaatcncaacaaatggcctattacaaagaaaaaaaatgagacttccggaagataactctatccaactataccttatgaaattataagtcacaggccgggcacggtggctcatgtctgtaatcccagcactttgggaggctgaggtgggcggaatcacgtcaggattttgagaccagcctggccaacatggcaaaaccccatctctactaaaaatataaaaattagccatgtgtggtggcgggcacttgtaatctcagctacttgggaggctgacacaggagaattgcttgaacctgggaggtggaggttgcagtgagctgagatcgcaccactgcactctagcctgggcaacagagcaagactcggtccc

SEQ ID NO: 704036 - DNA, 320 bp, Homo sapiens
tggctaaactgtattatgatatagccttttaaatactacactgaagacagccctgggcttgactctttggagctacactagattaataagaaaggatagaattgtaaaataaaaatactacgtgatgagtaatgtcgtagtatattttagggatccaggcagaagggaagaagggtgcgatttgaccttgagtttaagtctgggagaatggagtcttaaaatattttacagaggaggtgatttttaaattgagtccagtaagattagtaagtgggagtggaaactataaggaaatagtgaaaagagttattccaggcaaa

SEQ ID NO: 704037 - DNA, 555 bp, Homo sapiens
  misc_feature (30)..(30): n is a, c, g, or t
  misc_feature (35)..(36): n is a, c, g, or t
  misc_feature (150)..(150): n is a, c, g, or t
cacaaaaaaaagggggggtttttcgcgcgngggannaaaaaaaagggggggggcaaaattttttttttctggggggttttttttaaataagaggggggggtattttttttttttttggaagaaaaaaaaaaaaagggcccccccccccantttttttttttttttcccacacacccttttttgtggggggggggggggggggcccacccttttttttcgccccccccccccttttttttccgggggaggggggggctaccaaaaaaaaaaaacgccgggggggggaaattttttttttctgaaaagggggtttaaaaaaaatttttttgcccccccccctccccccaaaaagttttttcccaaaaaaaaggggggtttaaaaaaaccggtttttatttttctccccccccccgaggggtttttttttacccgggtaaaaaacccccccccccccccccgaaaatgggccccaaaacctcctttgagaggagtctccctggggggggaattccaaaaaaaaaatttctcattcccccctttaaaaaccttaaaggg

SEQ ID NO: 704038 - DNA, 700 bp, Homo sapiens
ggctgcaggttcaaatgtagaccacatttagatgtcatcttaccctagtcaaaataactattatttatttatttatttatttatcattttatttcaatagcttctggagtacaagtggcttttgttacatggatgaattatatcttggtgaatttggagattttagtccacctgtcacccaagtggtatatgtcatacctaatgtgtagtttttttgtccctcagctcctcacactctccctgtttcttagtctccagtgtctattttgccactctgtatgctttcgcatactcatagcttagctcccacttataagtgagaacatacagtttttggttttccactcctgtgttactacttcacttagaataatggactccagctccatccaaattgctgcaaaaaagacattatgtcattccttttcatggctgagtggtattccatggtgtagatataccacattgtctttatctactcattagttgcttggcgtttacgttgcacgtgtgaattgttgctgtataaacatgtgtgcaggtgtcattttcatataatgacttattttcccttcggtaagacccccatagtgggattgctggatcaaatggaagatctacttttaactctttgaatctgggaatctccatactgtttccattcagggttagtccaattttccttttcaacagcagggtg

SEQ ID NO: 704039 - DNA, 1426 bp, Homo sapiens
  misc_feature (588)..(588): n is a, c, g, or t
  misc_feature (1426)..(1426): n is a, c, g, or t
tcaggggaaaataatttttattgaaaccccaccaactggcaaaattcgtgttccgtggcatttaagcctccttctttccttttgcaattcggctcttctcttcaggtggctcccattgaattgcttttcttctccctccagtggctcgtggaagcggccatgtggccaaactgtgggagggtgggtgctaaagtgaaactttagaggctcaactctttctctccagaacgccccggccgcttctggctcttgccaccaagcagaggcactttgcggggagggggtggagccacccgcttctcttgtggtcccccaccaacacacaggcctttctcagcatgtgaccaaaggtctcatgtgtgggctcaccttctcacccatatatgtgtggaacaacaggcacacccacaagaggggtgtgatgatgtgctctcttgtgtgtccaagatataggggctcatataggtctcaggtgtgagaagggacatttggctctctgtgtagatctcacgctgtgtggcccggctcctctgtgtatctacacggggataacgcccctgtggtgccacaatctctttatatattaanatctctctctctgtgggagtaggaactccctccagggtgccggggtgcatttgtggataccgccttttttctgtcgcgcccagggtcgggcatgttcgccacaacaagaaggaaggggctataaccaacgaagaacgccaaggagtattgtgccattgttgccccccaaaatataacaagggggcccaactcttttttgtgcgccaaggggcccctcatacgggtggggctcacttgtgcggggggcgacacgcctctcttgtggggtgttcgcccaaaacagaatttgtggggtttgtcaccccccttttgtggactaaagtattcgtctgaggaattacgacgagagatcgagacccgccctcctaagagaagattatcccccttcgagagggggggcccccaaaggctatttaacggctgttacccccaaggtctttttcttgtgtaccacacggggtgggtccccctaaataaggaggagagtccggatattattaaaggcttaagggccacgtggtgcccgccgttttaaacaccgcttccttgaccgcgcgggaaacaactgttgctaagtctggggggaaaccctttgggggacgagaaacccttactttcggtggcggtgtgaccattatgttgtggccaccaaccttccttaaagagagaaatttaaaagggccctacggcgacaaactatttacactttctacgggtctctcatcggcgttctaaccccgcgctggcaattactttgccctggctgaggacgaacttgcgctccacgggtatataattttgaaacattcgccccccagtatatattgtagatatcacn

SEQ ID NO: 704040 - DNA, 127 bp, Homo sapiens
ctactgtgctcagaacggcttctactgcctggtgtacggcttcctgcccaacggctccctggaggaccgtctccactgcgagacccaggcctgcccacctctctcctggcctcagcaggtagccaca

SEQ ID NO: 704041 - DNA, 246 bp, Homo sapiens
  misc_feature (35)..(35): n is a, c, g, or t
gtttcattttctacacaataccccagaatcccaangaatattcttcatcttcctctcgttggattctgatgggaacatctgatctaaaaatgttaatcacagatacattcatgagagcattccttattataaattttaaaaacatatacaaatctattttcattcatgaatctgtggactttcttctggagcctgtatattctattgaataacaaccaccacttctatagtcgtgtagaaattgaa

SEQ ID NO: 704042 - DNA, 296 bp, Homo sapiens
gtggagctgaagaagaacgagtccagggaagagctggagaagcagcgggagccagttgacaaatccccgtcccagccacaacttccagctggaagagcgtcaacaagcttgtaccaagacgaaaaggcgggtttgggtgaataaccatccaccacaggtaagaggctcatccgagtgcttgcaagaccagttaaagaccctgcagaggaattacggcaggctgcagcaggatgtcctccagtttcagaagaaccagaccaacctggagaggaagttctcctacgacctgagccagt

SEQ ID NO: 704043 - DNA, 114 bp, Homo sapiens
attagtgatttttggattctgtaaacaaattactgtatcatgaccaatacttgctcaagatcaacatcgatcatggattgtgtcactgaggcatgtcatgagtacagctgtaag

SEQ ID NO: 704044 - DNA, 90 bp, Homo sapiens
gtggacacagccacatattactgtgcacacagaaccgtttcctacggtccctataaagcagactggtacttcgatatctggggccgtggc

SEQ ID NO: 704045 - DNA, 636 bp, Homo sapiens
  misc_feature (441)..(441): n is a, c, g, or t
  misc_feature (536)..(536): n is a, c, g, or t
gccagtaggagagagagcagataaagcacgcagagctccagctacgtactgcctgaagatgggcgacctgattaggacagctctgcactgcttcaatgggatcatccttaactgcatttaccaacggcctctgcacagacgactgacaactatgtgcacggatggaaacgaggtccaagaggtccgctagggccagaggtacttgataagatgatcagctacaggatgatggatatgacccgatgcagactccaccttggtgctagcatacatatgaaatgaggactctgggtgcacgggacatgcgactactcctctgcatgaaggcgcacacatctgagaactgaaggccgccctgacatgaccactgatctctaatggcgctaatgcccacttggtatcatgcgtgatgagacatgccagggttaccaggactctctnctgtacaatggttcatcacatgctccgggatagagtgtggcgtgaatcaagcccattgcttcctgtctgtagctgggcttggtattgactcctangaatcaagagagcatgtgagatgttcgatgacttgagctgggacttacatcttagcacctcataagggagccattcgcagctggaatgtacgcatgtggc

SEQ ID NO: 704046 - DNA, 494 bp, Homo sapiens
cgacgagtcctttaaaattaacgcgtttttcccactgggctagtgagccttatctctccacttcccaggcatgtgaagaccctgtttctctagctgtgcagctgcaaggtcactagacagataatctcaagtcgtaaagcatgttgttccttaaaaagtaagaaatgatgtaatgcatgtcttaactgaataactgtctttgtttcttgcttctgtaatacgcttccccctgcacagatctacccccaccccacgaaatgcttaaaaggtagcttgactttttgttcaaggctcagtcctttggatgttaatctgactgggttgatgcacctaaacaattaaataattccacctcaacccctccggtctctctgattccttaattatcccgctgcagtgtctctactaaaaatgcaaaaaattagccaggcatggtggcacgtgctgtagtcccagccacttgggaggctgaggcaggggaatagtttgaaccc

SEQ ID NO: 704047 - DNA, 629 bp, Homo sapiens
atcaccattaagtgaacagcgcaaatgactttccccggacacacgtcctttatatagcagccaggtgcaactggtggggatttcgcaaggctagccgagccgtgaacgtcgtactgctatcgacagatccaaaaggcgttcaaagaggtgagcccagtcttggtaataacgatggaattccatctacagagccgcggcttctgtgattaccgaggctgggctctttagtttttcaaaagacccagctttttttgcttttttccacccctcccctttttgtatttgcgcgagatcatcccctccccccttgaagtcagcacagacagatggttgcaaaaattaaaacctcaggcatgatcgcaatgagcgtttgccaacgcttgcacgcccaccagggcgaaggctggatcaggccatggctgaaaatcctctttttgaagcattgtcttacggtgatgcgccttgagggcgtggtgctaaatccgtgtaggagatgctttgtctaacgtaaatcgcttcccatccggcgcaactcttgaccaggtcaagaaagacgccaagaagctcgccaggactcagaatattccgctcaaccaagcacaggatgcagctgcgctgaagcatggtct

SEQ ID NO: 704048 - DNA, 920 bp, Homo sapiens
gaccttagccttgtgattgcacgttccagctccgataacgctcctcaatactaggcctactaaccaacataactgaaccatatatcgcaatgatggcgcagatgtagacacgagaaagcatcgtaccaaggccaccacacaccatctgtcgcaagaaagagccgttcgatacgggataatcctattctatgacctcgagaagtcttgatgtgcttcgcacggatttgttctggagccgttccaaacgcacgtcccagcctacgaacgccgtaacccccgaattacggagtggcgactgggccgcagcccttcaacgtgccttcaccccgcatatatccccactagtaagtaccttttcctgtcacaaccctccgtattacgtcatcatcaggcttatcaatcagtctggacgctgcgaccccttagttcgtcatattcgataagagcaatgcgaagactccatatgacattctggcagtggtggactaacaatttaacgtggggtcgctttgtttttgcctgtcctactagctcgcagcagtatggactgagggcatccccttcgtcctagtctcccgagcgggcatctagcggattcactcatttttgggtgtgccttcgtgtgggcctcggcctggtcactgtggttcatcgtgctctccttgcctcactattgtgctaccttcctggcacactgatatgtcagcttcaactgtcgcatatggtcattttggccctcgacaccggacgcctggatactggctattggagagtgtggtcggctgcattcgggggtctcgcccgaagggcggggcccccttataaaggccgtcgagaacagccgttggttgccgcgccccaatttttgggcccctgggccccgcggcccctgtggagtgggcccggggcctggacctcgc

SEQ ID NO: 704049 - DNA, 163 bp, Homo sapiens
aggaaaaaggggaaatgagaagctgctggggcagctgtcgaaggacatcccagggcccaaaaatgcaatccccttgagagaaaggaaacaggattgtaaagggattatcttttcacttaataggagtcaggactgtctgtcttaattctgtgtccaggtatca

SEQ ID NO: 704050 - DNA, 235 bp, Homo sapiens
ccagggaaccccagactcccgcaaaagatgggatgctgcggtcagcaggatggcaccataccatcgagcaggtctacaacagaagagtaaacatacttaaaaatcaaacaaacaacacgcgcatacactacctttaatccaaagtcacagaagaatttcactacacatggttcacagataacacattctgacaaaagtaatgctcagccaaatgagatacaattctgataaacac

SEQ ID NO: 704051 - DNA, 805 bp, Homo sapiens
agcgggagggctgggactcatccctagccctggcaacctccatgggaatgctgtggccacacctggggcgttggctacagacattcctagggagctactcttctgggtagcaaggcagggctaggttccctggagtctctgctgcaacagtgcagctctctgaggcactcctctgtccagctctgctgccctgagtcttctaggccctggggcactgcctgcgctgccacaggccacagtcctgatgaaaactactgttcagcttgggcttgtagccctctccaagggactcagatgaattccaaggacctgctgtgagggctcacagttgaagcatacgacatggtattttcctgttgccccctgtctgcatgtcttcctgggtgcacaacttcctcttggagcaaggctcacttcctcatgtaaattacctcctgcagagagacacaggccagacattgccaccactaactcatcagacacaccctgaatcgtcagaatcctatccacaggcccagcccgggacttccagttctcagttaacaaccatcaacgttaactgaggggagagtgtttcagagacccctctctgaaatgcagcgtgaagttgaactctggactgtttctaagagctgtttactttccatatcccaaagctagaggggctagggaccagagagttcttagtccatctggggctgctatatccaattgtccatagactggttgacttataaacaacagaaaatttatttctccacaggtctagacactgggaagtccagatcaggaacaccctgtacca

SEQ ID NO: 704052 - DNA, 204 bp, Homo sapiens
gagctcggcccggctgacgtctgaatccctttcttccggcaatcttttcgtcacctcgcatctcctcccccgtctgttaaccgtatcaccaccaccggtgtgctctgtccggtcaacgggatcgccgtatgcgcatccaatacaacccggtatccccttacctgtgtttcatcaaacaataatgtaaagggtttcatttccagc

SEQ ID NO: 704053 - DNA, 411 bp, Homo sapiens
ggcaaacacgttttaccagttgaatccgtgtctacagcgccacctatacagtgagaatatgcggtgtacggttttttgttctcgcgatagtttactgagaatgatgatttccaatttcttccatgtccctacaaaggacatgaactcatcattttttatggctgcatagtattccatggtgtatatgtgccacattttcttaacccagtctatcattgttggactcgatccacttattacctacatatggcttgctagcagtgctagtatattttgcacagcagtaatcaatgaaatgagcaggtgaggctggacctggggcaacaaagcgtttttaaaagtttttgttttgttttgtttgagacggagtcttgctctctggcccaggctggagtgcagtggtgcgacctc

SEQ ID NO: 704054 - DNA, 454 bp, Homo sapiens
  misc_feature (204)..(204): n is a, c, g, or t
  misc_feature (445)..(445): n is a, c, g, or t
  misc_feature (447)..(447): n is a, c, g, or t
cacatttgcttctgttactagtcatgatagctgaatggtgtgcttcattcagatactgtgtagtgatcacttactttgaattgcatattaagacatgtgaccatataaccttttatttgaaccaagcaatttacatggtggagctgaagattggttgttactggttcatttttagtgagcactgactgtttctaagactctatnttggtcagactctctcttgaggtctcccagggtaagtcagccagactgagagtgacccaagaagatggggcaacattctgaagaaaatagaaaatagtgctgtcatgtggtgaagaggccagggagcatttgtttccccatgcccctacccaccccgttatttattgattctgctcataacgtaacagtatatgtatttttgttgttgttgttgttgtgggtgacagagtgagaccctatntnagaagag

SEQ ID NO: 704055 - DNA, 346 bp, Homo sapiens
  misc_feature (204)..(204): n is a, c, g, or t
  misc_feature (236)..(236): n is a, c, g, or t
  misc_feature (284)..(284): n is a, c, g, or t
  misc_feature (295)..(295): n is a, c, g, or t
  misc_feature (324)..(324): n is a, c, g, or t
aactggctggagtagaactcactgaaagtggtaaggtgtggctacaggcagagctgaagccttcccagctgctctggttccagctcctcggaaaggaggactcagcactcttttgctacctacctagtgaacaagggcggatattttaacgtgaatcctgaaatgaaggaagatttttgaagaaagaaggcctttggggcaaanacccgtccctttggttaaaaaggggctaaaanttaatggacctccaaaaaacccccacctgggaaaaaatttcaccaggnaaactttaacntttaaaaaaggcttggaaattttggaacnggggcccttttaaaaagggaaa

SEQ ID NO: 704056 - DNA, 108 bp, Homo sapiens
cccgcaaatttccttccactcgttcccatcttgcaaggagccggaggcatgtggccgtggtctccgtcctgtctgaagcacctgcgccgtcgtgctttgaacttgacc

SEQ ID NO: 704057 - DNA, 912 bp, Homo sapiens
  misc_feature (395)..(395): n is a, c, g, or t
ctcgcaaatacggtctgatgaaggtcgtttaaagggttggtacaaggtcccgggggatataatacctgtcgagccccttttttagtggggggacctccgcccccgtttgggaaatagggcccaagccgtgtcgttgtgaaaccttagacgtttatatgcgatgtcacccatgccccgaatgttccggtccacaaaagggccggccccctccctttttgcgtttgcgcccccttccccccactattaccacggcgggtacccaacacccggtggcccccaccgagaaagagtcagacaatctggtgccactcatcacccgcactgctgcaacgccgctggttcgcccccccaaaccaaaagacggtgcggttgcacccccccatagccaggggccnctcatctctaaacgcgacgggcctctatatcccctcctggcgcaccccttcttggccgcgcatatctgcccaacggcaacactatgtttgggagccccctgtaacaccaccagcattgaggaaagactagcgcccacaaatcggttgggagtagtcaacagcccactcccccactagggggccgacggggctatgtataacacaccaagatttctgttcacaaaacaattcattccttattcaaattcgaacgaaccaccctcatgtctcattcttccggaatcacaccatgtgtcgcgttcctcaaattcgttcaaacttcagtgagcacccaatctccaagtcggctacaccatttcttctatccaagcctccacgcacccacctgtttttccaccgtagtgacttgttcctgcttataactcgatgacagactgacccaacacaggagtctcaaccaccccattcaatcttcctctcctcacaaaagggccaaccccacccagcccacatgtca

SEQ ID NO: 704058 - DNA, 586 bp, Homo sapiens
ccctgaacaaataataaataaaaaaataaaaaaataatagaacaatgcagcactcaccagctagatcgacacagtacagcacgaaaatgcaaaaagcaataacatgaagagaagagaaaagtaaaaagtacatagcatgagagtaaggaaccactagtattatgagccaacggtagagactagatttataaaccgagcagtaggacgaatagcagctaggagagggaacaagacacagcacgaggagaacaagataacatacaatgcaggaatagtacagcaagaagagcacagaaagagaaaaagaagtgcagcgaaaaaaccagagagagtacgacaaaaacacaagaaaacagataagaaaagagaatccaagatgtgtcattataaatattgtttgtatgtgatttagtgtattcatacatgattcgatatatgttgtgacgttctttttgagtctgattgtctgaatcgtgtttgtatgtgatgatgctgatttacatacacctctaatgttcttatgatgattagagatctatgaagaagtaatgtgatgtttttgtgtactttcgatcaatgatagtga

SEQ ID NO: 704059 - DNA, 162 bp, Homo sapiens
aggttgtacctgagctgcatatggtggtgggtggtataatccagctgttgggaagctgaaggcaggagaattgttgaaccgggtggggcggaggttgcaggttacagtgagccgagattgcacacttcactccagcctgagtgaaagagtgaaactctgtat

SEQ ID NO: 704060 - DNA, 1155 bp, Homo sapiens
  misc_feature (576)..(576): n is a, c, g, or t
  misc_feature (620)..(620): n is a, c, g, or t
gctcctggggtttcctcctcctgcggtgggctatacccgtttggggttctcacccgtggttctcttttcatccgaggacactctttcgccgcattcacgggcgcggtctctcaacactgtgttttcccgccacggaggtgatttaaacgtttgtttcgctggggcgccccccgccctgctgggggccccccaatagggaggagatttttcccacctctttctggggaaccacgggaaatttcttactgtgcgaacaacctcaaggcccttaaggtgggcttttactgggaaagaacccactgggggttttggctgaaatgccacccacacgccggagaatacccctgtgggtgttccccatttgggtgcacagtatatcctcgtggagggccccccaccacctgggagacacttcgggtgcttgccccaaagagtaatgggggtccccccccacgagattgccacgccacgcggaaaatccccctccttttcaccgcgccacagctgaaaatgtggttcccggagttgggcgcagaaatgtgtgtgaaaaaacagggaatttttgtagtttatatntctttgtgagagaatagagaggtgagaatttttttgcacgcgcncctctcacgaggccacgcggataaatggaggggaaaatatatataacacttccgcgaactatccactccacagctttagaaccccaccccacagtatatatggagatgagaagaggagatccaccaaagttccgcgaccacagagtatgcccacaattatggagactctgcacacccctatagagaaaagaggccacgcaggtgtaaaagaggttgtgatatttccattggaccgcgcaaaagagatggctctgctcggagagattgaggagaccacagcagaaatatagtggcacttgcacatgccccgcccagagtcgggcccttttcccacgccacgaccacggagaagaatcgcgaaactgagggttgtctggccctcacacaacccacatgcgttgaggatcaccacccaaggcgttgagataaatatattaaatatatttagcacgggtttatatttacgtgcctaaccgtagcttctgggagttttattcgcctgtggattttatataagtgtttaatttaaaagtga

SEQ ID NO: 704061 - DNA, 143 bp, Homo sapiens
ggctcagcgattcttgtgcttcaggcccacaagcagctggagagtcgagaggcacgcccggctactgtttatgttggtagagatagggtctcaccatgtcggccaggctggtattgaacttgtgacctcaagtgatttgcccg

SEQ ID NO: 704062 - DNA, 912 bp, Homo sapiens
gcttcttcgccataaccaagcggttgcttgctgtcccagccggcgccccctcatcagcgtcgccatgccgggaggtctggttctcgagcacgtgtctcccataagttttgaggcaatttaacaaccggatctgggcggatctgttttctacgaattgcatgagtagagtcatggatgggtatatggcgtttacttcgcaacttgcggggagttatataccccaagtagtaggagaaaaaagcagtttgtgaagtagcatgtcaagattggggatcaagtagtttgtcaatgataggcaatgtgtaggttggatggccgcttttcaagttcagtagagtgttgtgagtggaccattctctgtcgtgtagcaagggtattcacgtgttgaccctatttgtgagagaggcaacatgagaatgttactcttctctcacctattcatacagtgtgatacggaatcagtgagaaggttgagatcctggttgggaatgctgtggtttcagacagatgacgtgactgataagggtatggttgttgactgattcatgtctggggtatagtacgaggtcactgatatagcatagcgcgaaagcgtagacttatacctgtgatccagggttaccactggcaagcgatacttcttgatcgacgattcttccagggtaagtcacatctccttcttccagcttggtcctggcagcaacaacagggttttggccatcaccatggttcgctggcgccggcttgcgggacagtgtgatcggtccttccaaactatccctggcaccagacgcccacttgactttccccgatggggttcttccatagactcccatctggagacatccttctgcgtacacaccaacgctaggttcttgggaattggttcgtcacccagcttcctgccttgtc

SEQ ID NO: 704063 - DNA, 791 bp, Homo sapiens
ccacgaagacatccggggcgtgggacgcattcaaaatgcatttccaaaccgagatactccaacactcatacagactcgttcaggcttttcaacagcattcccattcttgatggaagccagctttctacattaagagaccctagcaaaacacctagactgcagatcacaaatatcaacacatttggctgaacaaaagaaagcctccaattttaacagagtcagttcagttcgattacagcctgaacatcgaaacataaaaagacaacattgcatatttgggttcgctagttcctgctagaatctgagcgaggtaaaataacatcactaatgcgttgaaagaattccacatatggaaaacctttgctttatactatagtagctttacacagctattgctctgtctctattatctaccatgactacaacttacctagcttaaggtgtctttagtgaaattatctaacccttatggggttcaggctctggtctggcttggtagccctggattctagggaaagagaatactaacatatattgtagggatcatgtagaatgtaccttatatatattcattactggccatgtacttacatccactatatctatatttattaccgaccatgccactataggatgaacttcctataattttaagaaacaacgacattatgcgttgaatctcctgacacttctacaaattttatttttaaaaaccctaactggaaaggttgggttaaatacaataggccgggattggcctttcttgaccccaagatattatattgttttgg

SEQ ID NO: 704064 - DNA, 977 bp, Homo sapiens
  misc_feature (256)..(256): n is a, c, g, or t
aacgttgttattggtggaagagaaggcgcacctaaacaggatttgcccacagtttagggctcttcaggacagtgtctacaatcagattgtatgtgggatcgccctcgcctgtcccattgaaaccgagtgtgatattgtcaggcagctgctttttacatgatgacaaaagaagagaagcaaaacacatcagacaatattatgtggacgtccccagtctggctgagcctttccaggtgaaatatatcgactcaggggnaataagcctcagcgaatggaggacccaggctaggacatcaatgaggggaaggataaacatgcagacgacctctataactggcccactcaggcgttcctattcactcggtaagacattaggtcccatcatcacgaggacacgagcagctgtcagaatccagggcttcaaagcgttagacacttttaaggggaactcgtcccagatgttcctcggtatactcttaactgacacttctgtcaaatcgcacgcgaatatatcctccaactatagtcttaatcctaaccacgaacatccccgataggattgacacggcttgtgcatcacgaacacgtcactgaggtcatgtctttagcgccaccggttacatcgacaaaacactctcgcctaatgagacggaattcaagcgacatagcaagactgccctggttgtctactttccttttcagcagccaacatttaacaaaattggtggtgctgactaaacccctaagtagattaagccctttattgccggcatacaatcctgtatgggtattgacgaaggggacagtttatcagggtgcaacggaatcctgggtgtgcacgcctctcacattttgttacacgcactgggaccttcgatgacgcacacaactactgtcatggtaacgtgtacctgcactactgccattagtgccaacgacggacagcacacgttcggccaataatagaaagaaaacaa

SEQ ID NO: 704065 - DNA, 407 bp, Homo sapiens
tcgacgtgaccagccccccaccatccccaacaacattccacacatcactcgcgcacgccacttgcgaacaccacgcacacgtctttggcgggcggagagagaggtgcccagcccgtgcacgacacgaagctccatgtgttctcgacgcaaccactctgacctggctacagccagagacacctcgaactcctccatctccccggcatggtcacgtgatggtggcagcagggacacagctcttcatccaccgacgcttggcgggggacagattctatgatgacctccactgccttgatataagtgacatgaaatggcagaagctaaatcccactgcgggctgctccagcaggctgtgctgcccactcagctgtggccatgggaaaacatgtgtacatctttggtggaat

SEQ ID NO: 704066 - DNA, 340 bp, Homo sapiens
  misc_feature (2)..(2): n is a, c, g, or t
anatccccggtagagcggtctaggaacattcctgaacataatcaaagccatttatgataaacccacagcaaatatgatactcaatggggaaaaactgaaagccttctcactccaatctggaacaagacagggatgcccactctcaccactgctcttcaacatagtttgggaagtcctagccacagcaattaggcaaacaaaagaaataaaaggcatccatataggaagagaagagataaaactgtcactgtatgcagaagacatgatactatacatagaaaaccctaaggactcaaccccaaaactacttgaactgatcagtgaactcagcaagtagcag

SEQ ID NO: 704067 - DNA, 561 bp, Homo sapiens
  misc_feature (17)..(17): n is a, c, g, or t
  misc_feature (21)..(21): n is a, c, g, or t
  misc_feature (33)..(33): n is a, c, g, or t
tactatttgcagaatgncggnttccagcatacntcgatgaacgcctgtagctgatgcggtttcatagctggctttcagcctggtcgttcacttccgtgccccgttcaaagaaatagcagagacgcttgcgtggcgacaggtaatcataggcggctcttggcagttgcaccggacgaagactgcggtgaatgcagagctgctgttcatgttcaagattgatcaccagcgcttcctcccggttgatcgacgtgtcatgaatcactactttgggtttgattgggcgtgaggagttgacggagaccaccagggcataacgctggtccgtcagttgtacgacggagccgggtggataaatacccatcatgcggattaaggaggtcagcgtcgggacatgaataatatgttttgtactgcgtgaatatctgggaaagggcttcatgcggtgtgatggcctgtgccggatttgtcgggttgcagagattatcgtaatgattcaccagggccacgatccggctcagtggcgacattttttcacccggaatccggcttggatagccactg

SEQ ID NO: 704068 - DNA, 397 bp, Homo sapiens
ggaattaaaaatgatttttaaactctctttggggactgtgtggatggtggcattattaaccagtatgggaaatataataaaataataaaatgagaggtgctttggagcagggattgagtggatgagtggatggagttgttggggaaggcagggagtggttgggaaaggtaaagaaaatgacaaagaagacacttggggaaagtgttgtaggcagttgacacatgctaggactcagaataaaggtccaggttgtagatacagacttcggagtgttaagaatttttaagaaaattctgcagggtgagaagggaaggggtgcttaagatggaaccctggggagaagcatcagttactggatacctctgaaaattataaatgaaagcaggatccattgact

SEQ ID NO: 704069 - DNA, 945 bp, Homo sapiens
taaactcgtgacaaggcgggtttgttatacagattatttagtgacccaggtactaagactagtacccaatagttacttctctggtcctgtcccttttcccaccctccaccctccaggtaatgaaccagtatgtaatatcctttgctgtccatgctatatttcactcccacttgtgagaacatggaatataatagatatacctgtaacctactaattaaattaagtacacagactaattcacctccaaaacacactccatgatccctagacacaaagaccatgattcattatcatatatagacaaaccaactcttcgataactagatacagacatagtcaatcatatccaactatatactacgacacatgttccactaatagcggccactcccatactacgactaatgcaaagaacataaaaaaacagaacaggtcgaatacaaaaacagcatcaacttgcatcactgcacacatcaacaagctaccactcaaaagaataactaacagtgatacaacacgatacatgcacaatacacaatctatatctcacaacaaagatcacaaaaatcttaccacaaccaatgccctcctaaccacatacacctatgcactctccaacccccatatctcacagctactcaacaatgcaaactatccacatataacaacaacaactccaatccactacaatagactatcacaaacaaaatcacaactaattatcggatacacacgaaaaacactcaaacaaaacaccaaacccaacatgatactaagataaatacatacacaccactcacacactatccactccatgcaacgacacaaacacacaatagacacagaatcacgagcactattcataaacaacaaacctcaaccaataacaacacctaaagagtatacaaacccaataacataaaacacaagccacaaactaccaag

SEQ ID NO: 704070 - DNA, 1644 bp, Homo sapiens
  misc_feature (2)..(2): n is a, c, g, or t
cnccaggagtggcctagcaacggtaaaaggataggggtggggtgggggctggggcccgtacaccacatcccgtgtagcgtgataaggtagtggtgctggcccccggtccctcttatgtggtgtggtgggttgtgggcatggagataatagtaatgttgaattgtcccatctccctaaccaggtacagtaatggtgggtgtttctcatctgcagtttagtgtttgggtatttgcccgttgcgcgtcgccatctgtcctaagcctatcctgcccctaccccttccctcatacctcgattccatgcccctaccactcatcctcggtgccctgcccctactcttagttgtgtgtgctaggcaatccttcctcccgatcctgccagatctcagtgtgagggtatatgtgttaaggtaaatgctaggtaattagtaaaattataggaaatgtgctaatacactgggccgtgggcaatggtaagctccataccgagcgtcccataccatgctgggccgtggctgaccatggacatggggaggagcaggtcactgagcaggggaaggggtaaaggtaaggataaaaggtaaactgaaaggtacggccaggcatatcacttgtgtgttgtgccgtcacccctccagaggggtgggctcgtttgttgttgtcctgactcggcgggtgggtgtgtattccatacattcgtgcctgtcactgatggtgggcctgtgtcccatccggccctgtacgtggtgtttttggtcggtcggggggggggctactccggcctgaccatcctcgtggcgggcggcgttgctttccgacctggtgggccggcagtctccctcactcggaggaagtatgccaatcttggtttgtttttctttccataccggcgccgcgcttggtccgaccgaccgatcggcggtggatgtacttctccaattgagggggccgcaactacagcgagggtggtcgccccccacctgtagagcagcagcgtggtggcgatcgagggatggaggcatgtcttggtggccgccgccacgcgccgacggcgccgaacgacaaggaggcggcccgcggaggccgcggcgcgcaaaagagcgcgcacgcgcgcggagagagagcgctagagagagcgctggagcacacaataggccgccccccccacgcaagaatagagctctgtgggggcagcaccgccggcttcttcatcaccaggtgttctcccacgcgcgcacaccccttcgagcacatcttttccggaagcagccgctgtgcgcacagcctcgaggcgctctcgcgagagtctgctagcacacagcagatctctcggcggcgtctcaccagggggagaccccctcgagaagagctacccgcagagggcgcacacacttcctcttcagagagagacccgggtgtgtcacaagaggctcttccacagagaggagaggagataatttgagttcgagagacctctcgagagagagagagagacccacagtttccaaaccccacagtgaacaacacagggtgaaacttggtggaggaaaccgggccgttccctgaggagtccccttgtaggctgccctccgagtgcccggaggagctccccccttccaattaaaaaattttttttagcggtgaa

SEQ ID NO: 704071 - DNA, 199 bp, Homo sapiens
gaaggatgggaggatgcttggactcaggccttgggagggaatggtgggaacatcctatagctcgcaggttggaagagatactactgtagccaagccggcgtagggtggagccgttgagaatgatgtcattgggcatggggtggggtggatgcagtagtgtcatcaacccccccatccccattaaattaatcccaacatg

SEQ ID NO: 704072 - DNA, 1259 bp, Homo sapiens
cgcctgccacgacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcacaaagaactcttaaaattcaacaattttaaagtggaacaaagatctgaacagccatcttaaccaaggaagcatatacagatgatcaattaagcatgtgaacaagatcacttaatgtaattaagtatcattagggtactgcaaagtaaaacaaccagtaagatcaccactgcacaactgttagaatggctaaaatccaaaaccactgacaacattagcaaggaacactgacaggacgtggagtaacaggaactctcactcattgctggtgtgacatgcaaaactggtacagcgacattggaagacacttaacgcagtaatgacaaacttcacctataaatttgcccggacgataagaatgtcacgcgtagtgtcaaccccagggcttgacagttgccagtaggccgcagaagactcagggatcaactagaattccctcacgagactccacgagggatatacagagccaagaatatatcatgctaaaagcacttccaaaagataagtgagaatacacaggagtgcgtgacacaagaacccggtacaagattcgagcaggactttgacacgaccacacaagtgggcgggtttaacaccaaatctagtgcgccaaaggctggagtcatgagatacctccctttgactccgtgagagaaactcaaagcccggagcctcttgacgcctgacccaaaaagggatacctggcgagaatatatagggcagtacgcgctacagcaatagacacagaccgctgagacaggtaattagtaacacaaggccaacagaattggcgggtctatccccacaaaccatatctagtcagacgcgcaattggctgtcctaaggtgaggatgccaaccacacatacatcagcttggaaacagcataaactatttaaccgcaaaaagaagcgagtcacatgagaatgttttctcaatcacagcatttagattaataattgagcacccgatcaggtgtaatgccggatcaacgttctcgtcgcgatcagcgcgaagccataacacaaggtggggaagcaacataacaggggacaataaatacgagaccatagacaacgacatatagcagactcaccgctgaaacaa

SEQ ID NO: 704073 - DNA, 142 bp, Homo sapiens
ggccagtgtcataggagcccacgatagaagaccctcagtagacgacctagataaagcagcaaaggaatttcaggagaaacacaagaaggaagtagggaagctagaagaacataggacctactctagaactacataaataccg

SEQ ID NO: 704074 - DNA, 141 bp, Homo sapiens
  misc_feature (81)..(81): n is a, c, g, or t
gtgatccctcagagaagtacatgcccagttagttcaaacccaggtttcaaagaagtgtactgggctctactgtaaaggcancagtgaccaagaggtggggttttagaggagagtaccctcaaatcactcccattttcactt

SEQ ID NO: 704075 - DNA, 159 bp, Homo sapiens
tagcttggtgtgaagactgtcctcggggtaccttatccaatcctatatatctcacagagattgatctctatcagtatatggcgggggattctcacggagatacatgtataataactggaaacatgtatatagcatgtggtgtgtgccaagtactcttca

SEQ ID NO: 704076 - DNA, 441 bp, Homo sapiens
tgaatttattgatttatttatttatatattttgagacagagtcttggtctgtcacccaggctggagtgcaatgagactctgtccaaaaaaaacaaagagaaaagaaagagatatatctggatcctagcactttgggtgggtggatcacttgaggtcagaagttcaagaccaggctggccaacatgacagaaccccgtctcctccaaaaatacaaaaattagccaggcgtagtagcgggtgcccgcaatctcagctacttgggaggctgagacaggaagaatcacttgaacccaagaggcagaggtcgcaccgagctgagatcgtaccactgcaaactccatctcccaggcccaagcgattctcctgactcagcctcctgagtagctggaattacaggtgtgagcccctgcacccaggctcacattgcttgttttattagtt

SEQ ID NO: 704077 - DNA, 569 bp, Homo sapiens
caatccaatccaaggttcccaaatcgcccgcacatccaaacctcttctacgtcgcgatttagggggcttagcagttatattaggggaggggaaggggtaggttagggagaattggggaccgtactgggggagagaaagagatagtctttctgacggggcgcgactattgcgaagtatgcggagtaggggcgggttatttggatcccgggttagacgacttgggcggcggggctgccggcgaacgtcttcttttccccctcgtaggaggttgttggggatggtttcgagggagagagggagggtggataatctctaaggtagattgagttctttaggaagtacgattaggcgccgagaaggagggggcggtagccttcaaagagggggctaaaggacggtaaggacgttaacgtcggctaggggggtactacgaagcgggataggcggagcttccggaagggaacgacggcgaataaggactattagattaagaactgggaggattctcggggggttgtttccgggaatatctatcccttctggtttagattgtaataggtaattacgta

SEQ ID NO: 704078 - DNA, 164 bp, Homo sapiens
ggctcgaatctataggatcccgaggcatcacgattgtccgtgaacgaggtatctttactataaaagtctattgtgttagctagtcatattcattggtaggctcgaggagttcgatagttcttgggcggtgagattgagtcgtagaatgttcagtgagcctaggg

SEQ ID NO: 704079 - DNA, 255 bp, Homo sapiens
cgatcggatggcatgcgatgatgacagagatgatgcgggcagaatgctcaatggatcgattgcctgcgcgtctgagatgttagtatgagttagattggtcgggcttgtaaaaccctgggcatacaggactaggaagcagataaggaaaatgattatgagggcgtgatcatgaaaggtgataagctcttctatgataggggaagtagcgtcttgtagacctacttgcgctgcatgtgccatgtcaaacaataaata

SEQ ID NO: 704080 - DNA, 272 bp, Homo sapiens
gcgtcgacaaaaatttcaatagcttttgggtacaagtggtttttggttacatggatgaattctatagtggtgaattctgagattttaatgcacccataacctgagtagtgtgtcgtagccaatatgtaggtttttattagttccagagtatatgtgtaggatgtgcattttgttacataggcaaacgtgtaccatggtggtttgctgtacctgtcaacccatcacctaggtattaagcccagcacgcattagctcttttccctaatgttctc

SEQ ID NO: 704081 - DNA, 156 bp, Homo sapiens
atagtgggggagtagagcagcagcagaaactcattctcaaacatcttcttcattcaggcgctcgatggcccggctctggccttgttggctttctccttctggatatcactctatgagggcagagatcttcatcttcatgtcctccagctcatggtc

SEQ ID NO: 704082 - DNA, 148 bp, Homo sapiens
ggactcggtcctatttacacagggtcaggttccgaagctgtacattagaggctaccagctggtccatggcccggacagagtaggtgatgtcccagcattcaagtgatttcttgtccgttcagccagctctctagcaatgttggcagca

SEQ ID NO: 704083 - DNA, 229 bp, Homo sapiens
agatattaagaactacaaactggtaataaaagtcagcccctttgcctgcaatagaaaacaaaatgggcaaaggatttgaaaaaacactgctcagagttaagatccttaattggccattcattacttaaaaatgtgtccaaccttatcagtcttcaaaaaaatacccatttaacctgtttatcagaaaaattatccaccaagaaagtgctaaaagttaaaattgacaagt

SEQ ID NO: 704084 - DNA, 298 bp, Homo sapiens
cgttctagaaagtcctgtccctgcttgccctggttaagccagaagtctggactctcaaagagaaatgcattctggtgattacatggatccaacacctgatccctgttcgtacaccccctcccctttttaaaatccctaataaaaacttgctgattttgcggctcggggtcgccatcatggtcctaccaatatgtgatgacacccctggaggcccagctgtaaaatttctctgtttggactctttctctttatttctcagaccagctgacacttagtgaaaatagaatgtatgttgaaa

SEQ ID NO: 704085 - DNA, 141 bp, Homo sapiens
aaggaaattttaaattctgggcccctgagttagatggtaaatcctgccttacgaaagttgaattgggtgaggcgggcaaatcacctgaggtcagcagtttgagactagcctggcaaacatgatgaaaccctgtctctacta

SEQ ID NO: 704086 - DNA, 114 bp, Homo sapiens
aaatgctagtggtcgccaccttgagaggatgccttggtcggctgcaatctggtgctcggcaccagcgcccgcgaccggcgtatcccttgtgcgctgctggatcccgcgtgaatg

SEQ ID NO: 704087 - DNA, 321 bp, Homo sapiens
aggtcgactcgcaggaatgcagctgtaaagatagcaaattcaactgccatctacgctgtgcatcaataagtaccaagcagactgccttggtacgtaggttacttgcaatggagaaccttccagtctgggaacagatacagatataccaatggatattgacaataatgacataaatcgtgatagtagttcggggtttggactgacacagaagagccatcacccccagaagatccgatgttcttcttggatccatctgatctcgatgtggacggagatgaagaagccgtttgcacactcagtccatcaatcagcgataatatt

SEQ ID NO: 704088 - DNA, 890 bp, Homo sapiens
  misc_feature (211)..(211): n is a, c, g, or t
taaatctggggaaaccggttccattctgggtctgagttaggaggcttgtgggctgtagtggggagctagtgagtcccattggaaggtggcctgcagcgacaggtgttgtgtgatgcgcacatgggctgggcccatgctgtgccctgtgcagcatggctgccacataatgccagattgtcatgcgtgccagagatgccctgtgcactacaanccatgctcactggtaaaaagcatgtgggtcgaatgtgtgctcaaattgctgtgctgctgtgctttgaatgtgcttgggtgggaattgccaaaatgtgtgctggaatgtgcatgggtagatgtgctctgggctgatagatgcctgcatgtgctgcttgcaggatcacaatttgcccaagaaaaggactgtctgtccgattgtgtgtgaatgatgtctcgaccttgtctgcatcatggctgccatgctcatgtgctgtgttgcatgtttgtttgggccccctgtgaagatgcacaaaggccaactctgtctgcccagtgtaagagccgaggataaggcgggcagtgccgtacatcgtgccttcgtggggattgtatgtactttgctaagccccgcgtttgtctggatagtgggcctgtgccattgcacaattactgtacaccagcaagcaaggtctttggcgcctggggtccccgaggtgacgccaggaaacctccagggagatttccccagtgtacaggaacactattctggtgttgcccttaaaaaagaagcgcattttgttggcaaatagttgagtgcctggttgaaggtggttctcttgagcttagtttacaacggggttgtgagtgccaagcagattcgatagcaggtttgccgaaatgggtcttgttgccgcccc

SEQ ID NO: 704089 - DNA, 897 bp, Homo sapiens
tgtcaaaaacgaaagaacaacggaacacgggaaacaggaaaggaacgggaaacggaacagggaacagaacagagacggaacaaaacaacaacacaaacaacaaaaaaaaaaaaaacttggtgtgcggcgcgccgcctctggcgccctatcgagaaaagaaaagcgctttacacacagacccattctggcgctgggcgcgccgcgcggggccacagtatagggagaagtggacaaatgggcgcaaatagcggggtgaccacaaggaagaaacccgtgggaacaaaaacacagagcgcgggggggaactctctcacaccaaagacacaaaaaaggccccggggcggggacaatcgagcgggcggtcctcgagcaacaaaaactccaccaagagggagagcatcacaggaggggcacatcacaacgggaggactcaaataaccaagagagaaggcgccacaaaagaggaagcgccagcaagagaatctcaagatatgagaaaggccgcccgaggaaaccagaggcggaggacaaagcaaacaacacagagcaaaagaagagacaacagaaccagacacacacaacaaacgacgaaagcacaaaaagaacgagacagaagacaggacacaacaaagaaagacaagaacaaaacacagcagcacaacagacaggaagaaaggagtgagaaaaagaagaaaaaaacaaagaaagagaagcagaaagaaaagaaacacagaggaagagacgagacgaaaaacaacaaaagaagagagaaccggcgaagaggaaagagaagaaagagaagaacgagacggagagaaaaagaaaaagagaagaaacaaacgagaaagaaagaaagaagaaagaaaaaaagagacagaaaagagagaaagcgaaaga

SEQ ID NO: 704090 - DNA, 839 bp, Homo sapiens
tggaaacacagtctccctcttttacccaggttggagtgcaatgggtgacctcagctcattgaacctccacctccaggctcaagtgattctcctgcctaagcctcccgagctgtggggaccacaggcttgtgccaccatgcccagctaattttggtatttctcaggagagacagggcttcaccaatgtgggccagactagtctcgaacccttgacctcaggtgatccacccgcctcagcctcccaaagtgctggggaccacaggcttgcaccatcacacagggctgatttctggtatcttagtagagacggggttccactatttggtattgggtattttagtagagacgggggcttcaccgggccagggggtctggaactccgtgacttcaggtgatccgccgtgcctcggcctcccaaagtgctgggattacaggcatgagtcaccgagcctagcagaaattctacatcagaaagtttacctcgattcaagctccccttagaagcgctacctggagaatgccgctcgggactgagggtggaagggaagaccctagggggaaactgtgggtgtaattaccccacaagggcgggggaggaggagttcccaaggtgcctggccagtggcgggttgggctgtaccagactggggggcaggcgaaaatcgtgaccagagtcaggccagctggcacaaatggaccgtttggttaaacagagcgcggggggcccccgatcagaatgggggggggcgggcaagccagggggtgtgagcaacaaactcccgggagagcgcgaaaaaaaaaggggcccgaacaatagccgaagaataatagtaagcaga

SEQ ID NO: 704091 - DNA, 1153 bp, Homo sapiens
  misc_feature (60)..(60): n is a, c, g, or t
ggccccgccctggtgtcacaggagagctactattactggcctggaagcggggaaccgaantaagtacaactttgatgatcaatgtgcgccgtgaagaaatagatcagagagatgcgagccccgcatgcattggaaaggaagaaaggagcgggacagagaagcgtctcctcttcagactgacctattctcatgtggcccctagttccaggtacacttgtctgagtacattcatgtcatgtcatcctgttgggcactggatgaacgaaacccctgtacagtttacagggttccttggagagctttctaactccaagtggccacatgcatgatcacggtccttcagtcatgagtgtgcccgctctacgatacactccgataggttgggaggctactttgaaaggacgcgaggcaggagagccataagaggttgcgggggcaagggaaggctcttgtatacccagttgggcgcggaatcctcgttgttcaaacggatacggcctttggagaccctagaagccaataacagggaactgaaccatccggtggcttttcggatccccccgttaacaactacgggtattgccccctacctatatgactccgttttgggaagtcttgacggtagggggacaccccgaggatggtcgtgaacacctccaggggccctatttatttccactgtgtttgtgttaggccgggatcggactttttaaggagcttgtttggggattagtgggtgttggccatctttggcgaggaagtggttggatttccattcattaagagaatggggggtgccccacttagacaaaattggggtcggttagaaactttaataacattagtttggggacaggaaagtaacggtggggaaaccgggtggagtgggaagagacatattggggcaaagaatgggagttgatggcgtggcgagaaggtgctcatgggagggaaggggggtaagaacatgtggtcgaatattgttaaagaggttgttggaagccatacaattgcaggggcaatgggttgagtaacgcaattggattggggtggacaccccagaagatattttcgttcaaaggaggaattaccggagttaagggaagaattctaaaagcgatgcttaatatgtgttggaattgttggtcacaag

SEQ ID NO: 704092 - DNA, 614 bp, Homo sapiens
  misc_feature (51)..(51): n is a, c, g, or t
  misc_feature (63)..(63): n is a, c, g, or t
  misc_feature (77)..(77): n is a, c, g, or t
  misc_feature (156)..(156): n is a, c, g, or t
  misc_feature (163)..(163): n is a, c, g, or t
  misc_feature (167)..(167): n is a, c, g, or t
  misc_feature (185)..(185): n is a, c, g, or t
  misc_feature (191)..(191): n is a, c, g, or t
  misc_feature (230)..(230): n is a, c, g, or t
  misc_feature (272)..(272): n is a, c, g, or t
  misc_feature (313)..(313): n is a, c, g, or t
  misc_feature (331)..(331): n is a, c, g, or t
  misc_feature (362)..(362): n is a, c, g, or t
  misc_feature (379)..(379): n is a, c, g, or t
  misc_feature (406)..(406): n is a, c, g, or t
  misc_feature (434)..(434): n is a, c, g, or t
  misc_feature (501)..(501): n is a, c, g, or t
  misc_feature (550)..(550): n is a, c, g, or t
  misc_feature (605)..(605): n is a, c, g, or t
cccctctccgcctgcctggcccccccggcccccctcccgccccccctttcnctcccgccccgnccgcccccgcgggncttgtcgactttggctcccctagtgcccgtgggcctcctttccccacaggctgggtgggagccggccgctcagcgactngcccccncctngaaggcggctgctgaganggcccnggcccccgtctgtgccaaaccagttaaccacgtgctgtngggcggaagagaggggaggggcaaggctgatgctccgaaccngggagcccccccaagccctcctgaataataaaggagggaangggcttcacagggtaatnctgcctggggggaagggacaggagggctgcngcacgtccagggacagncccagcgcagatccgggcctggcccgngtgagctctaaagaaggagacggtgacngcggctgcgttgcgggtactagttcactggcaaaacattgaccttgttcaaggtctcttctagcagngcagtcaaccggctctggtccgcctccctaatgaagcccagctgcaccngctcagccagaccaactcgagggaatatatactcatattggcctcagagtcacanactcagagt

SEQ ID NO: 704093 - DNA, 116 bp, Homo sapiens
tgaggtctcgtccacgttattttagctgcactgctggatcagactcgcatgcattcacagtactgttgctaaagtgctatcagattctcgctgctatcctccatcaattgtcgcgg

SEQ ID NO: 704094 - DNA, 174 bp, Homo sapiens
aaaccttaaaacttagtcaggcatagaggcgcatctgtagtcccagctacttgggaggctgaggtgggaggattgcttgagcctaggggattgagactccaatgagctgtgatcacgccacttcactccagcctgggtgacagaatgagtccctcatttaaaacaaacaaacca

SEQ ID NO: 704095 - DNA, 190 bp, Homo sapiens
  misc_feature (21)..(21): n is a, c, g, or t
  misc_feature (44)..(44): n is a, c, g, or t
  misc_feature (49)..(49): n is a, c, g, or t
  misc_feature (109)..(109): n is a, c, g, or t
  misc_feature (175)..(175): n is a, c, g, or t
attcggcacagggagagaagnactcgctgtgtcgcccaggcttnggtancagaggtgcaatcatagctcactgcagcctcgaattcctaggatcaagcaatcctcctgnctaagtctcctgagtaactaggaccataagtgtacaccaccatgactggctaattttttacttttncgtagagatggagtc

SEQ ID NO: 704096 - DNA, 813 bp, Homo sapiens
gcgagccctcatagccgctcgctatggggaggctgcggagggtcccggatggggaggagcccagccaggcatctgtctccagccgacaccgcagacgtatcgccgaggatgtcccatattgcgcccaggccaggagcgtgcccaggacgacctggacacaacggagcaccaggcggcgcatacatgagagatgatggtgtgagagacaaccagggccattgttagagaacaacaaagcaggataacggaagagtcagaagaagaggagcacgtagagaaacgacgataacaaaggcagaggcaaagatccagagagacagagaccgttgagcacaacatgagagctccgcgaacacgagagtggaagaaggtccatggactacggacgcatccgaccaccaccgttgcaagtatcgagatttaagccagtggctgcacaacgtgacttgcgttgaaaccaaaagcagtctttgaaacgagaagcaccatggaggtagtgggcccgtacggacatcgcgagacgacccaggggacacccaccactgcgaggtgttcgcgctcttgacccctgcgaagaggtggctacccattgggagcacgaagagagggggcacatgaaaagttgacattgcatagtgagagaagacgtaggacactggcgacattcatctgggcgagagggcgaagcgcgacgattaaagagtttgtggacccacgaaaggagctgcagtggtcccatactacaacgatgagttgcgtcgctgacaaacaatggacagggacacttgctgacgaacgagacactgtgtgtgc

SEQ ID NO: 704097 - DNA, 369 bp, Homo sapiens
  misc_feature (63)..(63): n is a, c, g, or t
  misc_feature (223)..(223): n is a, c, g, or t
  misc_feature (225)..(225): n is a, c, g, or t
  misc_feature (287)..(287): n is a, c, g, or t
  misc_feature (325)..(325): n is a, c, g, or t
  misc_feature (354)..(354): n is a, c, g, or t
  misc_feature (362)..(362): n is a, c, g, or t
gaatgaccctgtatggcagatgcatctgacagcaataacttaagaagtgagggttgccacgtngaggctgctgaggggagggtgctgagtgaaagtgctatgtaaactgcatgctttttataagtggttgcagttctgtccagcccgcggccactggaccaccctgtaaggttccccaaataaaccctatgtttccttcactagctccagggtctcttctttngncctcttgaacctgggtgccatccctactgaagttaacagaggtctgggcccaacctaagggncatcattttttaaagtcccatgggaaaaaactcccagncagagtttcaggcatctggggaacggttngggcaggnccccaca

SEQ ID NO: 704098 - DNA, 403 bp, Homo sapiens
  misc_feature (403)..(403): n is a, c, g, or t
tctccctactgtatcctataaaccatactagcaaatgatcaaacttgaggagggggttgtggggacctctgatttaccctccagttggatgggtgagagcctggatctgtaattgttgtttgaagtgggggcaatcttgtgggatgtagcccttcatctgtgggacctgttgctgtctccaggtacacagtggcagaattgaattcaattgtaggacactcagctggtgtccttacagaactggagaattgcttggtgtaggaacactgcacacatttggtcacagaaacgttctgtgttgagtgatagtataaaggcaatgatttttcctatacaagaggtaaagagagtaatgtctatgatggtgtctgctcctgtcccagtgcctggggagggcaggtgn

SEQ ID NO: 704099 - DNA, 847 bp, Homo sapiens
gcagtgggatgtcctaatgcttaccgaacgaaaaattctagggctatatacaactacgccaaaaggccccaacgttgtaggcccctacgggctactacaagccttcggtgacgcgcataaaactcttcaccaaggagcccctaaaacccgccacatctaccatcaccctctacatcaccgtcccgtaccttagctctcaccatcgctcttctactatgaacccccctcccgcatagccaagcccctggtcacgctcaacctagggctgctatttattctaggccagctctaggcctaggccgtgttgatgtcaatcctcttgatcagggtgagcatcaaagtcaaaattacgcccctgatcggagcactggagcagatagcgcaaacaatcgcatatgaagtcacctatggcatcatactacgatcaacataactaataagtggctcctgtaagctctccacccttatacagaacacaagaaaggtctgagtactcctggccatcatgaacccttggcataaatatgattatctccacatagcagagacaaccgaaccccttcgaccttgccgaaggggagtccgaactagtctcaggcttcacatcgaatacgccgaggccttcgcctattcttcatagccgaatacacaaattattatataaaacaccttagcaggtaaatctactaggaaaaatatgacgcatctcccgaattagaaatatttgaccaggaccaaatctagctcggtctatgaatcgaaagatacccgaatcgtagaacataaactctagaaaaagtctaataactaaatgtattaaatgtcatacataaattcgttccacact

SEQ ID NO: 704100 - DNA, 685 bp, Homo sapiens
ccaccggcgtcaaggtattttctgactcgcccactccccggagcccatatgaatgtatctgctccactgctctgtagcccttggattcatctttcttttcccgtaggtggcctgactggccttgtattgagccaactcatccctagacctcgttctacccgacccgtattaccttgtagccccctgtcccctatgtcctatccattaggactgtatttgcccatcataggaggcttcattcactgatttcccctattctcaggctacaccctagacccaacctacgccccaatccctttcactatcatattcatcggcgtaaatctaactttcttccccaccacactttctcggcctatccgggatgccccgacgttatctcggagctaccccgatgcatacacccaccactggaacatcctatcatctgtaggctcacttcatttctctaacacgccgtatatattaataattttcatgattttgagaagccttcgcttcgaagcgagaaagtcctaatagtagagagaaccctccactaaacctggaagtgactatatggatgccccccaccctaccacacattcgaagaacccgtatacataaaatttagaccaaaaaggaaggaatcgaacccccccaagctggtttcaagcccaccccctggcctccatgactttttcca

SEQ ID NO: 704101 - DNA, 950 bp, Homo sapiens
ctggttatgactcagaagatgttatctgaaacaaagtctatagaacaaaaaaacaagtttcccctccctcatcaacaaaagcccacccttctaagagacatttcaacgctgaacttatcacaatctcttaactcagttacaactttacaaaccagcataaccgtttaacacctaaccaactttacaaaacttttggaacgcattactcttacacatctggtctcggcacgtctaacaccaactggcgaaaacgtatatgctccttacacctaacaacaaccaacttggctatacaccaccaaccgtgcaacacattacgaactctttactgtgaactaacttacataacacgctataccattcgagcacgagcaaattcccttctcgagcgcactcactataacggccacaagattcccattttggctctcatcgaaagagtctaccacatattacgcgtacagtatcacaacaactctccactcacactatacacatttccacacttgggacacacacaaaattttccctatcactacccagcacgaaagcccaaacgacaagctatagcgcaaatatctcccacatctcacacctctctctgggccatatttatcccgcattataacactgtgctacgctatacatgtggctcaagagcccacatgtaatagggcgcccaacgaatccacagacgcacacgcaatgtcttctccacatctataaccgttttctccccccttctttcgactccccgaaaatcaagaggactctccaataatattaacccacttctcgtggcacaaacggagcgaacaaaataacgaccgagcgcgaatattaccgcaagcgtcacgtctttccaagcgaaacttcctgatcgtcggcaagacagaatctctatatattcacacccattgttggtccccccaactaagacgcttctcaaa

SEQ ID NO: 704102 - DNA, 120 bp, Homo sapiens
gcgtcagggggcgttctggttccggtttttctcctacgcttctgggccggtttaccaccgttaaatgatcccttcgttagctacttttccaaagtttttaaatcgtttgggcctcttagg

SEQ ID NO: 704103 - DNA, 131 bp, Homo sapiens
agcggttgcaatccgtttgacagtgagcggttgcaatccgtttgacagtgagcagttgaaatccgattgacagcgtgcggttgcaatccgcttgacagtgagcggtatgcaatccgcttgacagtgagcgg

SEQ ID NO: 704104 - DNA, 390 bp, Homo sapiens
  misc_feature (20)..(20): n is a, c, g, or t
  misc_feature (37)..(37): n is a, c, g, or t
  misc_feature (86)..(86): n is a, c, g, or t
  misc_feature (192)..(192): n is a, c, g, or t
  misc_feature (366)..(366): n is a, c, g, or t
tttccatatttaagagcctnccttcaggagctcctcntgtaaaggcaggcctagtggtcacaaaaatctctcaagcatttgcttgnctgtaaaggattttatttccccttttgcttatgaaggttagtttggctggatatgaaattctaggttgaaaattcttttctttaagaatgttgaatattggcctcnactctcttctgcttgtaaagtttctgcagagagatctgttgttagtctgatgggcttccttttgtggttaatccgacctttctctctggctgcccttaacatttttttgttcatttcaacattggtgaatctgaggattctgtttcctggggttgctcttctcgagattgggcncggttcccaattcgccctatagtg

SEQ ID NO: 704105 - DNA, 469 bp, Homo sapiens
aatccaacccaatggttcatcaatggtagctggataaagaaatgtggtacatatataccatggaatacttatgcagccatgaaaagaaatgagatcatgtcctttgcagggacatggatagagctggaaggcattatcctcagcaaactaatgcaggaacataaaaccaaacgccacatgttttcattcataagtgggagttgaacaatgagaacacatggacacgtggggttggtcggggaaacaacacacactggtgtctgtcctggggaaaggtggggggagggagagcatcaggaagaatagctaatggatactgggcttactacctaggtagtgggttgatctgtgcagcaaagcaccatggcacatgtttatctatgtaacaaacctgcacatcctgcacatgtaccccggaacttaaaagttgaagaaaaaaataaactgtggaatgtattgttcagccatt

SEQ ID NO: 704106 - DNA, 257 bp, Homo sapiens
ggcagcagcagaacatgctgcggggtgagcaccaccggccccggggtctgtagagtgggacgtaggtgagagcacagcaaggctgctttggagcccagcctaggagctgcgggtgtctcgctgtgacacgcacattccacgattcaagtgcaagcacattcgatgaagccctcagtgaggctgacaaccttccaaatgctgagaaagaattttttttcaaccctttttgctttttaaaaataatgacttgtaaaaaa

SEQ ID NO: 704107 - DNA, 94 bp, Homo sapiens
  misc_feature (9)..(9): n is a, c, g, or t
  misc_feature (52)..(52): n is a, c, g, or t
ttcgacagnaggttccttcttctcctccaccttgggctttggagcctccttncttgggtgcctcctctttacttgctgtccttcttctcctctg

SEQ ID NO: 704108 - DNA, 1039 bp, Homo sapiens
tgctgtacaatcggccgttgtcaccatgccggtcgtccggaaggattttccgtcgccgcggggtgactcggaagtcagaggaagatgagcaggactcagaggaggtcgattaaacatggaagaagaccagagaggtaccggaacttgaggaacgaggcccaaggggtgagtgctgtggccctttgtggtggcgagaagaagcgtacaaaagaggcgacccactcttagtggaaatggatctccttctcagcatgaagaccggtggtatggtgagatatgaacgaaaaactgaagggcaacacgcgggccacagcatacaagacatcagtgagcaggaagggcaccctgcaccctggggcacatcgtttcacttgcagacaaccacaacggaaggtgaatgaagggcatgcaagacacttgacttcgacactaccctttggcagcactcaggaggctacaagccaccacgcacaagggcagatcggcgggaccatgaggggcaccgaaaccagtctcagtcaacagaattggagacgggaaactgtcttttagtgaactctccagaaacacaatcccgtgttccctccagcaaacagacagaccggaggagaatgctccccaacaggcaattgtgagtggcattcttgaggtggccctgggatatgatgtaaaataacacatttctttaccccggagtattgccagggcccgtattgtgtgaaagcatacccagcaagacagacgagacgcgagacccccctttgggcctatcaaacagcgtggtacttatggtgcgccacaacgatttaccatgagggccaagggggccatagaggaaacgtagagccaggtcgtgcctggaatacgtgaaagaaagcaaactgcgggtcaacatagaaagacgtgaagagacgggtaaatcacgggaagcgaatgtatgggacacgtgcaggaaacaaccgacataccaaagatgcagatggaccatacccgagtattgatagcggacacaacactaacatgcgcctggttatgtttt

SEQ ID NO: 704109 - DNA, 160 bp, Homo sapiens
tatatcgccatgcttgtgatgtgcgaccaaaaggaacgagacgtgatatatgagggagtttctgttctggctctagcagagttttgattaccactgacctgctggccagagcgcttgctgtgcagcaggtttctttagtcatcaactatgagacccgcaa

SEQ ID NO: 704110 - DNA, 138 bp, Homo sapiens
  misc_feature (85)..(85): n is a, c, g, or t
gcggtcgatctagaggaacccctgattgaagagtatgcaatgagcgattaggtctgttgtcgtaggcagatggagcttgttatanattatgttatagaagaggcattaacttcaagataactaagtgaaagcctggta

SEQ ID NO: 704111 - DNA, 143 bp, Homo sapiens
gtctgtagcgttgcctgccgtcttgcggtgacctttcctggaaacagacattctggagatctaccagtgggctcgtgcacaacggtgttcactggtttgcaccgcccctgtgtcgtatacggagggcctcgccacagtcttcg

SEQ ID NO: 704112 - DNA, 489 bp, Homo sapiens
  misc_feature (235)..(235): n is a, c, g, or t
gttaacttttttattaactgggggataacattgttttttttttattgatacctttatcagaggtgcaggggaattaccaacatatgtttttcctttagcaaacattaaccagggcaaaaccacaaaccgggaacagggaaaaggacatttttgggaaagacttgcgccggaaaatttaaacaattgtttctttcaaatttaaggtattcgcacaaacaaatttgagcctggccangaaactttcttctagattcgctgaggtttttacataaaagaaactttaccatggaggtgtttaaaagccaacacaggtttttttgaccaaacccaactgacttatttaggcttacttttttctcaaacacaagggtttcctcctttgcaaccagtattcagattgccagaggccacctttatttgggggggaagccatccactgggaagggaggggtgacttacattgcctgggggctttacatttggattaag

SEQ ID NO: 704113 - DNA, 105 bp, Homo sapiens
tgtcgtacacctagttccacaatactgttttcgcatacggggctatcacccactatggccggactttccattccgctttgctaacaatactgctaaagagtacaa

SEQ ID NO: 704114 - DNA, 530 bp, Homo sapiens
cacatggtgtcagatgtatatgagcagctgtcctctgaagtccctggagtctgcccgaatttgtgccaataagtacatggtacaaacgatcgtggcaaaggatggcttccatatccggtattcggtctccaccccttccacgtcatccgcatcaaccaagtactgttgtcctgtgctggggctgaccaggtctccaaacaggcatgcgaggtgcctttggacaagccccagggcactgtggccagggttcacatttggccaagttatcatgtccatccgcaccaagctgcagcacaaggagcatgtgaatggaggccctgcgcagtggccaagttcatagtttcctggccgcccagtaagatccacatcctcaatagaatgtggggcttcaccaagttcaatgctgatgaatttgcagacatggtggctgtaaaagcggctcatcccagatgatctgtgggctcaagtacatccccagtcgtggccctctgtacaagtggcgggacctacactcatgaggcttcctagtt

SEQ ID NO: 704115 - DNA, 262 bp, Homo sapiens
cgtcagattaagcttggtgagacatatccaagttcacatttttctctaagtgctttcccatcatcatactggtccagccctatcctcagatttagctatagaatacttctttatggggctggtcacagtggctcatgcctgtattctcagcactttgggaggtcaagaaggaatgatctgcttgagtcaggagttcgagaccatgcctgggtagcatgatgagagcccatctctactattattcgaagacagataaaatcca

SEQ ID NO: 704116 - DNA, 996 bp, Homo sapiens
  misc_feature (44)..(44): n is a, c, g, or t
  misc_feature (63)..(63): n is a, c, g, or t
  misc_feature (95)..(96): n is a, c, g, or t
  misc_feature (99)..(99): n is a, c, g, or t
  misc_feature (108)..(108): n is a, c, g, or t
  misc_feature (118)..(118): n is a, c, g, or t
  misc_feature (178)..(178): n is a, c, g, or t
  misc_feature (208)..(208): n is a, c, g, or t
  misc_feature (212)..(212): n is a, c, g, or t
  misc_feature (219)..(219): n is a, c, g, or t
  misc_feature (243)..(243): n is a, c, g, or t
  misc_feature (250)..(250): n is a, c, g, or t
  misc_feature (288)..(288): n is a, c, g, or t
  misc_feature (292)..(292): n is a, c, g, or t
  misc_feature (296)..(296): n is a, c, g, or t
  misc_feature (299)..(299): n is a, c, g, or t
  misc_feature (303)..(303): n is a, c, g, or t
  misc_feature (307)..(307): n is a, c, g, or t
  misc_feature (311)..(311): n is a, c, g, or t
  misc_feature (314)..(314): n is a, c, g, or t
  misc_feature (316)..(316): n is a, c, g, or t
  misc_feature (321)..(321): n is a, c, g, or t
  misc_feature (330)..(330): n is a, c, g, or t
  misc_feature (355)..(355): n is a, c, g, or t
  misc_feature (365)..(365): n is a, c, g, or t
  misc_feature (370)..(370): n is a, c, g, or t
  misc_feature (377)..(377): n is a, c, g, or t
  misc_feature (383)..(383): n is a, c, g, or t
  misc_feature (387)..(388): n is a, c, g, or t
  misc_feature (390)..(390): n is a, c, g, or t
  misc_feature (395)..(398): n is a, c, g, or t
  misc_feature (405)..(405): n is a, c, g, or t
  misc_feature (409)..(409): n is a, c, g, or t
  misc_feature (416)..(416): n is a, c, g, or t
  misc_feature (430)..(430): n is a, c, g, or t
  misc_feature (476)..(476): n is a, c, g, or t
  misc_feature (488)..(488): n is a, c, g, or t
  misc_feature (492)..(492): n is a, c, g, or t
  misc_feature (495)..(495): n is a, c, g, or t
  misc_feature (509)..(509): n is a, c, g, or t
  misc_feature (527)..(527): n is a, c, g, or t
  misc_feature (534)..(534): n is a, c, g, or t
  misc_feature (539)..(539): n is a, c, g, or t
  misc_feature (546)..(546): n is a, c, g, or t
  misc_feature (551)..(551): n is a, c, g, or t
  misc_feature (559)..(559): n is a, c, g, or t
  misc_feature (563)..(563): n is a, c, g, or t
  misc_feature (574)..(574): n is a, c, g, or t
  misc_feature (587)..(587): n is a, c, g, or t
  misc_feature (591)..(591): n is a, c, g, or t
  misc_feature (595)..(595): n is a, c, g, or t
  misc_feature (606)..(606): n is a, c, g, or t
  misc_feature (608)..(608): n is a, c, g, or t
  misc_feature (643)..(643): n is a, c, g, or t
  misc_feature (654)..(654): n is a, c, g, or t
  misc_feature (674)..(674): n is a, c, g, or t
  misc_feature (684)..(684): n is a, c, g, or t
  misc_feature (713)..(713): n is a, c, g, or t
  misc_feature (761)..(761): n is a, c, g, or t
  misc_feature (852)..(852): n is a, c, g, or t
  misc_feature (861)..(861): n is a, c, g, or t
  misc_feature (945)..(945): n is a, c, g, or t
acctttaaaaaagtaacaaaaaacaacaccacaaatggaaacanggttggaagtaaacacagngggccaacagggagagctgtcacagtgtcttnnggnctgggaatntgggcatggnggccaaaggcttgaggagagatctttaggtttaaggcaaagggtacagcctataaaaggnacaaccaccagttatccctagaagaatctntttnttatttnttccttgggggttatagattaagngcgtctncccactctcaatcccacacctgtgactcagagtgattngggnagcngcnaganggangggntgngnggggngagattggnggggggagagacagcgaccatcttngccctcaggntctgnagaaggncagggncagnngngaggnnnngcctggnagangtatgtnctgcagtaataggnatctcttccacagagggagcagagaagtggtttagtgccatggatngggggggaaganaggngcncttggccagaaggngactgggttccttaggcnttaagcncaggngtttttntattntgtgtgcnaggncaaaaataganttgggggaaaatnaggnagtnacatctaagananttgtagcaggggagaggtggagaagagcaattgcnaagggcagggnagagtgtttgctggataatntttgcgtttnaagagatgcattggtccacagcaactggnaaaggggtgtagcaagaagaatggaaagaagagaagcaaggccctctnattccacttacctcaaaagactgagccctgaggactatgtgaatacacacccctaaaggcaaaggctctcactccaccatccctttctcanaaaagcatntggtgtgccatctctccccacagtagggtattggccctcagcagagaacagaagcccatcatagtacaggtattgatggatgcncagactcctaaaaactaagtcaaagagaagggctcctacccacctactctg

SEQ ID NO: 704117 - DNA, 720 bp, Homo sapiens
gaacagtatggttttcttgtatccatgaattatatcagtatgactaaaacatcgcttcagaaagaagaacggtttatttctgctaggcttcctgtccgtttgtggtatggttctgtggcctatattctatcacgtggactgtttcctttctccaaactttgaggcgtgattttcattcattgaagaatcaactacatagtatcgtgtctcaaaaggtttgaaagcaaagagacatagatggtagactctttattgaaaacatatatggatgtggaaagcactatatattaatgcagtcatccctgtttcaggtgggacagtagagcaataccagtatgacttttttaagttcatccttagtacacagagaatatactatttccgtcagagtaatatacctgtttgaagctttaaggagcagatgtgtcggtaacgtagtttcatttgtcccatagcaaggtttgctatgtctgtgtgttaattgtgttatacctgcattgttctttgtcctggaggttcatgttgtcgcagtctagactggggtggtagcaggtttgaaccaggggcggagggtattctggaagtgatgcgatagtcttacagactcgattcactatggccaagtgtggctaaccttgaatcgtaccaataattggtataaaatatccagtttccaaccactttttactaataactctctaatttcccaatgaaagagtg

SEQ ID NO: 704118 - DNA, 3861 bp, Homo sapiens
aaagagttcgaatattaaacaagtacagaagaaaagggaggcctagggggcaaacgactctcttaatcttccaccgctacacactacatattctgcatttattcagctacttccagttcttgtgattgtgattatatctgtcattactcagctgctggctactaatcccccatatagtctgttctataaatcgaccttgggctacaccatttctagagaaactcagaacctgcaggtgccttactttgtggataaaaactttgacaaggcctacagaggagcttctctgcatgacttggagaaaacaatagagaaggattacattgattatatccagactagttgttggaaggagaaacaacaaaagtcagagctgacaaatttggcaggattatacagagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactaggtaatgatgaacactttactatttgctaacttcgttggttgggcagagtggcaggagcatgggcacgagagccagatgtgtcttcacaggatccttcctggggagtggctccagggaccaggagtagttcatctaagttaaattaatggcaaggcattggattccgtctccctgctccatgcctaccctgcctatgtgaatggagttcagggcatcccagagcagatccatgctttcttccttcttcccttcttcagtgaagtcttaagaaccaggcattcctaggcttagccaaagcttaatattagttatttacactgtctaccaagaattatacctctcccttcattagagtcatcatctccgccaagatttagcctttggaacatgttcctgcccagctttccattttctaggggaatatggagaaatttaaactattgtagtcaatagttttctattattccaatctctgctcagttagtagcattagcaaactgcctaatttgagattcctttatttccttaaccctctctcctttagagagtccagaaattaaaactactgagcagcatctggaggcgggggccagggcgaaggtataatgcaagaccgagcctcatctcctccacgaagcctccctactccatcatagaacccagagaatgtcccttcggtcatttcccctcagtatcatcattggtgtcatcgcacttaggctgagttcctacatcccacagaggcagatggtcagacccaggaggaggcattgccagctctccaggctgtttgctcaagcctagagatagaggagacagatcctctctccttggatatgggggtctagctttggccccagcagccactttgtttaacccagtatcctatagtttgtgatttgagatgatttttcattcattcaacatttattgagtgcctactataaaagcaggggctctcacacatattttcttacttaaacctcctcacaactctgaagtagatgtattatccctggttctatgaatgagaacattggcccagagaggatgacccaggtcttgtagtggcagagcaagacggtaggctgagtgtcaagtagaaagtggagagcatcctcatgtctcaggtgattctagccagactggcaaagcagaacctttcccgaggatgcctccgtcctccccaaccccatgacccctcatcttttctgtggcaatcttgcatctgttcaggacaacatccctgctgctctttaggaagcaggaccctgtctaacataaattctgtacacaaaataagaggtccctcacaggcaggcagccctccactggtgactaggaagaattcagtcactgcctgggctgtgtggttctgggccttcctgtggagctgagctgcctgaattatcatgactctgaacttggaaggatcattaagtgactgtagcctacactccatgcttccttcatattggaagaaaagtttctggtagagagtcggccgggtgcactggctcaagcctgtaatcccagcactttgggaggctgtggcaggtggatcacctgaggtcaggagttcaagaccagcctggccaacacagtgaaaccccatctctactaataatacaaaaattagccaggtgtggtggcacatgcctgtagtcccagctactcgggaggctgaggcatgagaatcgctgcaacttgcaaggtggaggttacagtgagctgaaatcacgccactgcactccactccatctcaaaaaaaaaaagagtctacattaaacagattccaaagtaaagtttcttcatcccaatgcatggccatgatttacacagacgtgcctagcatggctcatcaacatctgaacggttgttccctaccatgcctctgcaggcattccacagagtcaggagatgggttcacaggtaaagattgggggctttagtggcttgtaggggacaactgctcagttgcagggagagggagcatttctagaaatagccagattttgctgcccaactagatctgtcctcctggttttagggggcccttcttgatcccctctgagtgactgagggaggttacattgtaaaatatgtccatgagccaaacaggcttatggaaagttcttctacacacaaaaaaatcaaagctctcctctccccatccccaaccactgctagaaaattggccataatgaaactgacttgacaggttaaaagaccctgtcctagatgcccaggaatcaggtagtcacacattttatggacttcatggcagcgatgagtaatctgtgatgatactaaatagaagcaataataactaactccattaaatgtcacgctgattgtctgtttttatagcaccgatggtactgttttatttattgccaatagaccacaacattcacatctgtttttcctcaagggaaccgtatttgcttttggttgaaggatttatctatttgatactatccagaatattgtgaagctataatttcctgggttatattttagatgggttgtctgcatggtggtaaaataagctttttcctctcgcctacgtcctttggaagatctcctgatcatacataactaggtagggcttattcttgctgccggagcttggcacccagctctagactgtttctttgagcattactgcagattggagacgtgtgtgagaggagcagcgctcagaaatagggcttgaggctcaagcagaaactgaagctctcattcaaatgaagatgctctctctaccgcacgatcggcagtgagaaaaggaggatgaaaatccttctcatcacaaagagcttgaaggaacccacgtccccagattagcaaccctagagttcatctgctcaggccgggaaatgtgtaagcttccttgatcagctccaggcctcacagcacgggagcagtgaccagtaaggaaacgtcactgctgtgctttctgttggaaattgttcgaaaatacagtgaactggccaggcccagtagctcatgcctgtaatcccagcactttgaaaggctgaggcaggcagatcatttgaggtcaggagttccagaccagcctggccaacatggtgaaaccctgtctgtactaaaaatacaaaaattaggcgggcatggtagcacgtgtctgtaatcccagctcctcaggaggctgaggcagaagaatctcttgagcctgggaggcagaggttgcagtaagctgagatcacatcattgcactccagcctgggtgacagagcaagactctgtctcaaaaaaaaaaa

SEQ ID NO: 704119 - DNA, 476 bp, Homo sapiens
  misc_feature (220)..(220): n is a, c, g, or t
  misc_feature (451)..(451): n is a, c, g, or t
  misc_feature (464)..(464): n is a, c, g, or t
ttggctcactgcaacatctgcctcctgggttcaagcaattctgcctcagtctcacaagtagctgggattacaggcgggtgccactacacccagctaatttttctatttttagtagagatggggtttcaccatgttggccaggttggtcttgaactcccgacctcaggtgatctgcccgccttggcctcccaaagtgttgggattacaggcgtgacagctngtgcccacccgaattatatttttcgaagcggagtcttgctttgttggccagggtggtctccaacctgggctcaagcaatccccctgccttggcttccctgaagtgttgggattaccagcctgatcttaccatgcccagctgattttatttgttggagcttgagataaaatttggggttcatgtgttatggaaaagctttctgattaagattgagaattattactgtttagnatatcttacaaanattttgtttgtg

SEQ ID NO: 704120 - DNA, 840 bp, Homo sapiens
ccgcgcaccctctctgggctccacccaggctgagagctggggtcgtggcggcgggggtggagagcgcgcccctagagatacacttcgagtggattctggccatttgagcattctctccaactctccaatccccagtctgcccccacgggggtctcccccactctcccccgtcccacagcctagaccactctatcgcccgtgacagcgtccctgttgcctcactgcggcgaaatgggcacagggccccgcgtcagacgtcccaggagcaccagagctggcccgtgagcgcaagccctgagcccagcaggaccgtggggacacgggtgactcaggagcgtgacgtcaggaaggcatcagggtcctgcgtggcaatcctgcggcaggctgagacgggtgagtcagagcgtgggatgggagactccccaggcagaggggacacccgagaggaggcacaaggacccagcctggccgggctaggaagtatgaatggagaccagaaggccccagaccagcatgggcagactcggccagagagaagatctccaagatgaggacaggaactcagcattcagactggaaggtccaggcacaacagaccgtgcctgacaagcgggcagggtcacggacaaggtgatcctgtgcttggcaaaggaagaagatacatagacaaatgtacatccgaacgggcaacgtacaagatgctaatcgtgtcctgccgactgaaccctgtacctgagcagttccacccgagttggtccaagctgtctatcctcatcatcatgcatcctgacaaagcattccgcgaatctgcacgctgccgggttctcgatcaggaaccat

SEQ ID NO: 704121 - DNA, 152 bp, Homo sapiens
gtctgtgggcccagtcattgggtttatcagtgctaatgtgaactaagttaatacttccacgaatacaagccactaccttctgacctccccaccccacaccaaccgacatctattaatatgactgtagggcatggaactcggatgaccgctgt

SEQ ID NO: 704122 - DNA, 718 bp, Homo sapiens
  misc_feature (85)..(85): n is a, c, g, or t
  misc_feature (139)..(139): n is a, c, g, or t
  misc_feature (159)..(159): n is a, c, g, or t
  misc_feature (172)..(172): n is a, c, g, or t
  misc_feature (177)..(178): n is a, c, g, or t
  misc_feature (187)..(187): n is a, c, g, or t
  misc_feature (195)..(195): n is a, c, g, or t
  misc_feature (197)..(197): n is a, c, g, or t
  misc_feature (213)..(213): n is a, c, g, or t
  misc_feature (216)..(216): n is a, c, g, or t
  misc_feature (233)..(233): n is a, c, g, or t
  misc_feature (236)..(236): n is a, c, g, or t
  misc_feature (274)..(274): n is a, c, g, or t
  misc_feature (276)..(276): n is a, c, g, or t
  misc_feature (283)..(283): n is a, c, g, or t
  misc_feature (285)..(285): n is a, c, g, or t
  misc_feature (287)..(288): n is a, c, g, or t
  misc_feature (292)..(292): n is a, c, g, or t
  misc_feature (303)..(303): n is a, c, g, or t
  misc_feature (310)..(310): n is a, c, g, or t
  misc_feature (316)..(316): n is a, c, g, or t
  misc_feature (400)..(400): n is a, c, g, or t
tgatgacttagggaaagatgagttagtgagagttcaccaagagatggctccagaccattttcttttcttgggagccagtggattnttccagcagtgaagggacattctctacactcagatgactctaccagtggccttntaaccaagaagtagtactgnatgggtcatttgnaaaannctgcagcangtgaactntntgcatctcaagaaaanatngaaaaattctatgaatngtngtagccggtgaatgagtcgtattctgtcacataatatntngaagaanancnnggcngtcgaaacatntttctcnctgacngctgcattgagatgttcgtgtggagggctggtgttcgttatgtagtggagttgtttgtatgtaatggttggatcccttcatttngaatattacatggcttctattcgcgattacaagagataaatgatttgtgggacgaatgccggtataacactgtgagtgaaggttagtattccacattcataagatgtcagagtgagtgtgtaagcgagtagaaatcgaagtattgttcgaatcgtgcatacgagcagatgttctttccatcctcgcagcgaaagcttgtattgtaagaccgaaagaaacgaatgaccctcgttttgcttgtaggatgggtgccacctaatgcccatcgagaagcaggagattttctaccattggaaaacgcggggctcaagtggagaa

SEQ ID NO: 704123 - DNA, 448 bp, Homo sapiens
  misc_feature (383)..(383): n is a, c, g, or t
ccgcatcttcttgtgcagtgccagcctcgtcccgtagacaaaatggtgaaggtcggtgtgaacggatttggccgtattgggcgcctggtcaccagggctgccatttgcagtggcaaagtggagattgttgccatcaacgaccccttcattgacctcaactacatggtctacatgttccagtatgactccactcacggcaaattcaacggcacagtcaaggccgagaatgggaagcttgtcatcaacgggaagccatcaccatcttccaggagcgagaccccactaacatcaaatggggtgaaggccggtgctgagtatgtcgtggagtctactggtgtcttcaccaccatggagaaagccggggcccacttgaaaggttgaancaaaaaggtcatcatctccgccccttctgccgatgcccccatggtttgtgattggttttaaccac

SEQ ID NO: 704124 - DNA, 164 bp, Homo sapiens
gtgagctatcagcattggtgaggattgtgccagaatggctgagtaggatattttttttgagagtacccagttattctactgtgcttatgctactgttcttatgtgaatgttgtacatttaaaatgtttgcatagcttttaggacttggtgtaaaggggcaagtg

SEQ ID NO: 704125 - DNA, 418 bp, Homo sapiens
cgccttacccttactgcgaacatcacttagtatctaccaaccacctgccaagcattgttcacatataaaagttgacttaaaaagacaaagaatcgaccgggcgcaggggctcatgcctgtaatcccagcactttggaaggccgaggcagacggatcatttgaggtcaagagttcaagatgagcctggctaacatggtgaaactccgtctctactaaaactacaaaagttagctgagtatggtggtgcactcctgtagtcccagctacttgggaggctgaggcaggagaattgcttgaacccaggaggtggaggttgcagtgagctgagattgtgccactgcactccagcctggtgacagagcatgactccgtctcaaaaaataaaaatagaaaataaagacctcttatttatggtgct

SEQ ID NO: 704126 - DNA, 782 bp, Homo sapiens
gctctgaaggataggcaacagaaaggctagggcagcaaacctttaatgcactacctccgacatatccttcgtcttctggcagagtttggtgaggtcctcatgattggtattgctaccctgagtggcacaacatacgggtacactgtgggccagtctgagactgatctaaagtaggactgtcagttagtgctagcgttttggttcatggaccagctggtccacagatacccagaatgcagaagacgatggacacgcacctgcgcttgtgcccggctggttcactcgacaagcctggctgcatgcaagggtagttggcacagatgcccagtgttggaccactagttggaattggaaggtacaaatgcagctcacttgtgactgggcaaccatggatattggctagagagtacatgagaaacgatgccaggctgtcaagtgcaagatgatgtgtattctagtctagatactcatcaatggtagtcctgctcccatccaacctaccagtcgttctacaagaaagtgctcaacgagcggaagacctcaagcaccatatggcagtgaatcgagacgagtcgaatttcgtgattctctcttgaaagacaaggcggacgtggttgaatggcactggcccacgaggtaccatcataaggcttaacgtaccttgtctcaaggtcctcataccatggggcctcaattcacgagtcagaatgctggatcatagagcgcctttgggaagcactattgccacggggaattgttggagcaccaagtgagaaccgagt

SEQ ID NO: 704127 - DNA, 860 bp, Homo sapiens
cctaccccttccttgtactatccctatgatgcataattataacaagctccatctgcctgcgataaacagacctaaaatcgcacattgcatactcttcaaacacccacatacccctcgtagtaacagccatgctcatccaagaccccctgaagcttcaccggcgcagttcattctcatagaatcgcgccagcgggagcttgagcatcctcagtatagctatgtctgccctagcagaaccgtcacaagctagcgagacgcacgtcacagatcgcatcataatcctctctcaaggacttcaaactctacctcccactaatagcttattttgatagacttctatgcaagcctccgctatacctctgtccttacccactccactattaaccttactgggaaaactactgctgtcgctagtaaccacgtatcttctgatcaaatatcactctcctacttcacagggacgtcgaatcatactagatcaccagaccctgagtatctcccgtactacaatattatacgcacaatcgacaatggggtctcactcataccacgcactagttgagacgaacataaaacgcctctatgtcacacgagaaaacaccctcatgttgcatacgactcttaatccacctcaattctcactcacttattcccgtcacaaccccccggcaaaattcgatttgaacccgggggtttgtaccccctctttttaaaatgagacacaagcctgtttctccccagaggtactaacacgggggagaaccagaattcttcctcataaagggcccttaggttcctagaacagaaacacttggggccccaaacagtgaacaatgaagacacttgaaagatcgtgccta

SEQ ID NO: 704128 - DNA, 219 bp, Homo sapiens
gccagcaacaaccacggaaaccaagacgagcgcggtcgggaagttatcgcggctttacatatctcgcagccaggcgggtccctcgggagaggcgcgacagaggctctcgttcggcgccccccggagaaaagaagcagtcacgccatgatctacaccccggttgccgctttctcctctcctaaccgttaagtgcgctaagggccatggctgaggtgcacg

SEQ ID NO: 704129 - DNA, 264 bp, Homo sapiens
  misc_feature (10)..(10): n is a, c, g, or t
  misc_feature (51)..(51): n is a, c, g, or t
  misc_feature (177)..(178): n is a, c, g, or t
  misc_feature (209)..(209): n is a, c, g, or t
tcccgggggntcagagtcgacatgctcatatgggagcttggtgctggtggncaccatcagttcctgcctaccatcgatatgcatgcattccttctctaagagagaaatttcctttccttgaagctgagctgggcttgcttgatctgagttggtgcaagtgatgtcctcggatttatnnaggctgtcgtaaggaagcctgtagcttctgncctgggactcttctgcctgagcacacaccaccactggatagactgctttgcgtca

SEQ ID NO: 704130 - DNA, 362 bp, Homo sapiens
tacttttttactaaatttcccatttttggcccaaaaaaattttatattgggctcttcctgaaaaaaaccattgttggggaaaaaaatctggggtgggagttattttttcacccatttgaccaagtcattcccctggggccctggccccctgtaaactggatgggaaaggaaaccattaaatattgtgtttaaagttttcctgggctataggaacagtatttgaattttatgcaaagggccaccccccctaaagattgttaccgttaaattaacccagtgattggatggggtttttagttgctggaaaaaaggagttccagtggcccatgcctaagccccctaattaattatatatttggtga

SEQ ID NO: 704131 - DNA, 313 bp, Homo sapiens
gctaattggatgtaaaatttggggtgattttttaaccctttccgggtaaagttttttaaatatacttttttttaaggttttttttccgcctttttggattttccacctttgcaagtggtttggggtttttaaattgcaaattttccttttttcctttccttggaaacccggtggacccctccccctttttttgggttttgtaatttgctttttacccggggttgaatttctttttttttttttccccttttttgggaaaaggcccccgtttttatttttttttttcccaaattaatccccccttttgtttcca

SEQ ID NO: 704132 - DNA, 235 bp, Homo sapiens
tctaagacccgttatgggtgccttccgaatgtgttggctctttgagctgatctcctgaatctccatcttctcctcatcgttcatggccggtttctatcaccttcattcctctgcaaggagcaatctcatcaggacggccgttcactcacacccctccatccacctctcatctatcttttctttcagatggagtctcgctctgtcatccaggctggagtgcagtgtcacgatctca

SEQ ID NO: 704133 - DNA, 943 bp, Homo sapiens
  misc_feature (568)..(568): n is a, c, g, or t
  misc_feature (943)..(943): n is a, c, g, or t
cggaggacaatgcccagcacagatctctcagccccagtgaatggtgaggccacatcacagaaggcgtgagagcgcagagtgacaacggaagcacgaggcagggtcgggactcggaggaggggccaagtgtgtgttgctccatcatgaaagtacctgcatcgaacgatgcgttacgtggtagtggtcccgcacctggaacatgagcctgagcgagacgacgctggcaggcagcgcgcatgagggcactggggggcgactcggtagggacccatggaatcgagcgacgagctgagcctgcggagcagccaagggcccaaacactcgcgcgcctcggaagctcaatgtgcttgcccacctcgtccttccgcctggactcttccaagtgaagaagcgataagctagtagggaacctgttggcgtgaaacagcttggtgtcctggtcaaggtaatttaggtaccctttgggggtttatgtaactgtgccttgcccctaaaacttttctctgtctcgaatgttgtcccatggcccgagagacaattggcaacagagtggaaacctttattaganagctgtggcattcttgttgaaactggaaaaatcacaagagaacttaacaccttgaccacagccaaaaaatagacgctggggggagcgtggcagggcgtaccccaaacgaagcttgtttgtgcgccctccgtgtggggaggggtcccgtcgcagaacttcctgatccaggtcctgttacacccacaaggggaaatcatcgcatgttggcatacgcacaacgttgtgggcggcgccgcacaactaaaatgcgagaagacgagtggcgacttggaagaatatattagaacagggcgacgcttatagggaaccatttttgtagaagcgtacaagattcaaatttatgggcattagacccgaatttggcgcgaagcgatn

SEQ ID NO: 704134 - DNA, 116 bp, Homo sapiens
tctgtcacagcaggctcctcctctacagtgcactatttccttagcaatcccgaagtctccatactaaactacccatctacactctagcagccctcagcgggatccatggctgcagt

SEQ ID NO: 704135 - DNA, 410 bp, Homo sapiens
gcagctggcagtgtaggagggaggtagtttgccacctcccggtacaccccggggacgtctgtgggagaggggagacctgctctgggcagcccgccaggcatagccagaccggccctgcccctccagcctgcagcccaggcccccgggacgccttcgcatcctcttgggagccatcctttgcgctgcgtctaggcccaagccaggcttgccgcccactcagacagcagtgtcctcaccaggcacatccggtcgggctagtctggggtctggtaattgtggccaggacaggtgggaggtcaccagcctcctgcggagcctcccagcccccaaccttaggctgtggcctgggatgttcacggctgggatgacaccaccctgctgggccacacgaagctgcgtataggatgcta

SEQ ID NO: 704136 - DNA, 1433 bp, Homo sapiens
atgaacacatacaagaaggcattcctggactgaattctctaccaaagctagaatggaatgcaaatgtaatgtaacgcttcttactttattagcacaattctaaatagctaaacagcttcattaatctatgcattccattcagccttttactatttagacatcgtctaaaacatgtaactacatactgtacagctacagtacttcccatttggactgcactgcgaaacagcaaatactacagtaattccggaacgacgcgtgcaactgcggacaacaaaacaatttatctaacctcctctccaatcaatgctaccagacaacctcaccctaccatcacaaacatatcctgttaaaatcaatccagcacacacaatcctacagcgcagcaatatttaattagccttctcatcttcgctacctaacacagcacaaacaacctgcacaacaattcaaaaacaccagttcccccaacgcggcaattaaccagcacagccatgacgtatcacccgtcacacactcagcattatatcggggacacttctatcatacactccttcagcggcttcatcgccctttacatactttgcaccaatatccttggccctggaatatataattaccgcaattcaacagaatgcgacgggaccaatatgcgcacgatacaaaacagacaatagatgaaatacccacatatactagtcccacccatatacttgttcataccacaccttatattcacaaccatccgatttcacacctcaactcacttggtcctcaccgctagcccccatatctaaagccaaatataacgtgacgtaacataacgacccccaacctcgctttcaactcatgctctaccttataaaacgtcaaccattatagaaaacaacacagcaaggaaattgagatacaaagaacgacagagacacccattacaatagtcgaaccaacgaagatgatatacacatacagaggtagcacaaactcacacgaccaacaaagatacatctacaaccacccggaatcaacgagcggaacctaacacaagtatagaccagtccaaagcagaaagaaccaatgaccgattcaaggccattgcaacttccactccactactacccaatcactcttgtcaaactcaacgaaaaatcactcgtcacctctttacttgcaacatcacaatcacccccccatcaatgattctgcaacaccacatatccagcaacacaacatctgaaaataataaagccaaacaatcaccacccactacatcaaataccacaaacatataatcacctacaacaaatcaacaacaaaacaaaacaaccaacatacaactcagcacaccccaagccaatcaaataaaaccaacaccatcacaccacacccaaacaacgcacaaacaatataaacaacacaagcaagaacaacca

SEQ ID NO: 704137 - DNA, 127 bp, Homo sapiens
taaggaagcatcctcctgcatgcagcagagcgttgatcgtctgctgggtaaacagcgtggaagatggacgcacccgcgtatgactacgacatcgagaaagagtccactcgtgcatcttgagtccgag

SEQ ID NO: 704138 - DNA, 269 bp, Homo sapiens
accattgttggccaggatggtcttgatctcttgatctcatgatccacccgtcttggcctgccaaagtgctgggattacaggcatgagccactgtgcccagcccttttttttattttttttcggacggaagtctatctctctcgcccagtatggagtttcatgacactattcttagcttattgaatcctccaccttctatgttcaagcatatttcctggctctcccctctgagttgtgggaattacaggttcccgtcaccatgcttctct

SEQ ID NO: 704139 - DNA, 813 bp, Homo sapiens
gtgctattgtactgatgccttggtgtttgtgaattctgtgcactgagttgtctgctggctgtggtttgtctactgctgtgctgctggctgtgactgtcgtgatgtgccatgctgtgtggatgctggatgctgtgtggcctgcctgggtgcctctccgagtggcctgcatgctgtgcatgcatgtatgtgtgccccccttgcccctgtgcctggctgtgacctgaatgaactgccatgtgcaatgtgtgtgtgcctgtgtgtgtgaccctgccccctgtgcctgtgcctgcagccatgaactccaactgtgtgatgaacctaccccctgcacatcatcctgcctgtgtgtacaatgtgatgtgtgactgacactgacctgcatacccaccctgaatggcatcaatgtgtctttcccaactgaggatgtgacctcacctgacctccagtgtcaccatctgatgtgtgccctgatgtggtgaccccatatgcttgtgatggtcttgttcctgcatgaaactcctgctgggtgaatgtgacttccctgcctccccacccaatgtggctacttcctgaccaagatcttccaccctgaacgttgtgcgccaatggcgagatctgcgtcaactgtgctcaatgagtggactggactggctgagctgggcatcctgacactgtactgctgaccatcaatgttgcctgctgatccaccctaatccccgagtcttgcactcaactgagtgagtgcttggcctgtctgctcttggtagaactacgatgagtattgcatgctcgtgcccgtctgtcacagagatc

SEQ ID NO: 704140 - DNA, 319 bp, Homo sapiens
  misc_feature (1)..(1): n is a, c, g, or t
  misc_feature (27)..(27): n is a, c, g, or t
  misc_feature (64)..(64): n is a, c, g, or t
nttactcagggatgtaaagatgtgggnccatgggtccccagaacaggatgcattctgctggggnctgggctctcaaagtggcactttgttgtagccacttaagacataagggtgtgtgtgggagccagcatgagcttctctcgagcaatgcggtcacagagtttccaggcagctccccatgttagtctcagagcctgcaggggttgagtcactaggattgcagaagtccatggtgggaatgtggtcagctgggggtctctcacttaccctttccctgcactgggagcctctctgggctcctggccaatcccagctgagc

SEQ ID NO: 704141 - DNA, 397 bp, Homo sapiens
tgttttaaaccaaggagaaggtagacggatacttgtgggtaaatggctaacggtccatattcacattagagacacagggtactctcggagcccaatatacagagaagggaggaaaaaagctagaatcctatgcactactacacgggggcctagcaccctccagctcccagcagagcgaagggagcaggtttttctttttccccacagagctcgggggtgtggatcccatacagttttggtccagacaggaggggataaaaatgaccttcgaacagaagaggggtagagactcttttcccatggtatccggctcagaggtatttccccccaaataaatggagacccagggagtagagaaaagagacctcaaaaacagggcgacgtgagcacaagaggg

SEQ ID NO: 704142 - DNA, 166 bp, Homo sapiens
gtgactggacttcggcggtaagacctcaggaggcctgggagctgagacgacctcaggtttgaggttaccggtctcgatcctgacgacgtgaccggccttgcaaacagtcactttggcgctcatggctgcggccagaattgatgcgctgccatccacccgaggacga

SEQ ID NO: 704143 - DNA, 469 bp, Homo sapiens
ctttattgtccaggctggagtgctttttcccctttttggaggaccccaggaataaaaagggggctttaaaaaaaaaaccccccggttttactttataaaacccttttcacaaatgaacccaaatttttccctttgaaaaaacggggggaaaccagtccctaaaaaagggcgtggggaacgggcttaatcccaaaggggggaaaaaggggggccaccctttgggggggtttatttttttgcccaagttggggcccccaattccccatcccaacatgtttttttcaatgtttgaaaacctaataaaagacaaattccccggtaaaacacaaattaaactgtttcacctgtttttgaaaaaaggttttgttggggtgtccacctaaaggctttggtgaaaagacccacaaaatctcgggaaattccccccggggggaagcatttggggggttttgaccaatgccaactttaa

SEQ ID NO: 704144 - DNA, 353 bp, Homo sapiens
tataatgtgacctgagtgtccaaaaaagcacaacaattaagacttggggcactttatgtagcagatatataaaaagcaaagcaggaataaagagcaaatgaatttaataatacggatataaggcagctttaaatctatccacaggaaaaggaaaaatttatataatctcctaaatataatagcaggtattatgaagagttaataatctcgtccattcggaatgaaaaaaactaactttaaataagttaattctatgctcctggaacgtcttaaaaaacagaaagggttatgattggctaggactacactttaccatatgagcagcgttacaggggataaaatagacctagtag

SEQ ID NO: 704145 - DNA, 449 bp, Homo sapiens
ggttagattggattagataaagtaattcagccacagaggagaaaagtacgtacataacaagaagggtatattatgagactgaagatcttctgctccttttccttccgtttcgtgcctctcaccttcctccatctctactctcccgagatagcctgtgtgaacggtgtaaacgagagagaatatctttcttaagattagagctaacccattaaggacttggctatgtctccaagtattgattgccccatcatctcaagtaggatattttaaagatttctactttaggtggaatatggaccaagtcactataagtaactataagataccagtactccatttttgaggcagcatgacttaaagacgggctgagacaatttacgggggaattcctgcttataaaaaaggtgagaaaaatttgagacattcaagagtaaatatggtttgtggac

SEQ ID NO: 704146 - DNA, 279 bp, Homo sapiens
tttcacctctccaaggcttaggttctttatctttaaaatgataatagcagtattttaaaaattaggtacaggatattgtgggagatcaagtcttgtaaaggattttagacaatacctctcaagttgtaagtgcttaacaatcgctactattgtttttgatagcttaatcactatctccattgttctttggatataaaaatgtttaaaaatgttatttaggcctggcacagtggctcacggctgtaatcccagcactttgggaggccgaggtgggcggat

SEQ ID NO: 704147 - DNA, 160 bp, Homo sapiens
tcccactggacgcctgaggctctccttaagctccttcttccattctgccattcctccctcccttccttttttaactgatttttattacggtgtggcccttattcagatggacattggttttcaaataacttacaataacacgttatgtgccatgttgcca

SEQ ID NO: 704148 - DNA, 226 bp, Homo sapiens
cacttaacccccaaaaccagcccccctttcaggggttcagggccagcctgaaatggccgttaaactcctacccacagttacagccccaagcctgcctcctccccccctgccagcctatgagtttccaaagggttggggcagttccatgaccccatgttccagctccccacacagcgctgggccaaaaaggcattggtgcgagggattgaataaagaaaccaattga

SEQ ID NO: 704149 - DNA, 908 bp, Homo sapiens
  misc_feature (487)..(487): n is a, c, g, or t
gaggaaaaccgtgtgctattagccatggtcaaccccacgcgtgtacttcgacattgccgtcgacggcgaggcccttgggccggcgtctcctcttgagctcgtttgctagacttaacaggtccctgtaggcacatggccagacaaatgtttctgtggctctagagcagctggagcagaataggcatattggtgtatacagtggttccgtgctattcacgatgaattagtgcgcagggttctattggtgtcatggggtgtgattgacgtgtccacatcgcccatcaatgcgccagctgcgtgggcgaggctctcattcgattactcggtggaagcaaaactttcgaaggacttagagaacatatcattaccttaaatgcattcacgggatccatgcgcaatcgttggtctcgatgggcgacaaatggctagagactgccgaactaccacatgttggtgtcccgaggcttgttttcattcctatgcatcnatgccgaatgtacatgacgtggggtataggattgagccaatgcaattgtgtgtggtatttgtgcaagagctgcacgcggacagtgcacttgaattaccttgtcggtgaaggcgcattggagtcgctcttgcgggtcccagagaattgggcaaagtaccaagtcaagaagagatacgacctattgcgtgatcgtcgtaggaccacatcgtcctgagatagagttgtagacgttgttgtattattcttaaaccacacaagatacatttccgttctagtagcatcagggaagagccaccccgtccacccccatattgctccgcaaggtatccctaggaaatctttgttgcgtctcgcttgcaggtaccgctttggggttccatggtttttccttgttccctccccatgcctagcttggattgaa

SEQ ID NO: 704150 - DNA, 298 bp, Homo sapiens
  misc_feature (235)..(235): n is a, c, g, or t
tctgattggtgggacttagcggtcaggagttcgagaccagcctcaacatggagaaaccccgtctctaccataaacacaaaattagctgagcgtggtggtgcatgcctgtaatcccagctactcgagaggccgaggaaggagaattgcttgaacctaggaggcagaggttgcagtgagccgagatcacaccattgcactctagcctgggcaacaaggagagaaactccgtcttaanaaaaaaagggagagaaaaagaaatggggggggggggcctcactaagttgccccgccaatcgaa

SEQ ID NO: 704151 - DNA, 307 bp, Homo sapiens
  misc_feature (11)..(11): n is a, c, g, or t
  misc_feature (186)..(186): n is a, c, g, or t
  misc_feature (209)..(209): n is a, c, g, or t
  misc_feature (249)..(249): n is a, c, g, or t
  misc_feature (262)..(262): n is a, c, g, or t
  misc_feature (277)..(277): n is a, c, g, or t
tgttttgaganagtctggctctgttccccccggctggattgcagtggcccgatctcaatctcggcctcccgggtcccaagtgatcctcctgcctcagcctctggagtaaatgggatcacaggtgctggccgtcacccccaggctaacttttgtatttttagtagagacagggtttccccatgttgnccaggctgatctcgaactcctgncctcaagccatccacccctttggcctctgaaagtgagccnctgtgcccggccnggatggggtttcttnaaaagctgtagattctagcctttaggactt

SEQ ID NO: 704152 - DNA, 357 bp, Homo sapiens
  misc_feature (29)..(29): n is a, c, g, or t
  misc_feature (31)..(31): n is a, c, g, or t
  misc_feature (46)..(46): n is a, c, g, or t
  misc_feature (117)..(119): n is a, c, g, or t
  misc_feature (138)..(138): n is a, c, g, or t
  misc_feature (167)..(167): n is a, c, g, or t
  misc_feature (172)..(172): n is a, c, g, or t
  misc_feature (183)..(187): n is a, c, g, or t
  misc_feature (190)..(190): n is a, c, g, or t
  misc_feature (197)..(197): n is a, c, g, or t
  misc_feature (223)..(223): n is a, c, g, or t
  misc_feature (230)..(230): n is a, c, g, or t
  misc_feature (234)..(235): n is a, c, g, or t
  misc_feature (237)..(237): n is a, c, g, or t
  misc_feature (242)..(242): n is a, c, g, or t
  misc_feature (246)..(246): n is a, c, g, or t
  misc_feature (248)..(248): n is a, c, g, or t
  misc_feature (284)..(284): n is a, c, g, or t
  misc_feature (292)..(292): n is a, c, g, or t
  misc_feature (318)..(319): n is a, c, g, or t
  misc_feature (321)..(321): n is a, c, g, or t
  misc_feature (350)..(351): n is a, c, g, or t
cagagatgttgtaagtattgcacttaatncncacctatttctcaanagtgttagtttttggctagcattttctttaccactatcttgttgatagctttttgttctctaaggttgaannntgacagtgcttatctcaangagattacccatctgcagaactaaggaangcaanttatgtatgannnnnggncttgaantcgtcattctcaacctttgaattaangcttagnctanngngtaanatancntgggaaggattttggttttgtgatatttctgtgaantaaggaanagatgttaaccattattttgtacaanngngatttgtatgtggttaattataaataaanntgtacc

SEQ ID NO: 704153 - DNA, 435 bp, Homo sapiens
atggattgtgaatcacttaagagtagaaaccttatctaattgtaggaatggggggcaatactttaatggatgatcatgccactacctaggtattatggtattgttatagtaccatatcagttaattcgacaccagtgaccattctggtttgaactgaacttcagttatctattctttaatgtacaagtgtacccaggtttaatactacagctgttataccttcaacatttcctttccaggccaggcatggtggctcatgcctgtaatctcaacatcttgggaggccaaggtgggcacacattatggagctccataggcagggtaggggccaggcatggtggctcatacctgtaatccttgcactagtggggagccaaggtgagaggatcgctcgaggccaggagctcaagaccagcctgggcacacattatggag

SEQ ID NO: 704154 - DNA, 165 bp, Homo sapiens
ctttatcatcacccttacttatgagtagtgggggcggtggtggtgatggtgatgatggtggctgcgatggtgatggtggtggtggtggggtgctggtgatggtggtggatagtggtgatggtggtagtggtgatggtgatgatggtgatggtagtaattgtgctg

SEQ ID NO: 704155 - DNA, 164 bp, Homo sapiens
gctgtacgcttgtaggacgaccctacacgatccccccccgaaacccagtgttgcctcaaccggccctcgcgcagcactgtggtctagagccgccccctcatcctcacactcaaactcagagcagatggctgcctcctcttgatgtcgtgaaaattccctgcctg

SEQ ID NO: 704156 - DNA, 89 bp, Homo sapiens
gatggacgatcttaccctggtttggatcacagtttttgttcttgacttttgaatgcttgtaattaaaaatatctatttttttcctctga

SEQ ID NO: 704157 - DNA, 481 bp, Homo sapiens
  misc_feature (85)..(85): n is a, c, g, or t
  misc_feature (373)..(373): n is a, c, g, or t
ccagtttgcttggacacatcagagccaacaatccccatggcaacccccaatatctgcctttttttcaaaagcttggagagtcatngacacccatcccctgtgacgggcccacggatggcggccccttccgctggcagccctccacaatgatgagcttctgctgaggagaggtcctggcaaagacgatctctgtgtggtaccgcaagatgtcatccagctcctcggaggtcatgtccttcaggtcactgccgtggaccacacaggccttggcatcttctggggttcacctggttcactggaatgttgaggcgggcagcaatgtcttccacagtctcattgccttctgagataatgcctacccccttggcaatgntttcgctgtgattggatggtctcctgtaaccatgatgaccttaatcccagcgctgcggcatttgcccacagcatcggggacagcagctcggggagggtcaatcatgga

SEQ ID NO: 704158 - DNA, 357 bp, Homo sapiens
  misc_feature (59)..(59): n is a, c, g, or t
  misc_feature (72)..(72): n is a, c, g, or t
  misc_feature (199)..(199): n is a, c, g, or t
  misc_feature (245)..(245): n is a, c, g, or t
atctatgtcttcaatttttagtcaaagtttataatcttcaataaacacatctctcaccncctcggctaaatntactcctaagtatttcctatgttattgtaaatgggattgttattcccatttctctttatgatagctcattattaatgtgtagaaatacaagtgatttctgtattttgatttcgtgacctacaaattngtttatcagctctaacagacttctgtggtggagctttcagggtttnctgcatattagatcgcgtcaccagcaaacagagatacttccacttctcttctcatatatgatgtctttagctcattctcggctaaaatgctctcgggtaggattccaagcgc

SEQ ID NO: 704159 - DNA, 95 bp, Homo sapiens
tcaagcttctaacgatgtacggggacatgatgtttacaaaatatctggtattttcgcctatatggccattaaaaaaactagatttgtggataaca

SEQ ID NO: 704160 - DNA, 420 bp, Homo sapiens
  misc_feature (1)..(1): n is a, c, g, or t
naaatccacagacccatcctggcgcctctgaaacaccagccagccgcccccctcggtgtccatgtcacaaaagtctggaagggccctgccctcaggtaggcacagatggtcacagccgctcaaggtggcgccctggctcaacagctcccgccagtttctggggccttcctggcaccgaaccaggttcactggatctcctggctcacccttggggcccttcttgcctggtggtccaggtggcccttgaggacctggggctcccttctccccaggacttcctgagagctccgggacaactgggcaggagcacactctttgctggcttccagttccctgggtcctggacatctggggtgttcctgggtcctcagacagacaggccccacaagcaggagaagccacagagagcacaggatccac

SEQ ID NO: 704161 - DNA, 293 bp, Homo sapiens
gtgaacacctgcaggcttgcccagtataccatagagcggtatttcaccttagtcaccagcatcgcagactacgagacagtgaaattacactatttaggtctatacagtcagagcttcggacgaatgttctgtatttcatttgggaaacctacgatgccttccactttcctggtggagttgtcctgggtatcattttggatctctctcgattcaatccctgcaagaacctgcattgaggacaacaaaggtaatgtagaagaagtcagtattactaatatcatcaacagctccat

SEQ ID NO: 704162 - DNA, 1775 bp, Homo sapiens
caagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttttttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacat

SEQ ID NO: 704163 - DNA, 110 bp, Homo sapiens
cctgcggaggctaagacgggaggatctcttgagcgcaagaggccaaggccgcagcgagccctgatcgtgccactggactccagcctgcgaaacaaagcaagatcctatct

SEQ ID NO: 704164 - DNA, 121 bp, Homo sapiens
tcacatgacatctgcctacgacaaacagacgtaaaatcgctcattgcatactcttctacatccaaatgatcacttggcttcgaaggcaagtgttgttggatgtgaagtgaagtatgtagta

SEQ ID NO: 704165 - DNA, 476 bp, Homo sapiens
gttacagaagaaaagggagaagggagaaaaaaatagagaaaagagggaattattttaataaaatttgaatttatgccatgtctttagcttgaaaaactattctgagattttttttgcaggcttttttttttaaaagctaaaattctaaatagaaaactcctccctatctgcagattaataattaaggataatttgtaacttttcacaaggaaactttagacctggcttggacctgtgtttaggacaagagagccgaggagggagagctgtgtttttcgctaatcatatatttagcgttgcgggggttggggggggcgtttaaaaatacttctgggataaaatatatttttctaagtaatttccaagcgcaggaaagccgcgccgagggcatcaggcctccgcgggtctcggcgagcgggccggaaagcctcggtccttttcgggaggagtggaaccgggtccacacgccgttttcg

SEQ ID NO: 704166 - DNA, 290 bp, Homo sapiens
tacacacatgtaattgctcctaccatgatctcatacttcctgccagcatctcatcactccttccaacagtctcatgccatcttccaacatctcatcactccttccaacatctcatgcctccttccaacatctcatcactccttccaacatctcatgccgccttccaacatctcattcctccttccaacatctcatcgctccttccaacatctcatgcctccttccaacatctcatccctccttccaacatctcatggcgttggcttgccatgattatgagatgtaggagg

SEQ ID NO: 704167 - DNA, 217 bp, Homo sapiens
  misc_feature (20)..(20): n is a, c, g, or t
  misc_feature (62)..(62): n is a, c, g, or t
  misc_feature (69)..(69): n is a, c, g, or t
  misc_feature (83)..(83): n is a, c, g, or t
  misc_feature (93)..(93): n is a, c, g, or t
aaatatgcaacaggggaaantacagtttttttagataccaagaagttgcctataatcaagangaaagtnaggaagttggaagntcagaacgantatgattcccgcagcctttggaaggttgtcactttcaacttaaaattcagagacattgatgcagcaactgaggcaaagcacaggcttgaggaaagacaaagagcagaagcccgagaaaggaagg

SEQ ID NO: 704168 - DNA, 213 bp, Homo sapiens
ttacatacattacttactaccacatattatcttatacccagagagagaaagggcggggaggagtccatcaacagaagatacagtctatagatctaagaagaaccatcttgattaactctgcttgatatacacctagtggtaagtgatgcagtaactcatcttactgtggggttgcgcactcacacaattcctgaaagccttccatacatgaag

SEQ ID NO: 704169 - DNA, 173 bp, Homo sapiens
gtgtccgaggctaggaaacagatctaggacctgttgaaattcgcatcctccacttctatcaaaataggagccacacaaagatctaaaaagagtgctgactgcccagatccagaacagaggtacttaacaccttagttttccagtttagttatcaaagcgtgagagcaccacca

SEQ ID NO: 704170 - DNA, 295 bp, Homo sapiens
agcttaccttagctcggtgtatgtgtggaatgtgacgatacattcccagaacagtagcagatagattatcgctccataggattggccctcagccaaattcggccagcattatattcactgtgggttggggagctaattttaagcatgttcaggcagctcccctccagtttcagtgcctgttaaaatttatcaaaaacacttcctaggggttttcttaagggataaaggccttttaaaagtacccttccccacatgtggtagaatgtgctcttctatattctcctctaagtgtttc

SEQ ID NO: 704171 - DNA, 958 bp, Homo sapiens
  misc_feature (822)..(822): n is a, c, g, or t
taggtctacaagacgctacttcccctatcatagaagagcttatcacctttcatgatcacgccctcataatcatttccttatctgcttcctagtcctgtatgcccttttcctaacacttcacaacagagaactaaggtaataacttaacatcgtcagacgcctcaggaaaatagaaaccgtctgaactatgcctgcccgccaatcatccttagtccttcatcgccctcccattcctgtactgcatccttttacataacaggacgaggtcagggatcccggcccttacatcaaatctagtgtgggcacccaagtggacttgtgcctctgagtagcaaccgatgtacgcgggcggaatcttctactaactacttaattaacttccccccaatttaatacccctagaaagcggggtgaccttgcgattccttgacagttagaccacccgagatagtaattcccggatggaagccccatttgtatcaataattggaattcacaaatagcgtctttgcacttgaatgaagctgacccaaaatcatggctaataacacgcgatggcactctcccgggaggttaaaccggaacattatcagcgcaaccagcaacggggctataactacggtaatgctctcgggagactcgggagcagaccacagtgcagggcaattggactacgaataagtgccgctaacaaatgtggaaagcgcgcccgtattgaccctaaggcacccggtctaagtcctgtagaggtaaaaaacagagacaaaacaacgtggggcgcggccccgaagtaacacacggggggccggccccaataagcancgcacggcacaagacgcgaagcgggcgccccacaaaccgggacacggcggacacaggacgggtgaacacagcgcacacgccagggagcgagagacggcgcgaaccaggggagaggcgcgcagcagcaaagcacaca

SEQ ID NO: 704172 - DNA, 838 bp, Homo sapiens
aactacttcggctaggtacgaggcctggttcgaatgcggcggtgaagacctgaacccaaggcgatgtggccgagctgcatgctgcgctggcggtcaatatcagcgcagcgcgtggtctgcaggacgtgctaaggaccagcctggccccaagtgtccaccatgaagatgctcgtttctggcgctggatcacatcaaacttactaaagacggtaatgtgctgcttcacggaatagtgcaaattcaactacccaacagttccttactagcagaggtatcaacagcccagtgatgatataatcgtggtgatggtacgacttctaatgtcctaatcattgggagagctgctgaaacaggcggatctctagatttctgaaggccttcatcctagaataatcacgtgaaggatttgaagcctgcaacagggaaaaggcccttcagtttttgtgaagaagtcaaagtaatgcagatgagatggtaccaggtgagagatcacttataggatgtgtcccagcaatcgatctcttcgtactaaagttcatgctgaacttgcgagatgtcttaacagaggcctgtaggtgtgactccattttggccattaataaagcaagatgaacctattgatctcttcatgattgagatcatggagaatgtacacgtaaatctgaaactgatacaagcttaatcagagggcttgtttcggaccacggagcaccggcatcctgatatccgaacaggggttgccggatgcctagatctcacttgtaacgtgtcattagacgtattggacacccgcagtgaactctggcgtttcacacagagtgtccaaagacagaaaacc

SEQ ID NO: 704173 - DNA, 308 bp, Homo sapiens
  misc_feature (41)..(41): n is a, c, g, or t
ggggagtccgggcaggggacttttgggggttggggccatgnttagctttttggccccccccccaaaaaaagtgggggtcaggttttttttgccccttcccagcacaagcagaaagactccagtgggtccattgtcccctcctgccctggggacctgcttgcctttttcaactgccccccctcccctggggtgggcccctcacccccagtggaaggggccgggatttgcccttcctcccctttcccctacctggacccctaacctggccttagactgagctttatttaaaaataaaatcgtggtggtga

SEQ ID NO: 704174 - DNA, 167 bp, Homo sapiens
caccgcactgcttggtgagtggcagagttttagtctcaaaaaaagaaaagacattatcatgttgagtcatcaaattcactgttactgaaattctttgctaaacctggaggcataacaaatttagtctttttgtcttagaccaaaacctgtaaggttctttggtaggt

SEQ ID NO: 704175 - DNA, 255 bp, Homo sapiens
atgaatccttctcttctcttctcttctttctcttctctctcttctttctttctttctttctttctttctttctttctttctttctttctttccttctctttctttctttcatttttttgagacagagtttcgctcttctcacccagtttggagtgcaatggtgcaatctcggctcgctgcagcctccaccttctgggttcgggcgattctcctgcctcagcctcctgagtagctgggaccggagatgcacacctt

SEQ ID NO: 704176 - DNA, 1199 bp, Homo sapiens
  misc_feature (961)..(961): n is a, c, g, or t
agcggagcgtggcccggggaggccgaggacggaggcggaggcccggacgccctgggtcggaagtcccttgttcccctaagctacgtgcgctcgcgcccggtcaggtcggcgacgccgctccgatggggagagggacaagacctgggccaagacaagagaagcgtgctgagctataaaagggcttacaccagcaagcgggaaccctttgctcgccctagtcgcagtgggtagctctgagcaaagctgcgctcgtgttatcagaccgaccaatcgacgcaccttccccgtccgcctctgttgtgccttgatgcacgatacctcgtggtgacgaatgtcgctgatatgcatgatctccgtgtgtccgtggtccggctgaaccgtgggctatcgtagggtttacgctcgaacgtcagggcctgtgttgcatggggctgggaccacggaggagcgaggaccgaccgtgcggacttcgctgtccgggggctaggacgattgtgccgggacccggacgacacatccttaccagtcggatgtgcagcgttggacacggaaaccgccggatgggatctgaaacgctaaggcttgtcatttctaaaggaatagggctgggaggagggtcgtctcgtaaacggcagttcagcagggcgtccgagtctaatccggtgggcggagtaccatcgtcttagagttggtggaacggacccttaggaggggaacggccagagagaaagaatgctgacgtggagccttgtaaacgccggagcaaaccccgggtgttttgttgcaagcgcaataaacctgtgctgggggagctcctacctccttaggggccctcttgggaaaacccggatttgttaggctttgatgtgctttttccttgttctctccctaattttcccgaggcaggccggaaccggaaacgggtttccccttgggcgagtgggttctaactctaagaagngtcttaacccggagggtgcctccagttgagcttgaccgaaggcaaaccgggatccggccctttggcaatgggggaacggttaatttccgggtttacaagggaactcttggaatggttggatgttggtttagagttgagaattttaacacatgggcttttgtggtcttccatcttggggatatataactttacaaggttgtgcaaagatggtgttgacattgttggctgtttgggaggg

SEQ ID NO: 704177 - DNA, 710 bp, Homo sapiens
  misc_feature (44)..(44): n is a, c, g, or t
  misc_feature (82)..(83): n is a, c, g, or t
  misc_feature (86)..(86): n is a, c, g, or t
  misc_feature (102)..(102): n is a, c, g, or t
  misc_feature (115)..(116): n is a, c, g, or t
  misc_feature (122)..(123): n is a, c, g, or t
  misc_feature (125)..(125): n is a, c, g, or t
  misc_feature (129)..(131): n is a, c, g, or t
  misc_feature (166)..(166): n is a, c, g, or t
  misc_feature (178)..(178): n is a, c, g, or t
  misc_feature (180)..(180): n is a, c, g, or t
  misc_feature (204)..(204): n is a, c, g, or t
  misc_feature (219)..(219): n is a, c, g, or t
  misc_feature (245)..(245): n is a, c, g, or t
  misc_feature (247)..(247): n is a, c, g, or t
  misc_feature (249)..(249): n is a, c, g, or t
  misc_feature (282)..(282): n is a, c, g, or t
  misc_feature (285)..(285): n is a, c, g, or t
  misc_feature (287)..(287): n is a, c, g, or t
  misc_feature (289)..(289): n is a, c, g, or t
  misc_feature (306)..(306): n is a, c, g, or t
  misc_feature (321)..(321): n is a, c, g, or t
  misc_feature (342)..(342): n is a, c, g, or t
  misc_feature (354)..(354): n is a, c, g, or t
  misc_feature (362)..(362): n is a, c, g, or t
  misc_feature (364)..(364): n is a, c, g, or t
  misc_feature (368)..(368): n is a, c, g, or t
  misc_feature (400)..(400): n is a, c, g, or t
  misc_feature (406)..(406): n is a, c, g, or t
  misc_feature (408)..(408): n is a, c, g, or t
  misc_feature (411)..(411): n is a, c, g, or t
  misc_feature (423)..(423): n is a, c, g, or t
  misc_feature (446)..(446): n is a, c, g, or t
  misc_feature (474)..(474): n is a, c, g, or t
  misc_feature (549)..(550): n is a, c, g, or t
gaaaaaataaaaaatgaaaaaaaaaacctcccatcccccttagngccttctaaaccttccggcctgattttattcgacagcnnttntggccagggcaagganctgtggtgggggnngtttgnngnaggnnntcctttcccacagatgaggcctagggctgcaaaanggccccgtgaananaggagaaggtgacagggatccttntcctccccatatggngtgatgtggtcaaggctttatgggtntntncacctcaaagagaaagtgccctagggtagtgtnctntnangaggggccacgcctatntgcagagggcctctntgggaccaaagcagggcagtntccctcctcctnaaacccantntttntttttggtggtttattaactacagggtttgcncaagtncnagntacaataatttnacaataagatttttttgtaaaanaggtagaggtttgcaccacgagtttggnttcaggggaatctggtgagaaggtacgtgctgtggggcgatgggtgtgccacagcaagaccaggacagagttggnnttttcctccatcacgtggaaggcattcagcctaaactcctggtgagaggccagccagggttgagaaataaatagagggaccttagagccccggcagagctgagggaagagcagcaccagccctggacccccactctccctcctcagtccttcatggaagg

SEQ ID NO: 704178 - DNA, 412 bp, Homo sapiens
caccaaggaccagtttccatgtatttgtggggggaagtttcagtatgattcaagtgcattacatttattgtgtacttcatttctattgatatgaacattttaatatataatgaaatcattatacaactcaccataatgtagaatcagtgggagccctgagcttgttttcctgcaactagataatcccatctccgggtggtgggagacagtgacagatcatcaggcattggattctcataaggagcacacaacctagatcccttccacatgcagttcacaatagggttggtgctcctatgagaatctaatgccactgctgatctgacaggagacagagctcaggtggtaacgctagccatggggagcagctgtaaatacagatgaagcttcactcgctagcccactgctcacc

SEQ ID NO: 704179 - DNA, 225 bp, Homo sapiens
  misc_feature (82)..(82): n is a, c, g, or t
atttagtgataaagaagcatttaaaatcgcatgcagaaaacattgaaatactaagggacaagaaggaatttttcaacaaacnggaaaacacataaagctcttagatacaaaaattaacttcataagtgtaatagttatgtttgtttatctatattttaacatgatcccaagaaaaataccaagaggatttgtatactagataagctgattcaaaagtttgtagga

SEQ ID NO: 704180 - DNA, 204 bp, Homo sapiens
  misc_feature (55)..(55): n is a, c, g, or t
  misc_feature (107)..(107): n is a, c, g, or t
  misc_feature (137)..(137): n is a, c, g, or t
  misc_feature (160)..(160): n is a, c, g, or t
  misc_feature (174)..(174): n is a, c, g, or t
  misc_feature (190)..(190): n is a, c, g, or t
gaaacgggtggggggaaaaaaaaaaaaatgtggtgtgtccatacaatggactaanccatccaccaacataaaggaattactgatgcctactacagaatgataacccncagaaacattatgttaagtgaaaaaaaggnagataaaaaaattacatgtggantggccccatttatntgaaattcctagagtnccacctttcctaaa

SEQ ID NO: 704181 - DNA, 836 bp, Homo sapiens
  misc_feature (16)..(16): n is a, c, g, or t
  misc_feature (66)..(66): n is a, c, g, or t
  misc_feature (83)..(83): n is a, c, g, or t
  misc_feature (100)..(101): n is a, c, g, or t
  misc_feature (122)..(122): n is a, c, g, or t
  misc_feature (132)..(132): n is a, c, g, or t
  misc_feature (142)..(142): n is a, c, g, or t
  misc_feature (164)..(164): n is a, c, g, or t
  misc_feature (231)..(231): n is a, c, g, or t
  misc_feature (692)..(692): n is a, c, g, or t
  misc_feature (758)..(758): n is a, c, g, or t
  misc_feature (789)..(789): n is a, c, g, or t
  misc_feature (791)..(791): n is a, c, g, or t
  misc_feature (794)..(794): n is a, c, g, or t
  misc_feature (802)..(802): n is a, c, g, or t
tcaaactcttctcgtntctgagtatctagtctactgttggttgagcttcttggcagtacatcagtnccaactagaagtgggtnatagatagattaccagnnatgcagtggtgtttaggcagnataggtcttnactggccctnactgctgttaattattggcagnagtgctccccagatcccagaaggtccctgctggagtgtttccagtgcacctgtagggaaccaactanacttctctcctggttagtccagctctttactctaaaccctttctgtccaaaattagtcattttcagttgtaccttagatgtctggtgttgaggaacaagtgccatagcctttattcagggggcctataaacccttccagttcttgccccagggctggcctgtagcgcttcaaattcccaggtgtccctaatttgagaagtaaccttttggaatagcattagaccctggctgtcccctccccaccaaataaacatgatatttcattctctgtccaggagtcatgaaccccttcacctccaatgacctgatcatttagtttggtgggggtgggggtgggggtgggggtgggggtggaagcagccgcaggagcaagggcccctcccacatacacaggaggagtatttcatttctccttaatgaaggctctggccctaacccctcagcactgtctccagataggnacatgcacaaagcagttaattaggcagcctggagaaaaccagagatccagtacagaaaggaaaggntatttattgattaacagaagttgtctttttnanagngtttattnttggcaatcaacgaccacaacactaatctcacac

SEQ ID NO: 704182 - DNA, 216 bp, Homo sapiens
  misc_feature (202)..(202): n is a, c, g, or t
  misc_feature (211)..(211): n is a, c, g, or t
ctagaggatctccgtcgacggtaccaacacattggagacttgttagaagcttggcagcttgggttggcgcatcctccttggcggtgtctcggtacctgcaggcagagccggcttggggcccagcacctggagcatcgcctcgggctcaggggccttactcagacacgtgcactcgggcccggccactccgctcgttgccccnggatgcccnttgga

SEQ ID NO: 704183 - DNA, 1064 bp, Homo sapiens
tctttataaccctttaaagaactcacaatttattgggaaaaaacaaaaaacccacaacccaaagggagtgggatttcacatctcaagaaaatttctcccgagggtaatacgctcttccacgaatttacaaatctcatttccaataaaaaaatatttctggcgtccaaatctttacaccatgtgttattctcagggcagcgcggagacattctatatctccaactccgcgtgtgttctctatatttctctaacatgagggggggcacacacgcgtatagcggagacacgaggagaacacacaacacgtttgtggggcatcatatataacccatatattgtggcacacggcacagaacggtaacaaaccatgtgcaccacacaggcgcgcaaacaacccctctaagcccctctctaccatcatcatatctcctctaaccaatcctccacaataacgactgctgagggtattctccctctttctccttactaaaacaaaacacaaaaacacaacacacaacacacaaacaaaaacccacgaggcgcggcgcgccccgcccaccaacacacaagagacaccccccgcgccgagcgggggcgcccccccacaagacatcaaacagccggagaaatcacacacacaagacgcctcatcactgcgagacgacaacaaacgacgggcgcgacccccccacaaaaagaccagagagaacacacgcaaatacctataaatacacgcgacacacgacacccacacgtgcgccgcccgcagccagatcacacacacacaccacccgcggtgggccgcatacgaggggagaacacccgcgcgcgcggccccacccgggagggagaaaaacacactctgaggcacagaaaaacggagaagcacgcacccactcccaacccctccctagcgcggagaggggagagacggacgaccaccaacaacacaaacgaggggcgaaccaccacaaaccacacacaacaacgcaacaacagagagacacaataccatacaaacgcaccgccccaccactaacggggggcaaaccaaaacaaacaaa

SEQ ID NO: 704184 - DNA, 758 bp, Homo sapiens
ggacgcgtgggtcgacccacgcgtcggctctgctgtccttaagccctcgtgggttttttttttaagagagtctcgttctgtcacccaggctggagtgcagtggtgcggtcttggctcacttcaacctctgcctcccgggttcggacaattctcctgcctcggcctcctgagtagctgggattacaggcgcctgccaccatgccatggttggttattggtgttttggtggagatggggttttaccatgtggttggccaggctggtctcaaactcctgacctcaggtggtgatctgcccgcctcggctcccaaaatgctgggattgcaggcgttaaccaatatagttccgtctaagacgcctctgcttgtgttcgagaactcttgtcaagggctctgtctgaatgagttaccatctgattgtggggaccaagtccctgagtagagggccaagagctagggacagggggaagagactggcccaggtggtagggaggaaagaactcccagagtttcctttagccaggaaactgtctagtgaccccgtgacttggacagtcagacatcaccctgagagtgacaagtgtaaaagtgactcccttcctccccgccctcggaagtatataagatacttgaaagcagtccttgctaaaatgggcttacctatgttggctgaacgattagaagaaagaactcagaagtacaagggacaagaaaagagtcagggaatgaggctttcctgaatagactattaccactggg

SEQ ID NO: 704185 - DNA, 547 bp, Homo sapiens
tctggatgaagtgtctaagaaataggtacagactctgatacaagcatctataaaagattcctgcagccaagttggaaaaagaggatgccccatagcgaaggttcttctgtccaatctctacgaataatgatagcagaaatgaactatacccatgaacatcacataccattggttgtcagatttttgcaagcctaaagcagtctgcctaattgttaatcaagtagaaccttgcagtaaacagcacttgattgaatagatctggttacatggttcacatctgaaaatcagttgtggtccccatggaaagcctcatctgtctgcatacaggcatcatagtattacagtttgtggtgcatttgctcagctccacagcagtctagggaggtggcggtttgcagatgcctgggcagtaggtttcttacagaaacaacaactttcccaagctaaataacctactggtggcagtgctctagaaaggaccgcgagaaaaagaagtgctatggcatatctatcaagcaccgccttgagtgacacttagcatccagag

SEQ ID NO: 704186 - DNA, 154 bp, Homo sapiens
cttctgggacggtgactcagaatctttggttgaggcctttttttctttcttcttcttttcttttttttctttgtctttttttctcttgtcggatttcttcttctccttcttgatccacacacacacatccacacacacatacacagtatgcatg

SEQ ID NO: 704187 - DNA, 271 bp, Homo sapiens
  misc_feature (220)..(220): n is a, c, g, or t
ccccctggtcacgcctgtaatacccagcacttcaggaggccaaggcgcacggatcacctgaggtcaccagtgccccctctgttgtgatacctcaggatccgtggtactatttctataatgactgatcatttggtgtctgtattagtcaaggttctccggagaaacagaaccaataggatgtgtgtatacctctatcactatgtacacacagagaaagaanttgacgatgaggggacggaacgaaatttcctcctttccttttttttttttt

SEQ ID NO: 704188 - DNA, 380 bp, Homo sapiens
  misc_feature (360)..(360): n is a, c, g, or t
gaataactgaaatgagggtaagtgaagttaagacagtctaaggttcttggtgttttgttttgttttgttttttgagatggagttttgctcttgttgcccaggctggagtgcagtggcacgatcttggttcactgcaacctccacctcctgggttcaagcgattctcctgcctcagcctcccaagtagctgggactgcaggtgcatgccaccacgcccagctaatttttgtatttttagtagagacagggtttctccatgttaggctggtctcaaactcctgacctcacgtgatctgcctgcctcagccttccaaagtgctggcattacaggcatgaaccactgtgcctggcctcttatanatttttgagctctacagagc

SEQ ID NO: 704189 - DNA, 443 bp, Homo sapiens
  misc_feature (166)..(166): n is a, c, g, or t
acgacggtatcgacagggttgaagaagaccatgttccaatactggaggtctgacatgatcattccaagataccccggtcagtcgttcaactcaggcgtcctccggctgtacccgtatgtcatactagcagttccgtgtcattggcatccagcgaggttgggagcangacaacaccagcctcccgttccgaggctctaccgtaaccagtgtgtagcaccccccgagtccaactcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgag

SEQ ID NO: 704190 - DNA, 165 bp, Homo sapiens
aaggcttggcacagattagttgccggtcgctggaccgttgtgacaacagacggagggaaggcaacgctctggatgccgcgtccctcagagccaatccaggacgtctctaaacaagctcttcccctggggactttagacggagagttgtcaacgatggacacctgg

SEQ ID NO: 704191 - DNA, 1546 bp, Homo sapiens
  misc_feature (278)..(278): n is a, c, g, or t
  misc_feature (343)..(343): n is a, c, g, or t
  misc_feature (424)..(424): n is a, c, g, or t
  misc_feature (450)..(450): n is a, c, g, or t
  misc_feature (483)..(483): n is a, c, g, or t
  misc_feature (490)..(490): n is a, c, g, or t
  misc_feature (528)..(528): n is a, c, g, or t
  misc_feature (588)..(588): n is a, c, g, or t
  misc_feature (674)..(674): n is a, c, g, or t
  misc_feature (681)..(681): n is a, c, g, or t
  misc_feature (711)..(711): n is a, c, g, or t
  misc_feature (759)..(759): n is a, c, g, or t
  misc_feature (789)..(789): n is a, c, g, or t
  misc_feature (794)..(794): n is a, c, g, or t
  misc_feature (803)..(803): n is a, c, g, or t
  misc_feature (832)..(832): n is a, c, g, or t
  misc_feature (878)..(878): n is a, c, g, or t
  misc_feature (917)..(917): n is a, c, g, or t
  misc_feature (922)..(922): n is a, c, g, or t
  misc_feature (979)..(979): n is a, c, g, or t
  misc_feature (1021)..(1021): n is a, c, g, or t
  misc_feature (1026)..(1026): n is a, c, g, or t
  misc_feature (1058)..(1058): n is a, c, g, or t
  misc_feature (1089)..(1089): n is a, c, g, or t
  misc_feature (1113)..(1113): n is a, c, g, or t
  misc_feature (1152)..(1152): n is a, c, g, or t
  misc_feature (1202)..(1202): n is a, c, g, or t
  misc_feature (1254)..(1254): n is a, c, g, or t
  misc_feature (1426)..(1426): n is a, c, g, or t
  misc_feature (1546)..(1546): n is a, c, g, or t
agtctagttatgattactaaagatcaagccatgctatgtctaactatgcgactggctgagtaccttttgtaattgtgcgcgactgggcgtcatgccaatgttaatgtactaggttccattttggtattcagctcgtctccttactacttagtgtgtgacttaactcgatatgcgttgaagttaatacgaatgactgtaactaagggtagtcacggcagcgagagcggtcaatgcacgccacgcataatcggccagccgggtgcgcgaggaatggcggnatagctcactaggtgagtccaatgcattgctacgcaaaagctagatgtgtcaggtgcccgaagtnactcgcgttgcattcacagtgcccctcactgtgtcactgtgagcgtgatcccagtgagacggtctcatgagatagtgcctnttctaggtaggttggacctatcggtnatcgaatgtaaagtcccttcatgagtcgcgccnagcgatnctcgcaaagcttgctctacgcactcctgattggaggcncggcgaaggaacagggatcactccgaaatgtccgtggcatcaccttgtgatctccgcgcnccatataatacgaagatcattgtctacctcgccacttgggctcaatactactcgacacgtggtatgtgactataagttccgaaccnagtgttncgcactcagaacacgaggggtgtgcaccgngatgaatgtagacctttcatggtgggctcttcctagggcattgctccntagagaaaatgatcagggcgcataggcacngtagntacgaatanacaactcgtgagcttacttgcgaggtaanatacaccatgatggagtacaaccgtggcattacgttccatgagacntgtccagtcgtacaaacgtgttataggcctcagacggtntcacntcttgaactctctctggtgttagaacctgttggtacggattcgtccgctaacataanttagagtacccaccttactcgatacaagagagaagtcctccnttaangtaccggctaaagatccccggtagggtatacnttcttgcgttaactaagagcggattccaaancgggtgaaacaggaggtccctctnttatcattcgtgatgcaggaagtcactaacatattgcgnagggagaggcccagccgatccatgcggtttctcccacacagggaagagcncacgactagtggatgcacctataccctcatggacgtgttcccaaacagaatngtacggctagcaacgctcacaaaccagtagctaggtctgagcacgagaggacctacacaaagcagggccgcgagacacacctggtgtaatcaatatcggcggggacaagagcaagtgagcacggcggaaccacacgacacggcaaggggcggcgacatgcgacacaggaggngggcattctcatcggcgaagagagagcgttcttgagggcagagcaccccatgcagtagtgatgccacccacccacaagcaagtatatcacagggcgtgtgagcgcataccagcactcacn

SEQ ID NO: 704192 - DNA, 271 bp, Homo sapiens
gcattgcgcacgaggaaaatagtcggcagatttatagcgtcagaggggaacacctaccgacgctgccgacagcctcgcgttgtctaagatagaattttagctttaactccaacctttgcccaagaaaactctaacatcccttgtcaacttcaatgcttagtcaaagaggaacagctttttgagactaggaaccacctctctagagagagtaaaaacttccaaaccacctagtcaggctaaaagcagcaccaattaggacagcctcacgcta

SEQ ID NO: 704193 - DNA, 136 bp, Homo sapiens
gcaatggctctgttggaaaaactgcaatcagaaagaatgatttgagaaagaaagaaaaactatggtgtaatttaaactctgggcagctctgaatgaaatgctactttcttatagaaatataataggttgccttaag

SEQ ID NO: 704194 - DNA, 827 bp, Homo sapiens
  misc_feature (164)..(164): n is a, c, g, or t
  misc_feature (364)..(364): n is a, c, g, or t
gtctactttgctgacgactgactaatcacctagcagccgggagactgttatgaggagatgcagtctggacccgtggatgtctcaatgtggtcctgtggcgtgacctgtgtgggcgtgcctgcgattgctgatggggcccttcaggtacaggatcggccgggtangtggggcttcccaccacgagcactgggagcccagcgagggcccgttccctggtgggatgatggctgggatttgccggtggtgccctggtcctcgacgtagttagatagaggctccaactgcccaagttgtggattccaccgcgtccccggggggcacaacctggggagtagcagatcgttctgaagccaacttgtgtggnactaccctaaggtagcctttggagtcccacgggcctggcaactgtcactcgcggtacttggatgtggcatgtactcggtacagttagaaaaatccaatgtactgaaatgcaagtgatgggagactagactgcaggcgtgctagggggcccgagcgcgcctcgagaccacatgcaaatttgacggtgtgcactgtggcaggaccctcaaacaccgaataataacccaacgcaatctttttttgtcaagggcgatcatgaacccattgtggtgggggaagcgtggaagctcgctccaagggggcattgacccacgcgaggttgttggggtttattcccaaaaaggtcccatgaatctccctttctggggaggccccaatgagaacgtaggggctcccttgtcttgcgcccgcttctcaagggggggcaagggggccaaatgggctccccttgcttgcttgtaatc

SEQ ID NO: 704195 - DNA, 529 bp, Homo sapiens
ccggtgtcagagaggaagaagagacaaaaagaaacaaaacaaagagcacatgcaaacgacagaaagacagatgagatcagagagcagagacaaagacacacaatacgacaaacataccaaggaagacaaaagaatagtgaaagaaaaaagagaagaaaacacacaagacaacagcgaaacacaaagaacaaaaatgaaaagaaaagaaagcgcacaaaagacaaaaacacaaaaacaagaaccagaaacaccactgaaacagaagaaacaacaaaaaacaaaaacaaaccaaaaaaaagacacaaaagaaacacacacgatggacaccacacacaaaatacacggcaacagaacaacaagaaacaaaagaagaataacgcagaacaaaaaaaaagaagaacaaaagaaaacaaagaacgacaccacaaaaagaaaaagaaacacaaaaaaacacacaacaaacacaaactaacatgacaacactcaacaagaagaacacatcaccactggcgaagaaacaagacaagac

SEQ ID NO: 704196 - DNA, 125 bp, Homo sapiens
agtagtaaccgttccggctctattatcttcttacccttttctacaactttttcatctccatctgacatttgaggtcagttatttaccagttgccctattctacaaagtttaagccatagctatta

SEQ ID NO: 704197 - DNA, 408 bp, Homo sapiens
aatgatcttaaatgacgagtgaagatgatcatggggcatgtgccacagtaaagaactaaaatgaaatgaaaaagccatgactcctcacttaatgcgattaaaaaaaaatctgatgtggtaaattaacgccacatatcatagtgtaattgggtaatcaaagttcgggggaattcaggttctcatgggcaccctaatagtgtgtagggcagggggtcctgagaatgatggccgagtcgtagaagatgtgcatactgtgggctagtgatagggtaggagcccaaatcgtcacacatagtcggccctctctctctctctatctctctctctctctctctctctctctctatctctctctctctctctctctctatctactactctctctctctctctctactactactactc

SEQ ID NO: 704198 - DNA, 457 bp, Homo sapiens
ctcaggatggagtacagcggtcctatcatggctcattatagcctcaaactcccaggctacaagcaatcctaccatgtcagccttcccagtagctgggactacaggtaagcatcgtgacactcagtgaactttcgtttatattttgtagtagagatagggacctcagtatgttgccgcggctgaccttaaaactcatagcactcaagggatatttcctagccctaggactcccaaagtattggtattacaggcatgagccatagtgcccaccgtctctggttctataaccttctgacctccctctataccagttttaaagaatgcttgtaattacatgggctctcctagatactccaggataatcttgttttaaggtcagctgatgagcaacattaattttctctgcactcttaattcccccttcctatgtaattgtgctgtgtcacataggacatga

SEQ ID NO: 704199 - DNA, 836 bp, Homo sapiens
  misc_feature (707)..(707): n is a, c, g, or t
tgggtgccttaaccaagcgtcttttaattttctaaaatcggaaaaccccctgtcccacagttactgctgctgacccctttcaaggtgactcagtgaggagggagaaaagcggaagcggggtgggaagagtgcggggtctgggccagcttgcttgcctccgtgcttctcctctcccctccttcgtggccctcataggctttcccatggagttggtttttggagaccctgcgcacagtgtcgctcgtggaagcgctgtgcgaagggcaagggcgcgtctttggacaccttgcgccagtgtgctcgtgggggctgtgccaggacaagggggagctcctcgtgtcccccgtgcgcacaacacagacagataggcttggatccacccaggtggggcggctcgggttgccaggccagtgctatacttccgcctgtgttttgcagcccgaggccagctggtttgcaaggttgcaggactatgccctcaggggtcagggtgcacaacacccctgacatgtcatcggggcctccggggtagctcctggaagggcccaatatgtggcctgattggagctgccgaggcgtggaagcttctgggaacaagggaccccctccctagggggaggaaggtgctttggaacgctgtggccattgttcaggcggaccaaaaaaccgggccagggcaggagcaccccctataccgtgaacagganaagggccgccgacagagagtataaaaacgacgccactacacacagaggattttcagacacaaccgggttttgcccccgtggtgggggcgaggagaacaccccttaggaaaaccacgcagctacagaata

SEQ ID NO: 704200 - DNA, 536 bp, Homo sapiens
tacttttccgggggatatatgagtggctcttattggagcagggatgtgctctggaatattaagccacctctgatgacatgtgtcctggtgctctgtgatcaagatgcctgttgtgtatgtgaagtgtattatggtggctcatcttgttctctctttttaaatttatttcaaggcacaagccctttgtgatggaggatgtctagcttgaacatgctggtaatgtgacactatcctcagctccccttggccctgggttcataggaggcaagtgtttctaaatttctcgcccagtgagttgttgcatgttatttttaaccattaatattgtgtgtctattggaatgagaaacagaaggttgaatgggaaatagattcagtgacaagcagacaaaaagcttggttctgagaaatgttcttcactgagttgaaaaaaaaataatctagaaacaaagaagagggaaattggggtagaatggtttggtggtgaagagacgatgacacccacattcagatgctctggtgtattccctcagagat

SEQ ID NO: 704201 - DNA, 270 bp, Homo sapiens
tgttacctgacagtcggcctgccagagcattactgtgtgctccttctcttctcagagccttgccgtgagcgtccgccctccgccagagcattaccgtgtgagctccgcctcccgtcctctcatcaccgtgtgagctccgcctcctgtccgtgcatttccgtgtgagctccgtctccacgtcacagcattacggtgtgagctccgattcctgtcagagcattaaagtgtgagctccgcctcccgacagagcataaacgaatgagctcagcc

SEQ ID NO: 704202 - DNA, 889 bp, Homo sapiens
taacccctcccttaagtctttatgcgcggcagaaaccaaattaaaccccccccccttgtaaagggggggcagggaaaaaagaaaaaacgcaaaaaaccacctcgggaaacccccactgttctcgtgccccccggccattttattccgcccttgattgggattttggtatccaattcttgctcccttgtggctcgggtgtggagttgatgggtggacgccctcctgtggggggcgcacttgtgccagttgacgcccccttggtgaaaattcacgagggtgcgagtggacaagaggcaccaggtgtccgcagccgcgggtcctctccggggagcacagtgggggtgtggtctcccacagaatagtctccgtgagaggggagcgaaagcgggcgaggcgatgtggagccgaggggctccctcacctcgagggtgtacccagaggaggagtgtgcccccgtggaagagtcacccagaggagaggggggagcaccaagtggtaagaggcacgtgaagagatgtctgccgcggataggtggtatatagggggcttctcccgcgcggtgtctgtttacatcccgagagatggggttctccccatacgcggcgcgtgtggggcccggggtggggcaccggccttatccgccgaacatctagttatgggtctacgtggtgtgtgttttggaagccccaccacgatgcagggatgaacgtctgcgctgagtgtttgagccccattcgcgaactccatgtgtttcgtttggtgccccctcgggaaccccaacggtgcttctgctgttttcgccatcgagacagcacacaaccgggggccctaagagttcgcgcaagggctctcgcttgtgggagtgtcatctggcccacttgtgcccccg

SEQ ID NO: 704203 - DNA, 1288 bp, Homo sapiens
  misc_feature (695)..(695): n is a, c, g, or t
  misc_feature (701)..(701): n is a, c, g, or t
agctgtgtgtgatatctcttcatggcgtcaagtttatatctcttggtggtgaacatttcttccggtggacgatgccttggggatgtcttctccctgccggtcacgagtatagtagcgaatcacacgtgttgccccaccctagttgtgttatctagacaggtgtgctacccactggcaccgttgagagagtcatgccttatgattgcccgccatggctgccacagttttggagaacagggtcagttcggctccagccaattgcaagccgtgcgtacttccaggaggaagctaccatggtataccagtcatggacagtatctactaatgacttgtgggactcaaaacccagataatacttttgagcccaaaattgtaaatacagcaattgggagatgctgtaaagtctgcaactcacacgaacagcaaggattgctttaaaacacaaatgcccagagtttccattttcagaaaagtgatggtcagggtatgtctaaaacatctgtagagcctgggtgggcagatcacttgagatcaggagtttgagtcgtttggcaaacatggtgaaaccctgtctccaccaaaaatacaaaactagccaggcatgacggcaggtgcctgcaatcccagctacttaggaggctgaggcaggagaatcgcctgaaacctggaagtgaacagggagacaagcactgcanacaaanactttttaatggctttagtttttttttattttttacaaatatactggagaatcatgcaatgctgccagcattggatgcaatccggggccacaagtctgcacactcctttgctactggtcctgtaatggcagaacctttcatctcgcctttattgttcactatgactcctgcattatcttcaaaataaagaaacacgccatcttttctacggtatgactttcgttgtcgaatgaccactgctggatgtaccttttttctgagctctggtttgcctttcttgactgtggccatcaccatgtcacccacaccagcagcgggaagtctgttcagccgtcccttgatccccttcacggagatgatatacaggtttttggctcctgtgttgtcagcacaattgattacagctcctaccggaagacccaaggaaatccggaatttcgcaccagaggacccaccacgtcctcgcttcgacatctgggaccgaattcgcaagctgggccgaccagtgcacgggtctccagggcttctgggttttccacagcttgggggggggaacgggttcggggttcacctcgctgctctggaac

SEQ ID NO: 704204 - DNA, 964 bp, Homo sapiens
  misc_feature (504)..(504): n is a, c, g, or t
  misc_feature (507)..(507): n is a, c, g, or t
taacaggcttcgcctgtgcttcctgttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaattctgggacnacnatacataatagatagaaacgaggaaccccgcgggcatctcaagtcgaggcggcgggcaaaaatggcgtgtgagtagagatgtggaccacttgggccaatgagcggagttgccctggaaccgcaagagttacctttggtcccacagtgggtgaaatctggccggagctcccataatgaggagagtcggtataaaatgcggcgataaaagcccgagggttcaccccggcgtgttagtgagaccggcgggaaaaccggccacttgtgagggagggtaatacccaccggcgtgaacccaatcagaccaaatagtccattggaccgcgcccggggatttcacagactttcagttaacaaacgatgcaagccctgggcttttgaaaacaacgccatgctgtgtgcccactgcacagacacatctcaatcccagcttcgtacgacgccgagaagggtgtatacc

SEQ ID NO: 704205 - DNA, 140 bp, Homo sapiens
gcatttgataactagaatcgaaataaatatgtacacgtggggcaaagacgagctataatatagcacataacagagaattccagaaatatctgattcggcaagcaccttgtttctgttgttcccaccaagcttgagggctg

SEQ ID NO: 704206 - DNA, 1353 bp, Homo sapiens
  misc_feature (45)..(46): n is a, c, g, or t
  misc_feature (60)..(60): n is a, c, g, or t
  misc_feature (893)..(893): n is a, c, g, or t
  misc_feature (896)..(896): n is a, c, g, or t
tacacgcacgtcatcgtatactttcgttgtcgaatgaccactgcnngatgtacctttttnctgagctctggtttgcctttcttgactgtgcacactcctttgctactggtcctgtaatggcagaacctttcatctcgcctttattgttcactatgactcctgcattatcttcaaaataaagaaacacgccatcttttctacggtatgactttcgttgtcgaatgaccactgctggatgtaccttttttctgagctctggtttgcctttcttgactgtggccatcaccatgtcacccacaccagcagcgggaagtctgttcagccgtcccttgatccccttcacggagatgatatacaggtttttggctcctgtgttgtcagcacaattgattacagctcctaccggaagacccaaggaaatccggaatttcgcaccagaggacccaccacgtcctcgcttcgacatctaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaattctgggacnacnatacataatagatagaaacgaggaaccccgcgggcatctcaagtcgaggcggcgggcaaaaatggcgtgtgagtagagatgtggaccacttgggccaatgagcggagttgccctggaaccgcaagagttacctttggtcccacagtgggtgaaatctggccggagctcccataatgaggagagtcggtataaaatgcggcgataaaagcccgagggttcaccccggcgtgttagtgagaccggcgggaaaaccggccacttgtgagggagggtaatacccaccggcgtgaacccaatcagaccaaatagtccattggaccgcgcccggggatttcacagactttcagttaacaaacgatgcaagccctgggcttttgaaaacaacgccatgctgtgtgcccactgcacagacacatctcaatcccagcttcgtacgacgccgagaagggtgtatacc

SEQ ID NO: 704207 - DNA, 1706 bp, Homo sapiens
  misc_feature (530)..(530): n is a, c, g, or t
ccgctaccctcacagctcccgtcccgttacctgcctcctgggcggcctcgctgcctattcaccgtgcaccttgtcgtcggtacgcgccgatgggtgcctgctacctgcgcgcgtcgcacgcccctggtggctttcggcctccgggaacgggggtacgcagcccaggctttccgtgcaccgtgatggcccgctcagagccaaggcgctggccggcaagtaggggtagcactaactctactacccgagcgccaaaaaacgagtagaatgtagctaccggcgggaacggggagtacaggcggccacactggagacaatagccggatggcacacaaaacagggcgtaaacaatcacgcacaaatatggcaataggtggtttagggacgagcggatacattcccaagttggtctatgtgagtacgcgttcaccaagaaggttggtaaatatcacgatagaaggcacttgagaaacccagggtatgaaaggagacaagtggccaccagtattgtataaataccgtaggatacgatnagaaggagttggggaaccatattggcgacagtggcgagaagggaggaagatagattatgagcacgaatagggagttaagcatggtgtaggctcagaagaaattaagtacgttgtccccgtggaaagtaagttcagagtcgaaaaagatggattatcaagaagatgacggcacataacccagaggggggcaagtgtgtccaaagtgcgcataaagcgaggaaaaatggagccattataaagacaagaggggagtttggctccatacacgtgagggggggacatataatttgggcaatcgtgccgacaaagagaatttggtgaaccgcacaattcttggaaacaggcaagcagtgtatcacctataaaagagtagtaaagtgagtgttggggtgacgaaaacgaagatacaatagtgcatgatgtggggatagtgtagaaacaccacaaatgtggtaggaaatgaggggacgttgtggaaagagtcagatgtggaccatagtgacagagtgagacagcaagagggggataaagggtcatggtacggtggtaaatcgtacattggcacactttgctagtggccacccaacaactcgggagggagaacagtggcacatggcaaacccgattggtgctgtgcccactaattagaagagcgaaaggtgtggcacatacacacctaagagtggggcagcacaattattattggggacacacgaaggtgctaggtgccactgagacaacagcgacaccaatcaaagggcaggacacagtataccagcgtagtgtcgtaccatcaaagagggggaccccacagtagcgcacaaaaaaagcagcagcaaaatcatctgcgacaggcggcagtggcacccgggcggcaacaggaccagcccagaggaggctccacaagggggggcacatcaaaggtgggtggagcgcgcacagcgcgcaccagtagcgaggaacagcacagagcaagtaggggcagaaagccaccagtcgtacacatagagcaagcaagtggtgcccctacaaggtgacaaagagcctcacaacaacaggagagaggaaaaactcctgaacaaccgactggccagcgagggtgcaagtcagacagaccgctaccacaagaaggtcgatagagcctggaagaactcacaccagtgtagacagaagtag

SEQ ID NO: 704208 - DNA, 796 bp, Homo sapiens
taacaggcttcgcctgtgcttcctgttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaactctgagaacaatcaaactaacatcttgatccaagacattaaactaaaataacacacactacgacaaagcacctagcaatagcaccccccagatgaacactacatatacaaactgtgtgcacaaaggaaacaatataaattcacatatcggccgtctgaacccgagcaactaccaaaaagcccaattgctaatatcattagagcaaccagagggacaacaaacaagagaccaataaacaacgaacaagccgatgaaccttatataaaaaaaaaaaccattaacaaccattccccagaataat

SEQ ID NO: 704209 - DNA, 387 bp, Homo sapiens
gagcagagtcagaggaggttgggaagcatggcgactgtggggggaagggaggcagccgggaagccacaaaagcctacagcaggccgggcgggcgcggtggctcgcgcctgtaatcccagcactctgggaggccgaggcgggtggatcacgaggtcaggagctccagaccatcccggctaacagggtgaaagcccgtctctaggaaaaatagaacaaagtagccgggcgtggtggcgggcgcctgtaggcccagctactcgggaggctgaggccggggaatggcgtgggcccgggaggcggagcttgcggtgagccgagatggcgccactgcactccagcctgggcgacagggcgagactccgtctggaagaaaaggaaagaaacagc

SEQ ID NO: 704210 - DNA, 1287 bp, Homo sapiens
  misc_feature (827)..(827): n is a, c, g, or t
  misc_feature (830)..(830): n is a, c, g, or t
tgagatggagtctcgctctgtcacccaggctggagtgcagtggcgcgatctcagctcactgcaacttatgcctcccaggttcaagcaattctcctgcattatcttcaaaataaagaaacacgccatcttttctacggtatgactttcgttgtcgaatgaccactgctggatgtaccttttttctgagctctggtttgcctttcttgactgtggccatcaccatgtcacccacaccagcagcgggaagtctgttcagccgtcccttgatccccttcacggagatgatatacaggtttttggctcctgtgttgtcagcacaattgattacagctcctaccggaagacccaaggaaatccggaatttcgcaccagaggacccaccacgtcctcgcttcgacatctaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaattctgggacnacnatacataatagatagaaacgaggaaccccgcgggcatctcaagtcgaggcggcgggcaaaaatggcgtgtgagtagagatgtggaccacttgggccaatgagcggagttgccctggaaccgcaagagttacctttggtcccacagtgggtgaaatctggccggagctcccataatgaggagagtcggtataaaatgcggcgataaaagcccgagggttcaccccggcgtgttagtgagaccggcgggaaaaccggccacttgtgagggagggtaatacccaccggcgtgaacccaatcagaccaaatagtccattggaccgcgcccggggatttcacagactttcagttaacaaacgatgcaagccctgggcttttgaaaacaacgccatgctgtgtgcccactgcacagacacatctcaatcccagcttcgtacgacgccgagaagggtgtatacc

SEQ ID NO: 704211 - DNA, 1297 bp, Homo sapiens
  misc_feature (695)..(695): n is a, c, g, or t
  misc_feature (701)..(701): n is a, c, g, or t
agctgtgtgtgatatctcttcatggcgtcaagtttatatctcttggtggtgaacatttcttccggtggacgatgccttggggatgtcttctccctgccggtcacgagtatagtagcgaatcacacgtgttgccccaccctagttgtgttatctagacaggtgtgctacccactggcaccgttgagagagtcatgccttatgattgcccgccatggctgccacagttttggagaacagggtcagttcggctccagccaattgcaagccgtgcgtacttccaggaggaagctaccatggtataccagtcatggacagtatctactaatgacttgtgggactcaaaacccagataatacttttgagcccaaaattgtaaatacagcaattgggagatgctgtaaagtctgcaactcacacgaacagcaaggattgctttaaaacacaaatgcccagagtttccattttcagaaaagtgatggtcagggtatgtctaaaacatctgtagagcctgggtgggcagatcacttgagatcaggagtttgagtcgtttggcaaacatggtgaaaccctgtctccaccaaaaatacaaaactagccaggcatgacggcaggtgcctgcaatcccagctacttaggaggctgaggcaggagaatcgcctgaaacctggaagtgaacagggagacaagcactgcanacaaanactttttaatggctttagtttttttttattttttacaaatatactggagaatcatgcaatgctgccagcattggatgcaatccggggccacaagtctgcacactcctttgctactggtcctgtaatggcagaacctttcatctcgcctttattgttcactatgactcctgcattatcttcaaaataaagaaacacgccatcttttctacggtatgactttcgttgtcgaatgaccactgctggatgtaccttttttctgagctctggtttgcctttcttgactgtggccatcaccatgtcacccacaccagcagcgggaagtctgttcagccgtcccttgatccccattccatgtgcccaggtgttctcaattgttcaattcacacctatgagtgagaatatgcggtgtttggttctattcatccttagtagatagtttagcctgagaatgatggtttccagcttcatccatgtccgatacaaaggacactgaactcatcctttcttatggctgcatagtattccatggtgtatatgtgccacattttcttaatccagtctatcattgcatggacatttgggttggttccaagtct

SEQ ID NO: 704212 - DNA, 223 bp, Homo sapiens
  misc_feature (21)..(21): n is a, c, g, or t
  misc_feature (38)..(38): n is a, c, g, or t
tccgcgggcggcccctgcccncctcccctccctccccnccctgcaactccattttgtctgaccagggcagaagatggattagagcacccactagtcctctctcttccaagcaagaaggaccacccctgagctgttttccagctggacatgcctggacctgtattccacctcctctctaaaatgcaccttatttttcttcattaaattgtgttacttaaccctt

SEQ ID NO: 704213 - DNA, 278 bp, Homo sapiens
ggtcgacctggttgctggggggtgctgacgagattagcactagtaaagaaacactgggccgggcaaagtggctcatgcctgtattcccagcactttgggagattaaggcgggcagatcacttgaggtcaggagttcaagaccagcctggccaacatggagaaaccccgcctctactaaaagtacaaaaattagtcaggcgtggtggtgcacacctgtaatcccagctactcaggaggctgaggccgcagaatcgcttgaacctgagaggtggaggttg

SEQ ID NO: 704214 - DNA, 1200 bp, Homo sapiens
  misc_feature (740)..(740): n is a, c, g, or t
  misc_feature (743)..(743): n is a, c, g, or t
ctctatcaagagagaggagaaacacggcaactttactatggatagttgacttgcggggtcgcatctgaacactgctgggtgtaacttgaaagctgcgcgcggggtgagcctcttatagacgagcggccagcatgctgtcacccacaccagcagcgggaagtctgttcagccgtcccttgatccccttcacggagatgatatacaggtttttggctcctgtgttgtcagcacaattgattacagctcctaccggaagacccaaggaaatccggaatttcgcaccagaggacccaccacgtcctcgcttcgacatctaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaattctgggacnacnatacataatagatagaaacgaggaaccccgcgggcatctcaagtcgaggcggcgggcaaaaatggcgtgtgagtagagatgtggaccacttgggccaatgagcggagttgccctggaaccgcaagagttacctttggtcccacagtgggtgaaatctggccggagctcccataatgaggagagtcggtataaaatgcggcgataaaagcccgagggttcaccccggcgtgttagtgagaccggcgggaaaaccggccacttgtgagggagggtaatacccaccggcgtgaacccaatcagaccaaatagtccattggaccgcgcccggggatttcacagactttcagttaacaaacgatgcaagccctgggcttttgaaaacaacgccatgctgtgtgcccactgcacagacacatctcaatcccagcttcgtacgacgccgagaagggtgtatacc

SEQ ID NO: 704215 - DNA, 204 bp, Homo sapiens
ttaaaacacgcatctcacctctgctggtatgggacagaatgatggcctcagcaggaccacccaacaagaggcagcagcacaagtcaccacctcctcagagaaagcacaaggacacccaacagtgatgcatccccctcctcctcaaggaaggccacaagggacatcccaacagtgagtgcatccccgtactacttcgagaaaggc

SEQ ID NO: 704216 - DNA, 990 bp, Homo sapiens
  misc_feature (24)..(25): n is a, c, g, or t
  misc_feature (78)..(78): n is a, c, g, or t
  misc_feature (86)..(86): n is a, c, g, or t
  misc_feature (89)..(89): n is a, c, g, or t
  misc_feature (530)..(530): n is a, c, g, or t
  misc_feature (533)..(533): n is a, c, g, or t
gagagagagagagagagaggagannaggagagagaggagagagagagagagagagagagagagagagagagagagagngagagagngangcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaattctgggacnacnatacataatagatagaaacgaggaaccccgcgggcatctcaagtcgaggcggcgggcaaaaatggcgtgtgagtagagatgtggaccacttgggccaatgagcggagttgccctggaaccgcaagagttacctttggtcccacagtgggtgaaatctggccggagctcccataatgaggagagtcggtataaaatgcggcgataaaagcccgagggttcaccccggcgtgttagtgagaccggcgggaaaaccggccacttgtgagggagggtaatacccaccggcgtgaacccaatcagaccaaatagtccattggaccgcgcccggggatttcacagactttcagttaacaaacgatgcaagccctgggcttttgaaaacaacgccatgctgtgtgcccactgcacagacacatctcaatcccagcttcgtacgacgccgagaagggtgtatacc

SEQ ID NO: 704217 - DNA, 476 bp, Homo sapiens
  misc_feature (23)..(23): n is a, c, g, or t
  misc_feature (105)..(105): n is a, c, g, or t
  misc_feature (140)..(140): n is a, c, g, or t
  misc_feature (427)..(427): n is a, c, g, or t
gttccctggaatcctgtctggtncccttttttttttgatggattctttctgatcaaatatcactggtcctgagtgggtgtggtggttcagccttagtccccagcnactcaggaggcagaggcagaggggccagagagagnggcagagagagaggcagagagacagaggcagagacaggtagatatccttgagtacagcctggtctacagatcaagttccaggaccgccagggctacacaaagaaaccctgtattgaagaagaagaaaaaaattccactggtcctgaaacaaaaccatggatatcattgtgttcatacagagagcaagtctgggtgggcccaagggtttcagctgcatttgtatgtatggatctaaacaaatgtatatttttcaagatgattttgcagaagttctattttaaatgttnatcaataaattcatattcatttaataaatgaaaataaatggtttctaaa

SEQ ID NO: 704218 - DNA, 115 bp, Homo sapiens
ggttgatgaaataccagggtgaaatgggctaaaccataagtgcccctttagtttttcggcagagtgcctactaaaggtttactccaatacccccccctcttgctcagcctatata

SEQ ID NO: 704219 - DNA, 413 bp, Homo sapiens
aatttggggtttggggggagtattatgtttaactggggttgtcaagtatgagtccctcaggaaaaaaaaaaaattttgttttaaaaagccatctggtttttagctcttggaactattggtacttaaatttcccataattaaaaatttaaaatttttaaattaggattgcccatacttttccctttgagaagggtttttttagaaatccctttagtaaagtcccccaggccttagttttacctttaaacttttttctttaaaacatgggtttggggggtaacttttacccagttttgaggactgttaatatttggaaaggatcttgagatatcagtggaaagctaaaccgtttaaattaacatgaaggacttccttttgattgggaaaataaaatcagattttttcaaagtcca

SEQ ID NO: 704220 - DNA, 668 bp, Homo sapiens
tgccccatgctgactccttgcttctttccagccggagccgctgccttgccccccggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttctta

SEQ ID NO: 704221 - DNA, 769 bp, Homo sapiens
  misc_feature (688)..(688): n is a, c, g, or t
tgccccatgctgactccttgcttctttccagccggagccgctgccttgccccccggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttcttaaaaaaaaaacaacacaaaanaaatctttgggggggccgcccccaaaaactttaaacactcgtgtgggcgcggccccaagggtaagaccaggggccagcggc

SEQ ID NO: 704222 - DNA, 295 bp, Homo sapiens
aaaggaaccaggaacccaatcgcaactccccttgtgtcacctctctccagcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttctta

SEQ ID NO: 704223 - DNA, 848 bp, Homo sapiens
atttaggcggtgacagacagcatccgcagtcaataggaagaagctgaagaattctttaggtctcccaaaatggcctttgctcaggccatgccctccgcccagcacatctgctcctccacctgcacctgactccctggccctcgtgaagccactcccatactcctagacagggctgctgcgccctccacttctgggctcctgaccagctctgccggagccgctgccttgccccccggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttctta

SEQ ID NO: 704224 - DNA, 566 bp, Homo sapiens
  misc_feature (53)..(53): n is a, c, g, or t
  misc_feature (69)..(69): n is a, c, g, or t
  misc_feature (109)..(110): n is a, c, g, or t
  misc_feature (113)..(113): n is a, c, g, or t
  misc_feature (140)..(140): n is a, c, g, or t
  misc_feature (145)..(145): n is a, c, g, or t
  misc_feature (197)..(198): n is a, c, g, or t
  misc_feature (200)..(201): n is a, c, g, or t
  misc_feature (214)..(214): n is a, c, g, or t
  misc_feature (219)..(219): n is a, c, g, or t
  misc_feature (227)..(227): n is a, c, g, or t
  misc_feature (243)..(243): n is a, c, g, or t
  misc_feature (245)..(245): n is a, c, g, or t
  misc_feature (249)..(249): n is a, c, g, or t
  misc_feature (285)..(285): n is a, c, g, or t
  misc_feature (348)..(348): n is a, c, g, or t
  misc_feature (350)..(350): n is a, c, g, or t
  misc_feature (396)..(396): n is a, c, g, or t
  misc_feature (432)..(432): n is a, c, g, or t
  misc_feature (507)..(507): n is a, c, g, or t
  misc_feature (517)..(517): n is a, c, g, or t
  misc_feature (519)..(519): n is a, c, g, or t
  misc_feature (526)..(526): n is a, c, g, or t
  misc_feature (530)..(530): n is a, c, g, or t
  misc_feature (554)..(554): n is a, c, g, or t
ggccacagagaatggtatattacagatttacacacatgaagagaaggtcagancgcactgcaggcagcncggctctgggaagaacttcacggagccccttcttagagcnnggngggggctttctcagtgaaatgtttggntttcngctgcctcctctgccccaggcccccctccagggtcccgcctatcccagattnntnngtgcaccaggggnccggncgccagcnccgccgacccctcccngngtgncgcccttgttcactgacaaagagacctgtcccaggngtgtcctccaccgagccggtcagctgtgggtggttttcctgttacgacgctcagttgcctgtngngataacaaactcgtggctatgtttgctgatgctgtgttctcattgnttaactgttcctgcacttttacagacaaatcttcgncaaaaaaaaagatcaactttttttttccgaacaacaaaaaaaaatgaatgattacaataggaaagggaaaaattnaatagctacntntcatttncaantttttgttcttcaaaaaattcctnccaatttctctg

SEQ ID NO: 704225 - DNA, 282 bp, Homo sapiens
  misc_feature (66)..(66): n is a, c, g, or t
  misc_feature (73)..(73): n is a, c, g, or t
  misc_feature (227)..(227): n is a, c, g, or t
  misc_feature (232)..(232): n is a, c, g, or t
  misc_feature (265)..(265): n is a, c, g, or t
atgccaccaatgtgggtgatgaaggtggcttcgacccaacatcctggagaacaatgagggtcagtnctgagcncctgggggcaagacccctggctctccacatgggcaggggaggctgcagacaaggggcactggagtctcaggtcctttcttggtcctcccccagccctggagctgctgaagacggccatccaggggggcttgttacccagacaaggttgtgatcngcatngatgttggcagcatctgagttctattcgcaatngggaagtacgatcttta

SEQ ID NO: 704226 - DNA, 630 bp, Homo sapiens
  misc_feature (561)..(561): n is a, c, g, or t
  misc_feature (571)..(571): n is a, c, g, or t
tgccccatgctgactccttgcttctttccagccggagccgctgccttgccccccggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacattcttgcatggttccgggagagccagtntgccaaattntgagatcacaattcggtttttagcactgtttgggcttatatgtatcactctgtaggaaa

SEQ ID NO: 704227 - DNA, 656 bp, Homo sapiens
agatcccttagacctcagggcagcctcaccctttgaaagaaagtagctggtttccagtccaacaaaaagttaaaaggatgctcatctctttctcggcatcactgatggaaaacagactgtgtgatggcctaaaggatccaatcaatgtgaagaatgaggagttggatgccatgatgaaggaagccagcggtcccatcaacttcaccgtcttcctgaccatgttcggggagaagctcaagggtgagtggagtgtcctgggtccaaggccccggctgccttttcccagacccttcagggacccatcagcttcatgtgccctctgacccccacaggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttctta

SEQ ID NO: 704228 - DNA, 141 bp, Homo sapiens
ggagagtgctggcgaatgctggttctgtgggccttgcaccacatcgtcaggattgtgacgggctgcatcacagattgtgggagccctctgctatgctgcactcggggtcaccatcccctaatctggaggtgactactccta

SEQ ID NO: 704229 - DNA, 393 bp, Homo sapiens
cgcagaaaggctgtagtgcgtacacctgttcaatgagatcatagtcgactcttgacgagcgtctctacaggagcccacgttcagaggcgtgtagaagatcacagacacatatggaggacgtacactggcaactgtagggcttaacgtggcctctaaggcacgagaaccaagaactggagcggcagcatgcgccacattggtggcaaggtggagttcaacatagccctgatgagtaagctggacgggattaacaggcacttctttaacttctttcggcttcgcgtgggcatataaccatgggcctgtgaatgctggagtgaatggggcccgcctcagaatgaaatatggggaaacactgtgaatgtggccaggccaatgggcctgtggcttggg

SEQ ID NO: 704230 - DNA, 81 bp, Homo sapiens
gatcggttcggttactatggttcggggaattattatggtcctgactactggggccagggaaccctggtcgccgtctcctca

SEQ ID NO: 704231 - DNA, 248 bp, Homo sapiens
ggtcaggggcccatgggagcgcccgaggtaagccacgatgagagtccctgagccggtactcgcggagcttggggacgagccgcccaccgggccccggtgccacgctcccgccctaaggaggccggcctcgacacaccacgccggccgcgactgccactagagcgaccgggggcgccaagctcggacggaattgggcccagctgaccaggccgacaggtaaggcaaccgctgggcattacagggtgacg

SEQ ID NO: 704232 - DNA, 641 bp, Homo sapiens
ctctgccacgcgtctttcctgcacttcgcccgcgtactactcctgccccgccctgcatacctctcccctatcatgtctctggaccctcctgtaggccgcagctctactccctcacaggtctctctgtcctggcctcaccgctatcctattcctctccctagccctgtgtctgtatcaagccccctcgggtggagtagtgtggacagaaatgcggctcaccccaaagcagaacttctcaatccatgaggacaatggggaggcctttaggccagcccacatgtgacaatggagggctgcggcttccttgcggagagcacaagtgagctcactgccctggactccaggaatcagagttctggccgccggggtgacccagctcctctgctaccatgaatagggcccctctgaagcggtccagtgatcctgcacatggcgctgaccggggcctcagacccctctgcagaggcagaggccaacggggagaagccctatactgctgcgggcattgcagatcgcgctggtggtctccctctactgggtcactccatctccactggtgttccttaataagtacctgctggacagccctccctgaggctggacaccccatctacgacaccttctaccagtgcctggtgacc

SEQ ID NO: 704233 - DNA, 779 bp, Homo sapiens
tggggaaaaaagccggggccgggggcaagagcctaccccaaaaaaaagggtgtctaaaatgttcacggtcccttctttggcctcaaaaagtgcacatttatctcaaagaaaaaaaaagtgcacaagaagtgtccactcccttgtggcccccctttcccctcccccctctcgtgcgtgcctcctctcaagcccccagaagaattgaacccctgtggctgtggggcgtgggcgtgcgcgagaaacagacgcgccctctcagagagagtgagagagtctccaagacacacacactatgtgagagaggcgcaatattctctctctcacaagagtggagagaggagtgtgtgtgtgtcagaaagaagagtgtcctctcacagaagtgtgtctctcgaaagagaaagtctccctctctgtgtgtgctctatttctcattcggatgttgtgtcgcaccccgatgtgtggtgttatcatttcgacgcgccacacaacacctcctcttttttaacggcgacgccccacaaaaccacccgcggtcggtccccagccgcctctgccgacgaagccgcggagaaagatttctgctgtggatggtggggacatcaatcattatgaagttgtttatgtttcatccccgccggtgttggtatgtgggggagatgggggggaaaaagaagggggtggcacccaatgattaacaggtgttgataaagaactggatgatacacccttcattaataagaagagaaaaaacacaccccctgttggggcttgttgggaac

SEQ ID NO: 704234 - DNA, 559 bp, Homo sapiens
  misc_feature (306)..(306): n is a, c, g, or t
  misc_feature (369)..(369): n is a, c, g, or t
  misc_feature (398)..(398): n is a, c, g, or t
  misc_feature (504)..(504): n is a, c, g, or t
  misc_feature (528)..(528): n is a, c, g, or t
  misc_feature (538)..(538): n is a, c, g, or t
cttggaccctgggaatcaggccgccgaggcgtgagctccagagccgcaccatctgccacaaacagaattcgagacctacttaattttgaaattcctccttgcacggtaaataaagccaaaagcagccgggtgctaattcgtggcaacacacttcactgaacccacttggttccaaaacgaatgcaagccgaggcactgctacggcagcaagctgcaaaatgggaatggtgggctcagggggcttccctccaaggaattccttgccccttgcctgtccaaaagactccttttgtgctggaaacctgngctcctcaagctgcaagcaggagtcggtaggactgtgcctgtgcctccctcagcggggcctgngcggggttccaaggcctgcgagctggganaggacagatgaggggactcgtgccttcttgctgtcatgcaatgaccccgccttatgttgccgagataagcaactcttaggtttgcctgactgccttatgctggtanagaaaagggattcagctgtctctnttgcaaatanaaaaaaagtcaagatttcaaa

SEQ ID NO: 704235 - DNA, 784 bp, Homo sapiens
ggttcaaacgacaactcagcacaaagccttgagtataaatggctggaatcaaaacatctcattctgatgacgtggtttaatttttcaattttttttttaaataggggtgggagggagggtacttggccccaaaagggagggtgtctgcactcaggatttagaaacacttgggaagctcataacctcatcagaaacggcctttagccacactccggaccttctagatgagtacacaaaaaattgaaataagttctgggaaattaagccatttatttaaattggctattttttacaaggtctaggtatcttcacactcggtcatgggggacctcattttcccggccagatacctttatcaaacattatgggctcatgagagctgaagtaagtcagctctttggggcacttctagtggaccttctgtgagactggtcgtggtacttggtatctctaaatctaaagatagtctttaaaaatcccaaagaaaatctgtctcctttctgatctaaaaatcatctgtgggtaaagagttacgggtgtccaaaggttgccacagtccatgagcgccaacgggagctagcctgcccctggactctggcccatccacagtgaaagattccacagacaggtcttcacatctccagtagaccacgccggcacggaggggacaggggcgggacatacgaacacggcgcggactcacacggcgtgggcaagggacctgggaaacaagctacccctttggccggcaccccctctgcccacatggccaccctgcctaccg

SEQ ID NO: 704236 - DNA, 205 bp, Homo sapiens
  misc_feature (22)..(22): n is a, c, g, or t
  misc_feature (152)..(152): n is a, c, g, or t
  misc_feature (169)..(169): n is a, c, g, or t
gcaggagaacctcttgaatctnggaggaggaggttgctgtgagctgagatcgtgccactgcactccagcctgggtaacaagatagaaactccgtctcaaaaatatagatatacatgtatagactggctgaatggattaagtacaggacccanctctatgttgcctacangaaactcacttcacttgtgaggacacatatagactg

SEQ ID NO: 704237 - DNA, 485 bp, Homo sapiens
acgcacttggactcctagctctcttaaattatatagccatcttgtgatattttttaaacatagctgaccaaaggaatggaacattttacaaaatgttggtttgagctattaataaattaggcgaataaaccagcattacaatgtccatcataacctagctgaagatacctcttttgtttctgatttactgtttacaggcaggttagagtggcttggaaaaaaaaatccatttaagagagtattttggtaaggggggtctttatgaaggatccacttctgtctacattgcatccaaaagagaataaacacagttgtgaaatatgttttatgtttgccatggcttacaaaaacatttcttggtttctttataaaccatacagataaaatgaccaatcaaatcttaagtcacatctagttctgcaacaaatattatgccctgcgcctgagaactgattatttataaccctgataaaaccagttgcgtg

SEQ ID NO: 704238 - DNA, 822 bp, Homo sapiens
  misc_feature (141)..(141): n is a, c, g, or t
  misc_feature (516)..(517): n is a, c, g, or t
tctgttagtagtgcttcatactctcattgagtctgggtgacctaagcgtatcaagaaagatcttcacctgtgtccagactgctttgtcctattctttctggagcaaggtgactgttctgatactattgattccatttgaanattctacactagcctctctacaaagacactgttcaatattacgatgcaggtgctaccaagtgagacggtagttagagattggtactccagatgccttgatagtcattgctgaatctaaggcgcatgaaaggcagagttatctacagacagactgaagcgtacttgtcgcttcaatcaagacggccattgtgtagcaccttgtctctttcagtgtttcttcgcaaattcgaaggtattgggcgatctttatgcagactagcgcaagaagtacttaagtgacactactattcgcccgagaaaggcagcatctacgtagcttggactagtgaccatctacaagcgggagacgtgggaagttctctcactatacctcgnnaacttggcgcaattcgaagcctcgaggtaactagcagattgcttcagcggaaagcaaaccttggggccttaccttcggggtatagcggtgaataaccgtaggcaattaggccttcatcggcccgtcgactgtgccatttgattcgatgcgctcaaagttcaggtttgggccaacgaaatgccacttttcgatatcagggggagccctataaatgggggatctctgatccccccacacgtaaaagggcacaccatttgtggaaagagtttccaggggccccctgtgcgggaaacggggcgcaaatc

SEQ ID NO: 704239 - DNA, 214 bp, Homo sapiens
acggccgtccaaaaacatatctctagaccagacagacatgctgaatataagaccaggaatataggaagtacacatagacatttacacttcacagcgtttcaaatcgaaaatttctaaactggactatggattccaggcccccacccccccacacacaccaactattcctctcctgcatttaaataacagaagattggccatggagtaaatggca

SEQ ID NO: 704240 - DNA, 528 bp, Homo sapiens
  misc_feature (38)..(38): n is a, c, g, or t
  misc_feature (43)..(43): n is a, c, g, or t
  misc_feature (339)..(339): n is a, c, g, or t
  misc_feature (362)..(362): n is a, c, g, or t
aagcactcgaaatatcttctatatgcgcgaatccgccnccaangcgtgccgtcggactttaaatagatcagtccttttgtaacggcccatgccacgagattgttgagaacaatgtcggaaaccatgcgcggggaaagtccgtaaggccgtcgcgggccggagaaatgtggggcagaaatcgttgcttgccagcttcgagatatcgcgctccgaccagatcttcgactcgccgtaagccgtcaccggattaagttcgccggtctcggtcgatgaaatcgtcccctgccagtccgtaattgctgcacgacgaggccatgacaaagcggcgaactccggcanctttggcagtctgtgcaacatgnaactgccgcggtgattgatcgcatacgtcgtatcgcggttcagatcgctcagcggatcgttggaaagcgccgccagatgaacgacggcatcgaacccggcaagatcagcgggttcgaggtcgcggatgtctttcctgagggagggaattggaactgatgcggtcgc

SEQ ID NO: 704241 - DNA, 434 bp, Homo sapiens
aacaacgggaatacttggaacgaatcgcgaaaacgaagaaaaaaatggccgaaaacggaatcgaggttcttttgatcaccaatccggccaacatgaactacttatctggttacgacggctggtcgttttacgttgaccaaatgctcgtgttgatcattgatgaagagcagccgctttggattggccggaagatggacgcggccggcgcccgggcgacaacatggatttatcatgaaaacattatttcctatcccgacatttttgtccattcccgggaaaggcatccgatggattttgttgcagagatattaaaacaaattggccagagtcaacggcatattggcgttgaaatggaatcgtattattttaccgcgctcgtctgggaaagattaaaagccgggcttccgataccaccaaaaacaggtgaccgagct

SEQ ID NO: 704242 - DNA, 1107 bp, Homo sapiens
ggcccggcgaggtgctggagggagcggggcgcggatccgggccacatgggcatgctccgtccgcggggtcagggccgggcttcggcttcaccggcagcctctgccttgagcgggcgcctcgtgcaagttggagggctgggcctgcctgtgtgccgcagtggcctcaggagaggatgtgtggcgccactggctgcgtctaccgtccagtggtttgctctgtctgcatccttgatgtgccttcgtagcatcagttacagggtactcaagcacttcgctgcaggccgctccagatgtgcccttctgctgagtgcacaggcgtcatgcatggacttactgctgcggcacttattgcgcgcaagggctcggtctccactgttgcatgggggaccgtggtgtcgatgcgcgcgtgcctcactgacccgtgcctcgctgcgctctggctgacatggggtcctgctttgcatgcgagcgcgcaggactgtgccgctgtgtggccctgcagtggatcaagcccgtccacccgtgaagctgaggaacctctaggggacggcggtctttcgctgcgatctcgcggcctacttgggcgtatcgcagcgcggttggcgtcctgttctgagtcgacaagtatcgtataccaccgcattacgcgtagcgtcgcatcttaggctcacgcacttcagcgctaacccttggacgtcccctaggcgatactgccagctccatacgtgagtcatcacaaacccggtggccatattcttgaagatatggcccaacctcgaaaagatagccttcatggggtccaataaccttaagcgattcgaagcatcataggggacccaacggtgagtgaccccaagataacgtcaccggcgacgtcggaaatcgtcgggcagatacgcgggagagcgggcgttattcataagcgtggaccgcatagttctatatgcggcgagaggactcttggccaggttgctccacctgcactggttgaaccagtcacgcccgagcccccctggtaggagaaacatcgagcgagacttggatgcgcggtctttcccacttatacaggggccacggggcatcatctttggggggggaacttgaccg

SEQ ID NO: 704243 - DNA, 187 bp, Homo sapiens
ccccccccggggggggccccccccccctttccccccccgggggggggccccccccccggggggggggggggggggggggggggggccccccccccttttgcccaggtttttggggggggcccccctttgggggggaaaaaaagggttttttttttttttttaaaaaaaattttttttttttttttta

SEQ ID NO: 704244 - DNA, 216 bp, Homo sapiens
cagagtgtccacgacgctggatgaagtccaagcggtgcctagagcagcaggtggatggcagatgaatgacgcagctggaagacgctggaggacgatgctgcaggccaccgacagatgccaatgctgcggtatggatggtcaaccgtgcatggccagtgacaggcccatgttctgagcgtggaccctgcatgtggccggggacgatgcatgacgcaa

SEQ ID NO: 704245 - DNA, 395 bp, Homo sapiens
ggcgtatttgtagttgggtaaatcacggtgacattctgattactataaaatacataggtacctgattagaataccacgcctatttggttaaatactaacaatacaggttgctattactcttgtcttactaccaattagacatttctcagaatgctaaagcaagaaggaaccttaaaaacttatctggccgcgcccagtggctcatgcctgtaatcccagcactttgcgaggccgaggtgggcagatcacttgaggtgaggagttcaagaccagcctggccaacatggtgaattatctctactaaaaataaaaaaaaataataataatagccaggcgtggtggcacatgcctgtattcccagctgcttgggaggctgaggccatggagtaaatggc

SEQ ID NO: 704246 - DNA, 182 bp, Homo sapiens
aatgtcattgtgctaaatcctgacaaataaggagatcattgaacatgctgaaaatattaacagtcttcttaacaatgtattgaggggggcaaaaattaccaattatggtctacaaaattaagcctatcaatgtgtttcacattgcacacacggtctctcagtggtacctgctctcgaacttc

SEQ ID NO: 704247 - DNA, 474 bp, Homo sapiens
gggatccccaccaccgtgggagtatcttataaattatgtccaaacatacttttgtctttcatcatctctatgtctcatgacttgaacgaagtccttgctctttaactggaagtacagctctgtcattccctccacacgacaaagtaccacctccagacagagtgttttcaacactccatgaaattttggcagcagaaagaacacagcattcatgaacctgtctgcaagaggagggaagctcttggtcactttgttcaagcacacaataaacttgtcctccatagtattctgatgttgcttcaattgtttcgcaaccagttcacacagagactcctccagtatgtattttctctccataacatatcgaagtataagtcctagaacttctgctgcagcggcatacacttctttatatcttacaaaggacatattattcaccaaagcctggaagtattcgctactctggatgcccca

SEQ ID NO: 704248 - DNA, 718 bp, Homo sapiens
ggaaatgtccagacttttccatatctcttatatattgtttccgttagtctagtatactatagaggaacaatgtgtatagtcgtgtgttcagctgggggtctacaacaacgaagtgtatcttgtacaaacaatagtgtaagtgatttaacaatttgggtacattcatatccaggcttctgcagcttgttgattctcactgtgaatccattgttctggatcatgcataagtgtatttgcaatagcaagatatacaggtttgagtatttctgcctgattatggtgattgtttcaccatgtgtaacgtgtatcggtatgagatgtaaataatggtggacgagatactgtggatgtgaaatgtgggaagtgaattttaatcatatgtaattggtcacagagggcctaactttgcaactaatctattggctgctatttatttaaccaagtgccttgttagctttgctatgcgagttaatgtcttcggagtgtaaatggattgtgtgtctagtctcaagcaagggagccacagtatttaagactagaccaatctacgtgttacaactacttccgaggtagagcaaatgttaactacaagccttaattaacagtcggtgcaatgttggtagtaatcgatgagtcgatccgatatgtgcacttaagatttggggagtttgccgatgtcaatggggcttggcattatacggctggaatccgacaatcg

SEQ ID NO: 704249 - DNA, 104 bp, Homo sapiens
tggccctggcatttaacgccgtcgggcattcaacgcctcgggccattcaacgcctccgggccattcaacgcctccgacctccgccgggaggccattcaacgcct

SEQ ID NO: 704250 - DNA, 133 bp, Homo sapiens
ctacaacttccgagggttattgaccacgccggggcacgatcaacctgaccacgagggtctgtttcctgcgagcaaacgaagaacaagcaagaaactgagattgcaatcgggatatcgcgaatataagatgaaa

SEQ ID NO: 704251 - DNA, 339 bp, Homo sapiens
tccaagatgggtagatggaccaagagttgtcacccaggctggagtacagtggcatgatcacaatgcattgcagcctcaacctccaaggctcaagcaatcctcccaccttaacctcccgagtagctgggactagaggcacacaccaccatgcctggctaatcttcagatttcatcatagaggtggggtctcactaagttgtccaggctggtcttgaactcctgggctcaagcgatcagcccgtcttggcctcccaaagtgctgggattacaggcatgagccaccacgcccagcctccctctttttccttctctagggaagaggtccatctgacccatctt

SEQ ID NO: 704252 - DNA, 349 bp, Homo sapiens
acacttcctgccctttccagcccgccatctgtgactccttccctctgagccaacatctgggtcctgccttcgacaccacccccaaggcttcctaccttgcgtgccttgagtctgccccaggtgcccttctcctgggccatggccctgaccgcggtcctggggcctggccagctggcccctgtggccatctctgctctatcttggattactccgcgtcggggacagcgagcggcaggtgcacgaagccccctgcgctgtggccccccaagccacgcatcacatgtagccccactgcagtcgcccgtccctgcccctgccgcttccccatcacctatcaaggcctccctgt

SEQ ID NO: 704253 - DNA, 408 bp, Homo sapiens
aagatccccactcttgcccctatgctgtaatgaacatgtagtgcagtatctcttttatgtgtgatttattatcatttcctttggcatatatacccggtttttgtgattgctgggtccataatatagaccatcgaaatccttctaattttaaattgagattaaaggaattgtatattagtttacaaaatccactctgatgaccaaaggaatttcttggagctattaggaaggagatggactttttcttacgttttgtttcttttaaatgtatagttttacccttttcccccatacctcttatgtccacagtctggtaaagtgacctgttctcacactaagacagggctggacaccaaccaaactttgacttatactgactaagggcaagggaattaggaagtcactatg

SEQ ID NO: 704254 - DNA, 85 bp, Homo sapiens
  misc_feature (17)..(17): n is a, c, g, or t
  misc_feature (19)..(19): n is a, c, g, or t
ggcacgagcggcacgananatgctccacccggccctgctcagaggataccttctggtacagggcttcatcttcatcttcatcact

SEQ ID NO: 704255 - DNA, 334 bp, Homo sapiens
  misc_feature (258)..(258): n is a, c, g, or t
ccccaattcagggtttttcaccccctggggggggggggggttcccccccccccccgggggccgggaaaaagggggaacaaagggggaagggggggcggcctttccccccccccccccctttttccctggggggggttttaaaaagggggttttgttggggttgggccctaacccagggggcggggcccccctttttttgggggtttttcccttttgggggcgggggggggggggggcccctaatttttggggccccanccccttccccccccccccccccaaaaaaaaaccctttgggggggggggggggggaaaaaatttttcccccttttga

SEQ ID NO: 704256 - DNA, 336 bp, Homo sapiens
ccctttggtacagggggaagtccacccccgggtggcggcggctccaaacgaggacttggccggtgatgatgaaaatgatgcagaacatgaaaatacccttgataacagacctaacttcgatggcccatttgcaaaacggccaaaaaccccgttttaacaaaagccttcatgccctttaaaaaatggctgttgtacccttattgtccccctaggccatttaaggaagacttatgctctaatttggaaaaagcatttgtgttgttctcctgggccaattttgtcaaaaaaaaaactggtttttctgtttctaccaaaaatagtaaaggcttagaaata

SEQ ID NO: 704257 - DNA, 387 bp, Homo sapiens
  misc_feature (8)..(8): n is a, c, g, or t
  misc_feature (12)..(12): n is a, c, g, or t
  misc_feature (24)..(24): n is a, c, g, or t
  misc_feature (26)..(26): n is a, c, g, or t
  misc_feature (28)..(28): n is a, c, g, or t
  misc_feature (31)..(31): n is a, c, g, or t
  misc_feature (35)..(35): n is a, c, g, or t
  misc_feature (37)..(38): n is a, c, g, or t
  misc_feature (65)..(65): n is a, c, g, or t
  misc_feature (71)..(72): n is a, c, g, or t
  misc_feature (83)..(83): n is a, c, g, or t
  misc_feature (86)..(90): n is a, c, g, or t
  misc_feature (93)..(93): n is a, c, g, or t
  misc_feature (113)..(113): n is a, c, g, or t
  misc_feature (126)..(126): n is a, c, g, or t
  misc_feature (136)..(136): n is a, c, g, or t
  misc_feature (187)..(187): n is a, c, g, or t
  misc_feature (230)..(230): n is a, c, g, or t
  misc_feature (239)..(239): n is a, c, g, or t
  misc_feature (241)..(241): n is a, c, g, or t
  misc_feature (244)..(244): n is a, c, g, or t
  misc_feature (268)..(272): n is a, c, g, or t
  misc_feature (274)..(275): n is a, c, g, or t
  misc_feature (279)..(279): n is a, c, g, or t
  misc_feature (298)..(298): n is a, c, g, or t
  misc_feature (316)..(316): n is a, c, g, or t
  misc_feature (376)..(376): n is a, c, g, or t
cctagganacantaattctgaagntnanganctananngtcagacctccaggactaagatgaagngagccnngaggagatcgnatnnnnngantgcttctgtcgttagccggntgcagtgctgtgngtatctagtnccagctacttgagaggctgaggcaggaggattgcttgagtccagaaagtgncagttgcagtgagtggagatcgcgccactgctctccagctggntggcagagngngancctgtctcaaaaaataaacaaaannnnntnnttcngtcagttaacaatctttantagagggtttttagtctntctttctcagctgtatgttaagttggttgacaaatgcaaataaacgtctttattatcctntctttctgaag

SEQ ID NO: 704258 - DNA, 771 bp, Homo sapiens
tgtagtggctcatgcctgtagtccgagcactttgggaggccaaggcgggcggatcacgaggtcaggagatcgagaccatcctggctaacgcagtgaaaccccgtctctactaaaaatacaaaagattggccgggcatggtggcgggcgcctgtagttccagctaactgggcggctgaggcaggagaatggcgtgggcctgggaggtggagcttgcagtgagccgagatatcgccactgcactccagcctgggtgacagagcgagactccatctcaaaaaaaaaaaaaaaaagaaattttttgaccggaaaattaagaggacggcttgaagggaacccagacaatgagaagggccaggaaaagaaagagctggaaattgggagaaagcccaagagctcagaacagttgggatacgggacgaagaaacaaggggtctccactacagacccagcccaggttcaattgtcctccgaaagattgaggttcttccccgtggtgattggctccccatgccctgttctatccaagattcaaattctccctttgtcctccggggggaatatctaagacaaggcaagcggaatcccgtaatagatgacgatgggattggttagcacatgtgaggggatccctccgaggtgtaactaaacgggtcgttttcccctgtttgaacattagaaaggcacggtggtgggccatgagcatgtatccccagttaaagagctggttgtccgtaaaacccaaatttccaaacagtttgtagaacaaccat

SEQ ID NO: 704259 - DNA, 302 bp, Homo sapiens
gccatgaaagacttttctcacagatggacacttcacagttaagtgccattagcatgttaaagctaggaacctacccaactgtaccaactcagtttactacatgattcccaaggatttttaataatttgtgctaaattccttgctgagcttagggtatatggtatatttatctattcacccatccaaccaaaccaaccacagattcttcactcaagaaaatcaggtaagcttggcatgatttgccgttttgcctttatgtttcttgctagtgcttttttataatatttattattttgctttac

SEQ ID NO: 704260 - DNA, 235 bp, Homo sapiens
gtaggtcgatctagagatcccagcggggaacaatcacttgagcacaggagggggaggctacagtgagctgagatccctccactgcactccagcctggaagacagagtgagagtgcagtggcgcaaactcagctcacagcaacctccctttctttcttttttttttttttgaaaaagggatttttgttctgtgcccagggtggatttgaatggtggaaatcgaggacccatggaaa

SEQ ID NO: 704261 - DNA, 657 bp, Homo sapiens
  misc_feature (1)..(1): n is a, c, g, or t
ntgaccgaacccttttattcttgtttttcctatttccctcgccgtttctaacctgggatctttttgctggcttttcacccccgcgtagagccttttgtcttctccgcaaattaacgcaccacatgtccgaaatattctcataagaacaataatacataaattcttgagggaatacttccgaaaatataagaagcgcacacttttctataaggttttcctcccactgaagggagttatgtataaagaagtcgtcgcccttcatgagagagtgacaagaactttgcgacgcgacgccccgcagagagagtgttatataatatatatatagcgcagtgtatagatggtgcgccacactgtttctatctaagaatgcccccacacaggggtgaataagacacccccgagacgcacacagctggagtgtctcttatgttcacaaaagagggaccattgacctctctatttgttttaaaagattcacgctctgggccgcaagaatgaggagagacagtgtccatatacaccacacagagagcgcactacacccttctcttaacataaattggcttcttgaggtagataatggtgaaagacaccactgcgtgagaagaaagccccacgaagatttgtgttctcgccccgtcaatagacgaaaaa

SEQ ID NO: 704262 - DNA, 86 bp, Homo sapiens
gcggccgcctactactactactactgctcgaattcaagcttctaacgatgtacggggacatgggcaacagagcaagactctgcctc

SEQ ID NO: 704263 - DNA, 984 bp, Homo sapiens
gatcaatgcactgttggctgctctcggggttagcaccctatggtgccttctctatgtgatcgcctgagctaacctgtctcttccttttcctcaacctcagggtggagccgcaccagaaatgcagagttttcgtgaaattcccttacggatgaaagtaccatcacccgtcgaggttggaccctccggataggatagaatagatgtaaaggcctaaggatccaggctaggggaaggagattcctcctgatcagctagcagactgtgtctttgctgtcaggcagactggaatatgggaccgtcctttagttgggactaccactatgcaaaaggacgcctagtgttcatcgttgttgtggacgacttttggagccgggtgctaagaaataaggaagaaggaagtgtttacaagcattcccaataagattaagcgcaaagatgaaagaaggtgaacgacttgatgtctttgatattattgataaggcggatcgagactggtcgaccacaaagtccgactaatcgttagagagatgtcgttcttgatgaatgtggggctggggtgttcatggcaagataatgtggccggacatatgtgggaactgtggtctgacttagtgggacaacaaaccccgaagacacgtacccgatcgcgtacttccaggagctgattcctggaccacacgcggaacacaggacaaaccttgcgacgcgcctgcacctccaaaggcccatgccaaccatgcggacaggcagcccagagccaccaactaaagggcaacccgtcgtcacacaggaaccggctaacacaagggggggcctgtcaacaaaaaaaccccggagagcgagatagccaacacagaccggcagcgacagcacacacgggcccgacgacaacacccacggggagccatacgggcacgaccgaggacagacgacacggagcacgcaatgacagccacaacaagactcaaccatcaccaccatatt

SEQ ID NO: 704264 - DNA, 731 bp, Homo sapiens
tgtgaaaaacccaaaaatcttctgtgtgcgaaaaagatgtgtgtgtgggggggaattttaaacccaaaaaatagacgggggggacagcgtgggggggggagacgagtgtgttgtttttatataaatcacccccattttttctctcttttatagagcgaaatattttttctttctccgcagggaaaaaatttttttttatcctccccgcgcggggggggtccgcgcggaacaaaaaaaccgcgagggggtgtgtgggccccacttctttggggggggagacacaggccgcgggggcgccacacacccccccactctccccaaaaagagagggttgagagacacaagcgcggagaaccgccgggaggaacaacggagtggtgggacaccccccacccacaagaaatatatttttcccaccggcggtccacacacaataatatattttattctcctcttcttctctctttatatttgtggagagagggaaggaaaagtaaaaaaaagagaggggcgcccaaaagagaaaaagaagaagcgcggcgagggggagggaagaaacttaatatttaataaatataaaaaagaagagaggaaaagaagaggggagagagaggacacccgagaggaagcagagagagaagaaggaaagagaacgaaaaaacacacaaggccagcccccgccccagccgggggaaaacaagaaaaagaaacgagagacaagacagccacaa

SEQ ID NO: 704265 - DNA, 119 bp, Homo sapiens
cgtctggatgcaagatgtctgtgaaggtgaacactgtgagatgtatcggccatggcatccagcactgtattatggaggtgtatcctagggtcctgacaggagcaatcttgttaccttac

SEQ ID NO: 704266 - DNA, 162 bp, Homo sapiens
cagagagatagagagagagggatagagtaactgatttgtctgtttctacagttaacacttcttgatggagtgtattgaagctgatgtatagcccagcagtgcgcacgtcggacttgtggattgcgctcattctgcaacaatcgcgtctagatacttgattcg

SEQ ID NO: 704267 - DNA, 250 bp, Homo sapiens
agatttccctgctgagttgaaatatttactgttattaaaacttgctttatgagaaattgtgaatatatttccatatacgggcactagtaacagtcagtgggcctgtcatccactatctcaggcaaaggaaagattgacttttttgaaggacattttacctccccatatgatttgactggctaggactttcttctgtaaagtcataccttttcacatcttaagtttatacattggccattttccaaatcta

SEQ ID NO: 704268 - DNA, 210 bp, Homo sapiens
ttaatcgctcacatgagtcaataagatccagagctggacactaactatgtggtggccccttcatggcaacatccctctcctcctctaccctcagtgacggtcccccgtcagataagtcccaggccaaaggataatggggacgttcgccaggactgcattcagatggtgactgacatccagattgacatgtacggaccaactccagcgtgt

SEQ ID NO: 704269 - DNA, 224 bp, Homo sapiens
aaaattgtgcgattgcactccagcctgggtgacaagagggaaactctgtctcaaaaaaaaaaaaaagaggctttggaccccctaagaggcttttataaaaaagaaaccatttggccatgtaaggggtgggcccttttaaaaaagaacagggccagtttgaaaaccaggcccctgggacccagggagattttggattcgaccccgactccttgactggaaagttt

SEQ ID NO: 704270 - DNA, 685 bp, Homo sapiens
tgggaactcgtactctttttttgaaaaaaaaaccacaaaaacccccaaaaggggggtgggcgccccggcccggggaaaaggggcccccccccgggtgttgtcgtggtcggggggggccgtgggtgtggtgtggccggcgcgcctctgtgttgcctcaatgggggctgccgccgatgctcctgcggggaatgggccccagagcaccccccattcggcggtccgagcaccatgcccgtgcaccgaaggggggcgccagacacacaaagttcttctgggtggacgtcaccccgcccccgccgaggagggaaacacatgggcgaaaatggtgggcacagaagatgtggtggcacccccacaagctccgccgcagagaaagatcctagtgacagggaatatacacagcggcccggagggagtccctactcaacgacaaggtcagaaaaaaattgcgccagaatccaccacaccaaaagaagagaccaatggcaggaacacacccccaggaggtgtcgcaaagaaggtcccaagaacccaaattcctccgtgcggggccacgggcacgaccacaggaggtctgctacagaggcccacaagtggctactcaaagatggagaccccttgttgttctgaccccgagggctcccgagaagaatcgcgcggaggagagggagagaacatggcacat

SEQ ID NO: 704271 - DNA, 296 bp, Homo sapiens
cagcgtccccacaccctctggtgaccaccacatggcccagcagccacacagcacccggctcccacctgggcgtctgaggctggaggaagctctgaccttacataaaaaaatggggtcggggcggtgtgcgtcactttgggcccatggatggtgggtgccttgtggccacatcagagcagggcttggtggggtgtgggcagggagcagttggaggtggccctgtgagagctggggaggtgtcccaaagtgccagcatgctgcggattgatggggtcgcacactccgtgcccctgggg

SEQ ID NO: 704272 - DNA, 805 bp, Homo sapiens
agatcatttatcttaggacttgcagattaagaatgttaaagatgctatggctaaaatccaagcaaaaatccctggatcgaagtcgcagaagctgaatgaataactgacccaaaggtaattagtaggagattcatctttaaaggggatattcatttgattatacgcggggagcggtcagggtaagtaactgataccttgtacgtctcgcgagtgcagctttcacagatcgctggttagactcttcattattagcccatgcactgtatgtgaggaagaattacctgtcttgactgccatgtgtccatcatcttacagtatagtaatgctgcgtatagtatggattctaagaaccgtatatcactcatctattttcctatgctgatggcactggttggacataatataacctgtatcttttacttggttgcagatagtcttgccgccatcttggccagttgcagcagatggtggagctagaacaaacaaaacataaaatcgccctctttctagccggtgcccggtgtttttggcgcccttgaacaatggactgcagacttctctttgaaacttgaacagtgttatggactgtagcactagtatctccacggtctaaggcccttcgattgcagcggatcccctttgcatattccggggtacgtaccctgcggcgttccctgtcgcactttcctcatggaccactgttttcattgggcacccttttccggtaagctgcgagacttggtcttcggttaaacgagttgtactcactgactggtcaaccttttgccctgcccgtccacccgga

SEQ ID NO: 704273 - DNA, 269 bp, Homo sapiens
tgctgcaggtcactctccaggattcaggtcttagggaggctgacgttgcagttagccgagattgtgccaacgcactccagcctggcgacagagtgagactctgtctcaaaaaaaaaaaaaaaaaaaaaaaaatggcaattttttccttttttttccccaaaaaggtaaaatcttaaagttggggttttttggcccggcaattttttttacacaaaaaaagttccgtttatgaaaattgataaaaggtaattattattaaaagtggaaca

SEQ ID NO: 704274 - DNA, 154 bp, Homo sapiens
gccgcctcctacttctcacttgtcacaaggctctgatagactctagctcatagttctgactcagccaccctgcgatagtgcacttgaggcccagggaaagacgggccacagatttaacttgtaggggggaaagcaaacaaattggacggtaaaa

SEQ ID NO: 704275 - DNA, 381 bp, Homo sapiens
  misc_feature (264)..(264): n is a, c, g, or t
  misc_feature (298)..(298): n is a, c, g, or t
  misc_feature (333)..(333): n is a, c, g, or t
  misc_feature (347)..(347): n is a, c, g, or t
  misc_feature (350)..(350): n is a, c, g, or t
  misc_feature (359)..(359): n is a, c, g, or t
cacgatgtgctcactgcacctccaacttccatgttcaaacgatatcctgcgtcagccttctgagtagctggacctcagccacacagtcaactgagcagggccctgttggcattcacgttgccaccctccacttaaacatttcttccatatgtgtggtccttggcactcaggtttaactttcccccccagaaaaggcaacttagataaaatcttagaggcctttcatactcttttaagtcctcttccagcctccctttgagtccnccttggggttgataggaattttctcttgctttcncaataaagtctctattcatctcatgtttaatttgnacgcatagaattgntgngaaataaantgttccattcaagcttacaaac

SEQ ID NO: 704276 - DNA, 163 bp, Homo sapiens
gacagatacgaatcgagcctgtacccatagcacaatctcgtagctggaggtcgtaccgagtctacctgggttaggtctacctgggttaggtctacctgttaggtctactggttaggtctacctgggttagagtctacctggaggtctacctggtgttaggtct

SEQ ID NO: 704277 - DNA, 272 bp, Homo sapiens
  misc_feature (101)..(101): n is a, c, g, or t
  misc_feature (117)..(117): n is a, c, g, or t
  misc_feature (122)..(124): n is a, c, g, or t
  misc_feature (135)..(135): n is a, c, g, or t
  misc_feature (137)..(138): n is a, c, g, or t
  misc_feature (145)..(145): n is a, c, g, or t
  misc_feature (229)..(229): n is a, c, g, or t
  misc_feature (233)..(233): n is a, c, g, or t
gagcgtccaatgaggagatttttcacctgaagtgggggcttggattcatgggtggtcccccctttgggatgtagactagagggattttggggggttttaanccaacccctttttccngctannngccggggggtntnntcgggtnaatgttttgaattttggggggcaacccccggttttatgcccttggtcctagaattaattcccctaaaattttttgaaatggggncggnttttcccctatggccccccctttcccccttttagggcca

SEQ ID NO: 704278 - DNA, 159 bp, Homo sapiens
tggtctattggtctgcttttaaatttcaaaaaaaaagcccatgaattcttggggacggggatacagagattgtttcccagctcagatcataatttctaccatctctgtgacaatcataatttcaaaagggccccactctccgcaccccgtgggggggag

SEQ ID NO: 704279 - DNA, 301 bp, Homo sapiens
  misc_feature (33)..(33): n is a, c, g, or t
gccccaaagccaaaaaaaaccaaatggccccanttgctccggatgtgcctgcccccattgggggacagggccgggcctgggctcggttcccaggtttaaactctccaccctctttcctggagtgagggggctgaagtcaaaccaaaaaaaaaactcaaaaattttttgtttatttgtgtttgtgaccaaacaccctcccccttcccccaggtttatggcctcgttttcccttgtatatttttccccctgtaaattttttgtccaaacccaaaaaaaaaattaaaaaaaattttttttttta

SEQ ID NO: 704280 - DNA, 832 bp, Homo sapiens
acggcgccggaagatggcggagtcggacatcgggcaggactgccaggtggagcattgccggcagtcgagattgtcttccatttgtgtgtgatgatagtccaggaatatttcgccttgaacacagaagcagggaggtctcatggatgtgtcctgaggtgactgtacatcaaatgagagactgaagacagatctacaacagtatcattcttacgccatgctctttcaatagcactgttgctgagagagaacttgttggcagttatactgtccttattgtgagaagaattttgcctgagacaccgtcatcagctcaagatcattgagtgtgaggaagtggaaatcccaaagccttcgaatggtgccactcagacactgggttattggacagttattgattccatagtacagggaggacagcagcagagataaaccgagtggaaatggtgccatgaagtagtgaaacaggtgcaagaggttgctagtcgatgaaattaagagatgcaattgctgaatggggataagtcgaattaccacagtaacatgaacagtaatgtcactcttcaggtgttcttacctaaagggagccggagagaggagcaacaccgaatgttctcttgagccaccgatggagcattggaaaaggccatagactttgtccgagttctctagccaggcgttcctatatgacgatgaacaatttacaggtaagaaattaaggctgtggtcacatttacttcaggagaaagcctttagccttgggatcactacttttggaatgcctgggatggctaaggggggatttgttccttttatatacatggtggggactata

SEQ ID NO: 704281 - DNA, 599 bp, Homo sapiens
acgtcggcgcagggagctggagggacgctaggatctccgccggcaggctcctgggggccggagcaccaaggtttaatataacatatcctatcatgatttttctctgccccttctcaaatcatcggcagtagaaaagagaagaaaacatgtcaggacacaaatgttattcctgggagttgcaggaccggtttgctcaagataagtcagttgtcaataagatgcagcagaaatattgggagaccaagcaggcctttatcaaagccacggggaagaaggaagatgaacatgtggttgcttctgatgcagacctggatgccaagctggagctgtttcactcaatccagagaacctgcctggacttgtctaaagcaatcgtgctctatcaaaagagaatatgtttcttgtctcaagaggaaaatgaactgggaaagtttcttcgatctcaaggcttccaagacaaaacccgagcaggaaaaatgatgcaagccacgggcaaggccctctgcttttcctcccagcaaaggttggccttgagaaaccctttgtgtcgatttcaccaagaagtagaaacttttagacatcgggccatctctgatacc

SEQ ID NO: 704282 - DNA, 858 bp, Homo sapiens
  misc_feature (378)..(378): n is a, c, g, or t
  misc_feature (787)..(787): n is a, c, g, or t
  misc_feature (834)..(834): n is a, c, g, or t
cccaaacaaaaacgctgtccggcgccaggcgcccacctgcaagcccaagccggtgctcggccagttacaaaagaaatggtcaggatctggacaacgataatgatagtattaatcctcctattaagaatcggcccaaacaaaccctcgctgtcagggcgacaggcgcccgcccaagcccagacctcggacctggttccaagcctgttcccgctgggtctctgggcgcccggtttctgcacctggagctcgcccgatgaggacaagaggccgaggaagccggttccggggacgggcaacagggactcagggaccagaaggcggctgcaggacgcgaccgagcaggaccccaggcccgggaacgacgtcgcgagcgctganactgccgggcctcccagcccatctggcattcgagcgcaggaccgggcgccccggcaccgccgcgcgccacccgctaggatgccggtggccccagcgccctcagccgacggaggtgagaggcgggcccgggcggggcgcggaaccagggtggggggctgggggccgaagacccacctttccaacaaaatccccaccgatcccgggcgcgacggggacttgggcgcgccacggcggccggagcgctccacatcagcacccctcccccagagccgctgcaggaacagggaggaggccttttccaccgcacccggagcgtttacaacgggctggagctgaatacctggatgaaagtggagaggctgttcgtggagaagttccatcagtcgttttccttggacaattaacaagnttaggcttccacagtgccagggcctggggatgctggacgtgggaganggttgtggtcgtagcctgggaaaa

SEQ ID NO: 704283 - DNA, 531 bp, Homo sapiens
ccattgggtcgggcgggtcttgaactcctgacctcaagtgatccacccgcctcggcctcccaaagtgctgggggttacggggcgtgagccaccggggctgggccatctcactggtttggaatcaggatgcctaggtcagtgagagcctgtgtgagccaaaaacagccacgttcatcttggaaaaaacttaggccgacaaatcaagtttttaattacgggaaataatcaccaagtaggggagatgcaattaagggcattttgctctgagagtagctggtgggtcttttatatttttccccaaagctcattataaaaaatactatgtcctttcatacttacagtctcaattctatcacttccggcggtgagtatggaaatgaatttggtggaaatcaaagaatttagttaataagattttttaagccggtaagtagaagtggcttaaggtttataaagaatatgggcttggctcataatttaacggaatgagacatctgacctctgctgtctatcaaattcattaccggtttc

SEQ ID NO: 704284 - DNA, 854 bp, Homo sapiens
gatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaagagcccaaaaagccaaagcaatcctaagcaaaaagaacaaagctggaggcatcgcattacccaacttcaaactatactacagggctacagtaaccaaaactgcatgatactggtacaaaagcatggtgctggtacaaaagcagacacatagatcaatggaacagaatagagggcccagaaataaagctacacacctacaaccatctaatctttgacaaagttgacaaaaatacgcaatggggaaagaattccccattcagtaagtggtactgggataactagctagccatatgcagaggattgaaactgaaccacttccttacaccatatgcaaaaatcaactcaagatggattaaagacttaaatgtaaaaccccaaatataaaaactctggaagataacctaggcaataccattctggacataggaacggaaaaagatttcatgacaaagatccaaaaataatgtacgaaagcaaaatgacaatgggactgattaacgaatacattgactcagcaatccatatggggttataccccaggaatctaatctcctgtctaagacttttacccaatgttccggggtataccatcgaagcgggataaacaagtccccggggaagagcaaaaagtggg

SEQ ID NO: 704285 - DNA, 544 bp, Homo sapiens
  misc_feature (41)..(41): n is a, c, g, or t
  misc_feature (44)..(44): n is a, c, g, or t
  misc_feature (118)..(118): n is a, c, g, or t
  misc_feature (380)..(380): n is a, c, g, or t
  misc_feature (411)..(411): n is a, c, g, or t
  misc_feature (441)..(441): n is a, c, g, or t
  misc_feature (443)..(443): n is a, c, g, or t
  misc_feature (504)..(504): n is a, c, g, or t
tatcttgagtatcccgcctacctgggacgatccgaccaccnagngagcgaacgcagtcaagtcaattgcctcgcccattggagaacgctttgaaagcaattatgggtatcgccttatngggcacgttgctggccggttgtgcgccgtcttactcggtatggacaggtggtatgaacgcatttgtcggcacgcgcttcgatgtccatctctatgacgattgcagccgcggctgtggcgattcctattggtcgccggtcaacaagaacaaggtctatgaccaggttgtgaaggagggcgacagccagcgctacttcctgacctggatccgcgactgtcgatactccgtgctcgtctcgggtgagggcattatccagtcgtgncgctacgagactgaagaccgtagcagctgtnacgttttttagtcggtctttgtacgaactnanatccactcaataaccaaacctaaacgcggtcaaatgtgggacgggcttgctcgcgaatgcngagtgtcagtcgccacatggggtgactgatccaacgcttt

SEQ ID NO: 704286 - DNA, 115 bp, Homo sapiens
actgatgcttattctgcaccacagtggcgcacggtagttacccggagacggatctgcagcctgagtccgagcataagcttggggtacatcctccttccctggatcactccacagt

SEQ ID NO: 704287 - DNA, 315 bp, Homo sapiens
  misc_feature (52)..(52): n is a, c, g, or t
  misc_feature (66)..(66): n is a, c, g, or t
  misc_feature (86)..(86): n is a, c, g, or t
  misc_feature (121)..(121): n is a, c, g, or t
  misc_feature (154)..(154): n is a, c, g, or t
  misc_feature (280)..(280): n is a, c, g, or t
  misc_feature (287)..(287): n is a, c, g, or t
atttcctctctacctcattttacataaagagttgtaggcccagcacggtggntcacgcttgtaatncccagcactttgggaggctnaggtgggcggatcacaagatcaggagttcgaccancctggccaatatggtgaaaccctgtttctactnaaaatacaaaaattagctgggtgtggtggcgggtgctggtagtcccagctactcaggagactgaggcaggagaatcgcttgaacccaggaggcagaggttgcagtgagccgagatggcgccactgnactccancctgggcgactgagcgagactctgtctc

SEQ ID NO: 704288 - DNA, 1276 bp, Homo sapiens
  misc_feature (143)..(143): n is a, c, g, or t
ggcggagaactccgtgtcttcttcactccctgtgcatacctctggcgtgtcttcctttcgcttgtgtgttgtggtcatgtgtggtgtggttgctgtgtcgtgctccctgactcgtgcacctcgcgtcattgattgtagatgantttgtttctttcactagctgagcagtccttgtgcgggtcgaacagataggttgttccccttctctgtgggccctccctcatgttgtttgactcgcctctttcttcccaccacagtggttgtttttttggtcgcttcttgtttgtggtccactcttcgtggcaccagggggttccctctcctcctttgagcgggggagtgttgtcgctaactcctcttcgtcccctctgttgggggcgccgcattctatttcacaggtgctcggcgcgccgccctgtgcgctgctaatgctgctcattatgtgcgcgagactgctcttttcacacgaggttgttcactcttcgtgcgggggtgggcccccttcgggttggttgtcccgccgcggcacgtggtgtggttcccacactgggcctttgccccggggcttgctctcccctatggagcaaagcctttcttttcttggggggcatcctcccggtggtcctcccagtcttgtgcgtccacagcgcacggttgagagagcacacagtgtgtgtgtgtcgtccacatagagcgctggcgcgcctctgcctcttttatagagggcctccgtcccatagtgggcgcctggtcttcaaacaggtggtttgttcgcacgtgcgcgcacacacttggaagtagtcacgtgatggtcgcccgcgtgcgttaggtggtgtagcaaacttctcctccaactcgcggccgcacacttgtgtgcacccgtcagtgatttgcgtcctcccatctgcccctgaccccgctcttgaggggccgccccacggtgagttctcgagtctccgccccgtggcgcacacaggacccccaggtcattggtgttcagctgtacttctcgtgggccataggtatgggtccagtaagaccccccttctaggcacttaagaagagggctggtacctggtcggctaggtatatcccaatagaagactgggccttaggcccgggagttccccaaatattcgtaggagggggagcaaacaaaacacagttcctcccttgagagattccctggtggattttttataacagatattatgttttattaagtattggggccaaatggtttgataaatggataattaaaatagaaaaagttata

SEQ ID NO: 704289 - DNA, 302 bp, Homo sapiens
gcctcccaaagtgctgggattacaggcatgagccaccatgcctagcctggtatttatctttgtaattctaactgtacaaagtcttatgactacagtggcatgatctctgctcactgaaacttctgcctcctgggttcaagcaattctcctgcctcagcctcctgagtggctgggactgcaggtgtgtaccactacgcccagctagtttttgtattttcagtagagatggtgtttggccaggttggtcttgaactctcctgacctcgggtgatccacctgtctcagcttcccaaagtgctggg

SEQ ID NO: 704290 - DNA, 476 bp, Homo sapiens
  misc_feature (367)..(367): n is a, c, g, or t
cgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttccccattttaataaatggtcgcaacttctagaagtcctgctggtgccacctggtggggtggacgtctctcagactgcccttcactgaagccattttgtacatggggacggggtggggacgtctcttttttggtgttgnacgtttgaccagtggggaggggttcagaggcggcggtcctgtccttggctccgtctgtccgtgtggccttgctgccattccgtctgatcattaaacagagcttttgata

SEQ ID NO: 704291 - DNA, 473 bp, Homo sapiens
atctctagtctggtacttggcacagcgatgaagtctgagagtcatgcccatcgctgattataacattcactttgggcaaagcggttattaagcaaccgaatatgacatggtaaagctgcagacttccgccccgtcacttgtaatagcctcatttggaaccatttcaaggaaatttcatctgtcacatctatgacccctggccttctagaacagtaagattttttgcttttagttttatgctggtgattatcacaaggccttttcctggtgggtcactggattaaatatgaagtataaggttacatctggaattttcattacagtagggtcatgaacagctcattgtctgtccattcactgtccctagtaccgcaggaaatatgtagacagtacaggttatgataccgaaggccgggaaattagtgggtatttaatctggagtaaaggaaatatttggttccctccctgagtgg

SEQ ID NO: 704292 - DNA, 690 bp, Homo sapiens
  misc_feature (86)..(86): n is a, c, g, or t
  misc_feature (227)..(227): n is a, c, g, or t
gtcttagatcttacgagagtcagactcgtgtctagtcatgtaagtgagactgtgccactatagctgttatcctatgtgcacaatcntggcctaggaatcaggtcgcttatgctatcccttcgcacaactccagaaattgcctcaggggtgaatacaactcgtaatcgttttctaggagactagacatgccgacattgtctgcttcggacgagtcattacctgcgccntgaaactataggtatgccggatacttcaaggcgtagccatactgaatcatgcaatagttgagctggcacgccaggcgttgctactggagactaactaacatttttggcactgtcaaaaatacttgggttgaaggcaacacagataagcctccagggtttacttggctaactgggggcttcaaattgcaaccaagtcaagcaacaatatttttcactcgctctcccaatcggcgagaggttttgaaaaaaatttcaacatgattaaatttaacccccacacggaatcttttaacctgtgttgttcccggcatattcttttataatcccaaagcaactttaagaaaaaaactcttaacaaaattccctaaattttttgaattgtccaattggtttaaacgaagtgtgggttgaattcacgaataacctaatttttttgtgttatttgtcaattatgtggtaatag

SEQ ID NO: 704293 - DNA, 215 bp, Homo sapiens
tccacagctccagttcactcccaagcccccactccgctgtctcttcctggatggtatgtgcttgtccaaatggatatagccccgagatgactaagttactcaaacacgtgctggctccgcggaaggagttgtgacaggaattgctgcccaagaaatgggaaagcggaccagctccttggggaagggaggttgcttaacagggagtgacactcgag

SEQ ID NO: 704294 - DNA, 278 bp, Homo sapiens
ttgcaacacaggtttgttgcgcgttgcaagacaacaacacatgtcaaatccagttttagatttattaaataatcatcgttcaattcgtgcttatacgaatgaaccggtcaccgatgacattgtgacaacgattttatctgccgccaatgccggaccaaacatgaataattaccaaccggtcacctttattgaattacggaccaagcattgaaggcggaaattacagacaagtcgggatgacttatattgaagtgccgcccgttattttgtggtggccg

SEQ ID NO: 704295 - DNA, 948 bp, Homo sapiens
ctcgatttccttgtcgaaattctctggaggaatacttgtgtgtactccgcccacgtaccaaggatgatgtggcttgctctgtgtgtgtcttccttcttccatgcgtaggaaaggagggcactgtttgcgattgaggggatgggggggagcccaggaagcaacgagggccaggatacctcttctgccaaaagaagggtctcctctcgcgctccttctccacccctctttctggtgagccgtgtctttcagaattccacctcgatttcgtttcgagtattctgggacatgttattaggtaggctgtgagctcccaacccaccaccacctcgctcggttgccttgggtggaagtccgctgcaggatgtgaaccgaagagagcaaacatgtgaattcatggaccacgcacaggagctccaaagccccttccttggaatccctcctccttttcctgtatatacatggtatagccgcagggtacaaattacgcacacgacatctacaaaaaggaggcccaagctcaccacaataatactgaattcaccagcaagaccgaagataaccataggcacacattgcaacattgcttggacttgcgaagtgcagctttacactgtccacacagatctcaagcaaaatttcacactggaggacctgacacgaaggctcagacaccaatcctaacgcgtaattctctacaatattattaaaagaattgcccattggctgttcatgctggtcccattaagacgaatttggcaccgtgttagtcagagacgttggaattcgagaatctttaacgagctggaggagagatgggcccagttattgacgcagatcccgtattttaccaggatgcatggccgcaggctaccccaatcactgaacatggtgatgtgatgaggaaccgaaataccagcagcaggatctcactcgtgccataggcatata

SEQ ID NO: 704296 - DNA, 735 bp, Homo sapiens
gatggaaatgcagaaatcacccgtcttctgcgtcgctcacgctgggagctgtagaccggagctgttcctattcggccatctggggtctggattcggcattacatgtcttaacggaaaaatcaactcaagagtggattaaggacttaaacctaagactggaaactataaaaattctagaagataacatggaaaaacccttctagacatgacttagataagtatttcatgaccaagaacccaaaagcaaatgcaataaaaacaaagataaataactaggacctaactgaactaagagcttttgtgcagcaaaaagaacagtcagcagagtaaacagacaacctacagagtgggagaaaatcttcacaatctatacatctgacaaaggactaatattcagaatccacaagaaacacaaatcagtgaaaaaatcctatcaaaaagtgggctaggacctaatagacaattctcaaaagaggatataccaaacgtccaaataaacatgcaaaaaatgctcaacatcactaatgatcaggggaaatgccaaatcaaaaaccacaatgtgatatcacttgtgtcctgaaagaatggcataatcaaacacattggaacaaacagtagatgttggcgtggttgtggtgataggggaacactttctacactgtggtgggattgttaactagttcgcactgtggcaaatggtggggcggttccttacagatgaaagtgactccattg

SEQ ID NO: 704297 - DNA, 106 bp, Homo sapiens
ggtaagtttcaggcgcacaaacccgcaaagagtaagacggcagccgcagccttcttgaaaagaattcggggccccaagaaaagggcggtcgtttttatcggttccc

SEQ ID NO: 704298 - DNA, 535 bp, Homo sapiens
  misc_feature (130)..(130): n is a, c, g, or t
  misc_feature (146)..(146): n is a, c, g, or t
caaactataaaatggacttggctgacattctttgaacaatagaaatatctgcagtctttcacagatttgtattatgctgaagagtttcatctgacaacctgtttcctccattcccccgctatacatatanaatgtgtcccaggcangtgccccccgggatggaatattgagggtctcacggcgatagatatatcctgcgtatatactatagagagacggcccgtaatttccttagtgcacaagagaccccttactcacctccacagcttgtttcgggtgtcccctattcggtgtaaataatgcattcccctgtcgcacaccccacatggctggtgttgcccctcgactccctgagggctccgccctgcctcggcatggttaaaggcacccccccctattccccgccacggatgtgagtccctgcacccactatgtcggtccccccggctttgccctcttctcagaacccctccctctctccctcccttccccttttccacaacagcgtttcaccacctccctcttctgctgagcc

SEQ ID NO: 704299 - DNA, 267 bp, Homo sapiens
ggggccgggtgtcttttctcactgttgcttccccgagtgcgcagaagtccatcggcttcactaaatagcagcataatgttgggccgaaagcgcgaccttagagccagactgcttagcttcgaatctcagctcaccctgaggattcaacggtgaacgagacaggaatgatctcctcttatggggatttcattccagtggaagaactcacataactcgtaaaataacatatttttacacaaagagaggctaacagtaacctatacatgt

SEQ ID NO: 704300 - DNA, 774 bp, Homo sapiens
ggcaattcctagagagtgtgctgggtgggcagaaaacactgagacaggtgcccagcaggagggcataggtggcctctgcagaggggacctcagtcctgtcactggccctgaagactggccccacttctggtctctgtccctctgcctccccggaagaagatgagtgaatcgtgagtgattatcagaatctcagcatccatccatcagtggtcgcgagtccaggaacggtcatggggctactccagagagaagctatcccctggccggctgggaagcccagacagacgaggacggggaaccgtggattacgtgaatggggaggtggcagacgacatgcaagcgctagaggaagagcaaatcatcgacaggagccaatgctgaagatgggaacactgtgctcatggacccatcggatgcttccaaggagcatttcccagagactactcaagttttaagcccctgcatggttgctcctggatggagaacccaggcaacgacttgaggaaccaccgtgggcatgcagtggacatgccttggtgaacaagacagttactcacggggagcgtggaggtcccgtcacacaaagccctctccccgacgccaggctttgtggggcaggcacctggtaccaaggggaaaacgcgggtgctggtattggcaccggatgccccaggaatttaggataaggcgtgtcaccgcagtcccccattaacaaaaccaagtgacaacagttggatatctgagttcctttgtgctattaatttggattcctca

SEQ ID NO: 704301 - DNA, 733 bp, Homo sapiens
ggcacgaggaaaaaagaaaaaaaaaaaaaagcacagtggctcacaactgtaatcccaacactttgaaaggctaaggtgggaggatcacttgagctgaggagttcgagatcagcctgggcaacatagtgggaccctgtctccatttaaacaacaacaaaaaaaagcttatctacttggagagttcgcatagtagaaagaacaagtatggtattctgaaatttaggggctttagattgcaaaagaaaacctcttccagtctcgttagcaggtttagaaccagccaaatggctgttatttaattggatctcccattgtatcggcagtttttcttggttagcgcacattgtaattataacttatgtataaggtggtgctatatactataaggagttaacgaaattcagtttggaccctaacatacagttataagatgtatatagaaaatagccaggtgcggtggctcacgcctgtaatcccagcactttgggaggccaaggcgggcaggtcaggagatcgagaccatcctggctaacatggtgaaaccccgtctctactaaaaaaatacaaaaaaaaattagccaggtgtggtggcgggcgcctgtaatcccagctacttgggaggctgaggcaggagactggcgtgaactcggtaggcagagcttgcagtgagctgagatcacgccactgcactccagcctcggcgacagagcgagactctgtctcaaaaaaaaaa

SEQ ID NO: 704302 - DNA, 429 bp, Homo sapiens
ttaatttttttttgagacaagagtctcaccctgttacccaggctagagtgcagcggcacagttacgactcactgtagcctcagcctcctgggctgaagcgattttcccacctccgcctcctcagtagctgggactatagacacaagccaccatacccagctaatgaatgatatttttaaatgcatatgaaaatatgcatagaatcagaatagcaaaatattttttaaagttgtggaaaacagatgtgctttactgaggttttataaataataagatgatacacttaaaatgggtgtgttaattttttttaggagactggtgtgatggctgtataccctcagtactcacatgtgcgtctgtgttacagtagactccattgctctgcagagagagtaaagaattttcatttgaactgtccagtttgtcaaa

SEQ ID NO: 704303 - DNA, 228 bp, Homo sapiens
attgaggataaattgccataatatgatgcaaactgtgcttctgtatgataattacaatacaaaggttccattcagtgcagcatatacaataatgtaattgagtctaacacagttgaccctatgggtgacacttccattgtttaaaaatacacatgaaacgaaaccctatatgcttactgtcacctagagctttttataacaacgtcttttgttgttgttggattcttt

SEQ ID NO: 704304 - DNA, 895 bp, Homo sapiens
  misc_feature (51)..(51): n is a, c, g, or t
  misc_feature (167)..(167): n is a, c, g, or t
  misc_feature (193)..(193): n is a, c, g, or t
  misc_feature (252)..(252): n is a, c, g, or t
  misc_feature (267)..(267): n is a, c, g, or t
  misc_feature (286)..(286): n is a, c, g, or t
  misc_feature (319)..(319): n is a, c, g, or t
  misc_feature (352)..(352): n is a, c, g, or t
  misc_feature (364)..(364): n is a, c, g, or t
  misc_feature (369)..(369): n is a, c, g, or t
  misc_feature (391)..(391): n is a, c, g, or t
  misc_feature (396)..(396): n is a, c, g, or t
  misc_feature (452)..(452): n is a, c, g, or t
  misc_feature (575)..(576): n is a, c, g, or t
  misc_feature (578)..(580): n is a, c, g, or t
  misc_feature (590)..(591): n is a, c, g, or t
  misc_feature (626)..(626): n is a, c, g, or t
  misc_feature (634)..(634): n is a, c, g, or t
  misc_feature (875)..(875): n is a, c, g, or t
ccccggcgccgccgcccggagctgcccggaagtctcggttccgccgccggnctcgccaggggaagcccggggccgcccgggacctcggcccgttcctccggacccgagaggccgccgcacgggctgccgctccagatgctgctgctgccgccgcggccgccccaccntcggtcctcctctccggagccatggngcaccgggccccaaggctccccctttccccaaggcggaaggcccctcctccactccttnctcggcggcggggcnccgatccccgcgtgctggnccgccacctcctcatcgacgccaatggggtctnctacacatacacggtgcagctggaggaggagcnccggggctcgcnccagngcgaggtgccctccaggagagntcggntctcgtaagggctaaagctgcccggagtgcgcacgtgtctttgccagcactctgtngttgcagagccaccgcgtgttgcactcggatctcaagcccttcacgtgcggcgcctgcggcaaggccttcaagcgctccagccacctgtcgcggcatcggccacgcaccgcgcccgcgccggnntnnngcacacctgnncgctctgcccacgccgcttccaggacgccgcggantggcgcanaccgtgcgcctccactaagctcgagacccggcctgtgctgccctgcccgtctcagggccaccaagtctgacccacacagcgtcactcactcccacacacaccccctggctctgctgaggttactgccttaccctgggcctcagccccaccttccaaagggaggagcatcattccttccttaccccctttctagctgtgtgatgtagacaaagtcgttgcccctccctgggcctgggaacantcggaactgggttccagtcc

SEQ ID NO: 704305 - DNA, 132 bp, Homo sapiens
ccccccccccccccctggggggcccccccatcatggggggggggggggttttaaaataaattggggggcctttttttgaattcccccccccccgggccccccttaagggggggggcttttttccctttttta

SEQ ID NO: 704306 - DNA, 483 bp, Homo sapiens
  misc_feature (38)..(38): n is a, c, g, or t
  misc_feature (66)..(66): n is a, c, g, or t
  misc_feature (125)..(125): n is a, c, g, or t
  misc_feature (443)..(443): n is a, c, g, or t
  misc_feature (446)..(446): n is a, c, g, or t
  misc_feature (471)..(471): n is a, c, g, or t
  misc_feature (473)..(473): n is a, c, g, or t
atccaaaataattgtaaaaaaaatttgggtacttgcanggaacgcaagggatcatgtcctgcaaanctgggtccagaaaatgggtactgatatcccaaaaggaaacacaggggctccctcttccnattcccaggggcatcccacatgaacccgcacaaagttctgaatgatttcctgcatgtcctcgaactgaaacagtggctggaagcaagatttatagttaagtcccacatcgtggtaggtaaggatcgctgggcgtttgggtttgggggtgccatagacagtgaaagtgacagagccgtatggtgtctccacagagtgagtcttgggccctcaggcgtctgtcctggcaacagtggcttctcctctgtgatctgcacctcctgcagtccgccatggtggctgggctcctattggctggatgcagtgggattaggggtcanaantctcactccttctgaactctggggntnctctgccgcc

SEQ ID NO: 704307 - DNA, 252 bp, Homo sapiens
agagactcccgacgctctctctgtggggggctcactccgtttcttcttctgattctgcttgtggtccggggatagaccatgaggcgtctccagccacccactgacgatctccttggtctccgcccggatgaactgctccttctcaggcgtcagaatacacagggcgaacttctggcccgtgcggccctccccatccaccaccatccgtcactggcccggggtcacgcagctcgggggcgtcaatcatggtca

SEQ ID NO: 704308 - DNA, 145 bp, Homo sapiens
  misc_feature (83)..(83): n is a, c, g, or t
tgcctcctgcatgcacgtccagcaatgatgtacagcccatggcccatgccacccgtagtagcggtgagcagctcgtgccccantcagcgccagacgtgaagtgtgtagcacctttcccattccgtggtgacgaagcatgtggcgg

SEQ ID NO: 704309 - DNA, 224 bp, Homo sapiens
cctctcatacaagtgcgtatcctttatccaaagtgctaggaccagaagtgttttagatttggattttttttttcagatttttgaatagttgcattgtatttactgctgagccttcctaatgggaaaatctgaaatctgaaatgcttcaatgacttttttttttttttttttttttttttttttttttttttttttttttttttttttttttttctctcctcctt

SEQ ID NO: 704310 - DNA, 2305 bp, Homo sapiens
  misc_feature (21)..(21): n is a, c, g, or t
  misc_feature (70)..(70): n is a, c, g, or t
  misc_feature (1119)..(1119): n is a, c, g, or t
ggcttattactgtgatcaaangtcgaacgtgctacgacatccatggactactagagagctctctgtacgncaggacttgtgtgccgtacgcatgtgactaattagagaagtaagtctctatagtcggcgagatgcggccacaagtatgcgcagccagtgagtctacaggagatcctcatagcgtgcagagtagagatgggcatgactggtgctatcgcgtatacgctcgattgacattctggcaattctatcgtggggcaacacagtatagtagtgcacattcatcttagggagacttctgaagagagctggatcgcacgtcccttcgcacaatatcgtagccaccagacaagcgcacggcgcgccgcgcgctctctcgcagacggcaccatcaagcttcgtcgacgcattcacgggccacatggtgtgctgcgttggcatatcgctgaaagtagaccgcgtacgagccatggtgccgacaaccgacgttgacatagacaactaggatacaagttgtgcacattgaacctctacgtttaccagcattacattccaattgaggctcacccatcggttcggaaccctctcaacggctggaggatacaacaaacaggcggaacgaaggtacactatccctcttcaaagacgatcttgcagtcactgttcgggtcaaggactctgccacatcatttgctattgctgtactacgccacatagtgtagtagtaattttccttattgacaccctctcgataggcactagagacgatactacacaaacacaatagcaaataggacatacacggggtcagcatatactaatcgaccagacacacattagatcgctaagcgagtcatggctgcgacaaccatcacaaccaagacgcacaccgcttatggaataactcatttggggagcagtattgttcaccccaggttacgcccaccaacaggccgacatgcggtctcagcaatcggaccaatatacaactcgacaatctagtcacagagagacacaaaccacataagggaacacatagacagcgtacactgcaagcacaacagtcagccaactcatactagtaacgctaacagtcaggcaacacagactatgacacgngcacagagataagagcacacactacgtgactgcaactaactagctatagctacgaacgacgtcgctcagtagtacacacacagacagcacatcacgacaagcttaccacacaatcaagcagagcgccgcatagaccgaccagcaggataacagagacagccggtaactaccgaccacatcagcgcgatcatcaagcctgacacagcacgcgcaagacgagaccagacagcatgtctattcggagatacacccatccacgagcactaggcaagccacctatctcgtgactctgccagcacacgagggaatccagaccaaccgcaatagcgagagacgattgacagacagaagtagaccgcagacatcacatagagacagcaacgaacggcattgcgcggtaacagacacgccaagtgacaacaggcagaagcgccttagaccagtcagtacatcacgtctaggatccacgcgagagtaactgacccacaccatacgcgagactccacataggcacacggcaaccaatcacaacacttagagccgaacagaccccaccgcgctagcagctcagagcacacaccagactcacacaagcatgagtagatacccaccgagtcacgagcgctcacacacagcaaccgagagaacgacacacgagcaagatggaacaaggactgagaagactacaacacatatattaaatctatcaaaccaaacacctaataacctagattcgacaacccaaagtgtaagctgcacataaccacaacaacactcacacaacagtaacaatttcaaaatcacatacaaaattacatacaaaagataatatcaacatatcactcatatacacaatcaacaataacaaatcaaactaaacatatctatctcccatcaacattcattatcaatacacactaacaacaatgaaatctgataacacacacactaacatcaacacactatataacgcaacaactacacgcaaaccagaaacacacacaatctccacaatcataaacacaccgacaacatcaccaatcaacacgactgatcacacaggaatacaccacacacacaacagatttaaacaaaaattcaaataaaaacacatacacacaatacaataaacaaaatcacatcaaaaaaacaaatcaacataatacaaacacaaacatcctataaa

SEQ ID NO: 704311 - DNA, 707 bp, Homo sapiens
ctggctgttgggcccggagcgcttgagcgccttcgtcttcccgggcgagctgctgctgctgtctgctgcggatgatcatcttgcctgctggtggtgtgcagcttgatcggctggcgcctgccatgcctggacccctggcgcgctcggccgtctggtgctgcctgtggcgctgctctttttcctgtgtcagccactgcttgctttgctgtctgtgctgctctgtgatgtgtggcttgtgcgctgtgctcgtgcagcctgtgtgctgccgcctcctgcctgctcatcagactgctctcctgttggtgatgcctgcgttgcatgttgcctgaaaagtgcccccagcaatggaggtgctcgattcgttcctgtgatcttgctgagaaatatcttcccttccaacctaggtgtcatgcagcctttcgctcatactctaccacctatgaagagatggaatatcacctggaaccagggtgaaggtgccctgtggggcaggagtgtggagggtgatgaacatcctgggtgcttggtacgtgtttgccatcgtctttggtgttggcgcttgcggaatgcttggggcctgaattgggagcttgcttatcctgcttcttcaaactccttcaattgatgccaccatggttctggtctcctgggaatcagtgttggtacgccactgtggggcatcagtgttcctggtggcttggcaagga

SEQ ID NO: 704312 - DNA, 250 bp, Homo sapiens
ggcggtggtgagaggggaacaaaatatcccacgtgccaggataagaattagaactgtatgaccttgataaaaccagaaaatccaagttgcataagataattaggagtactaaatatcctgagtatcttacatctccaacatcaccatgtgctttagtacacataaagtgtctggaaggatacacgacaaattggtacccatggctcctatatggggaagaatcttcagtgttccgtgctgtggcagtatc

SEQ ID NO: 704313 - DNA, 197 bp, Homo sapiens
gaaaactggggaaaaattttagggggggaaggccgtttttttttcccttcccccctcctccagaaagaaggggggggcgggcagcccttggtgggcccagggttttgccccccccccccttcccttttggaagttttggggccccagggtttcccccacccggccttgggcaaaaaaaaaattgggtttttttttta

SEQ ID NO: 704314 - DNA, 81 bp, Homo sapiens
agcggaggggagccagagccggacacggctgtggccgctgcctctacccccgccacggatcgccgggtagtaggactgcgc

SEQ ID NO: 704315 - DNA, 327 bp, Homo sapiens
gtcggtacctgtgtgtagcacaacctagggtcagttttgcaggtgtaagccatttaccaagatagttgtaggtaaagaagggcagatttattagagaaatgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 704316 - DNA, 123 bp, Homo sapiens
agctcctggttagatcctcccaagtagctaggactacagactgtgtgtaccactcctagctaatattttaattattttgtagagatagggtcttgctagttacccaggctggtcttgaactgc

SEQ ID NO: 704317 - DNA, 122 bp, Homo sapiens
gtgtgcctagaggatccccgcgcacggggcgtcatcggccgagttatctagagtcaccaaagctgccgggccgcccccggccgtgccgaagagggctgaccgggtggtttgatctgataaat

SEQ ID NO: 704318 - DNA, 166 bp, Homo sapiens
gagcccccattgtctcctctcataccatctcaagctcaaactcagctcttcccagcacacactataagccaacattcattggtggacttactcatctctctcatccccaacagcttgtccaccaaaagtctccaaagaagagatttatttttttttagcatcacat

SEQ ID NO: 704319 - DNA, 379 bp, Homo sapiens
ccagaggctgaggcaggaataatcacttgtaaaccagcaggcggaggttgcagtgagccgagatcgcatcattgcactctagcctgggcgacacggagcaaaactctgtctcaaaaaaagaaaaaaaaaaaagaaaagtacagttactttaccaaacagttgggtcgttgcttattaattatacattacactgtccaaggtgataaaactgggtggccagtttattgcatttgctatgcatttgcttcacagtgcagttagcagcccgttgctgaaaatgattttaagccctgcataatgctaagctttatggtgattacctgtatgtgtcttctttcttttaagcagacccttacctttccagggtcaacgtacggaa

SEQ ID NO: 704320 - DNA, 208 bp, Homo sapiens
gacatttacaggcagcgcgacgtcaggccgcatgtgtattttcttatagatcatgtgtgacatttaagaacccatacatgtactaacgttctgttcttgaaattttctcttcaagtatgctatggcggcagcacctccgcgagaggggttagggtggaacccgatgtaggaacagtcgtgatggacttggggggatcacacgtcgtgt

SEQ ID NO: 704321 - DNA, 716 bp, Homo sapiens
  misc_feature (162)..(162): n is a, c, g, or t
  misc_feature (299)..(299): n is a, c, g, or t
tttggtgctagctgttctagagtatccctcttagtcctgctaatggtggtgttgttgcagaagaactcgaaggggctctcggtaggagcggtggaactcgatcagggcctcctcctccgccgtgtgtgctggggcgccgaagttcggggccccagcccttgntcctcacgcttgttcccctatcatgagccctggatgtggaccgtggagggctagagtcctgctcctccagctttgttcccctccatgagacctgttatgggctgcagaggtctagggtcctgctcctccagcttgtncccctggtctgtggcttccctctcttgcggcagtctcttgcgactttcttaaagtgaaagcgggtgtcacccaggattccaaaccagtgttcccttgcttaccttgatactgctcatgatacctcccctttgtaacgggacaggtggattttccttcattgggtcctaatgaagaaacttgacccttccccaaggataactcagtttccttgaggttagccacacaaaatagtgagcagagctttaaccagaattcagaattctcctcctcctctggggctattctacttagcgcttttggcgattacttcactgagacagactcatgggggatcggggctcaggtgcacccggatgtgaaagcgggaaaggctccttaaatccacaagagccgtggatcggctgactctggggcgc

SEQ ID NO: 704322 - DNA, 799 bp, Homo sapiens
  misc_feature (26)..(26): n is a, c, g, or t
  misc_feature (193)..(194): n is a, c, g, or t
  misc_feature (198)..(198): n is a, c, g, or t
  misc_feature (201)..(201): n is a, c, g, or t
  misc_feature (205)..(205): n is a, c, g, or t
  misc_feature (281)..(281): n is a, c, g, or t
  misc_feature (321)..(321): n is a, c, g, or t
ggagtctcttggaaacttctgcaggngaaaagagctaggaaagagctgcaaagcagtgtgggctttttccctttttgctccttttcattacccctcctccgttttcacccttctccggacttcgcgtagaacctgcgaatttcgaagaggaggtggcaaagtgggagaaaagaggtgtagggttggggttttnnttgnttngttntttaatttcttgatttcaacattttctcccaccctctcggtgcagccaacgcctcttacctgttctgcggcgccgngcaccgtggcagctgagggttagaaagcggggtgtattangattttaagcaaaaattttaaagataaatccatttttctctcccaccccacaagccatctccactgcatccgatctcattatttcggtggtggctgtgcggggtgaacaatttggtggctttttttcccctataattctgacccgtcaggctgaggggtttctccggctccgtcactgcgtgctacctgggctgcctgttcccccaacctgtgcaagggttaaattctggactgggacctgtcgcaggcacccagcctcaactctctctacattttgcagtgtctgggggagggactggtctacttggcagaaatttaaacaaaacaaaaaaaaaaaatttgggggcccgcccgaaaaatttaaacctctgtgggcggcccaggagaaagggcaagggtcagaaccggcacacgggggttcacaaaaccgggcgggttgaaccgggttggctggttagctatccccccccccgggaga

SEQ ID NO: 704323 - DNA, 211 bp, Homo sapiens
tcctctcggggattcccaggagagaagggcgaagtaggatgcaattggactggatggtctggactggtgaagatggagacaaaggattgcctggttcttctggagagaaagggaatcctggaagaagggggaacgggaggacgcgaaatctccgtttcatggaggctgaggcaagagaacatatcggagcctggatgtggaggagcccaat

SEQ ID NO: 704324 - DNA, 732 bp, Homo sapiens
ctatatctgaattctgtttgattttagcctgtaataccatctgaaaaccatgctttcaactctatacagtgatctttcaatgctaaacagcttaagtttgcttatgagactgtaagtacttttcaatcccgtcaaaaatctgagaatgaattaaatattacctgagtatacataaaacaccaaccatagctcctaaaacttaaaacaattgtagagacagctgactacctggctagcctctattccttctaatactggggcatctgtcctcaggcttctgccccagacatctttagagttcttgccaggattttggttccattttacaacatcagagtagcaaaacaaacaaatcactcttggtgttggtaaagaggtagaaaatgcagtgctcacagacagttatggtggtataagttggggcaaacaggtttttttttttttttaatttaaaattttcacacatgctgtgggctcatgttgggggtcattggaagagtggcctctggtgttctttcttgggacccttcctctggttgtgttcttgtcccatagggttgctgtatgctggagacaaaccgggctggaacgtgaatggagttccagtaaagggcctggaccctgtacaagtgatcccatatttgcgggtatgtcttggggtaacgaatcattgttcaagggggataccggtctctggccccgctgtgacacgcagaacatggtaaggacaca

SEQ ID NO: 704325 - DNA, 172 bp, Homo sapiens
  misc_feature (134)..(134): n is a, c, g, or t
actccagatggaacgactgttcgctcatatggagatcaggcgtgtccagtgtagtctagtgcgtacgaaatgatcttgggcattcataagtcttagagcgaaagcctataatcactgcgcccgctcataagggnatggccattcaacgcctccgggccattcaacgcctccg

SEQ ID NO: 704326 - DNA, 136 bp, Homo sapiens
  misc_feature (98)..(98): n is a, c, g, or t
tgtagtaggcgataactgtaggggtgtaggtgtccttgtggagaggatatttaatcttagagcgaaagcctataatcactgcgcccgctcataagggnatggccattcaacgcctccgggccattcaacgcctccg

SEQ ID NO: 704327 - DNA, 777 bp, Homo sapiens
  misc_feature (37)..(37): n is a, c, g, or t
  misc_feature (147)..(147): n is a, c, g, or t
  misc_feature (152)..(152): n is a, c, g, or t
  misc_feature (313)..(313): n is a, c, g, or t
  misc_feature (319)..(319): n is a, c, g, or t
  misc_feature (334)..(334): n is a, c, g, or t
  misc_feature (425)..(425): n is a, c, g, or t
  misc_feature (443)..(443): n is a, c, g, or t
  misc_feature (480)..(480): n is a, c, g, or t
  misc_feature (594)..(594): n is a, c, g, or t
  misc_feature (603)..(603): n is a, c, g, or t
  misc_feature (662)..(662): n is a, c, g, or t
  misc_feature (675)..(675): n is a, c, g, or t
  misc_feature (690)..(690): n is a, c, g, or t
  misc_feature (736)..(736): n is a, c, g, or t
agtgtcacaacaaaaccaatcactacactcatccacnctaagtagtaacagcttaggattcactcaggttttcacaagtcctgattcagaccttttttaaacaaagtagattggcataaaaaataaaacgcactactcacctcttanatggngttttatagccacgtgtccattttatatatatgagaggacaatttctaaaaactctgtaaaatatcaatgtccccttccaagaagggaaaacaaatcccaattttgttttaaacaaaaagtatgtggttttagagggactttacataaatggccatatgtnttaccngtaccaaattaagcngttttaaatttacagactacaagcaactcaacccaaatgtctaaatgtacatccttttctgttctacatttcagccaatattgcagaactnatgacaattttaaaagtngccattaccaatactgtttactgtggcaagacacctnaagttacaacaaaatcttaggaaataagactgaataatatctgttatagaaataccctactctttaccaactcccaccctccctgaccccttcaaaatcataagccgccctctnctgtcacanacaaataatgtaagactggtgaaacccaatttatgtggcgtatctctaggtccactgtntggccatactgtnatgtgctgctctctnggtcacatactgagtggcaatactccccaccaaggggtcggcaggnttacagtgtgtgagaagtgagcagagagaaaggaggactct

SEQ ID NO: 704328 - DNA, 1269 bp, Homo sapiens
ttccagtggtagcgagcagtaccaggtctcggtccagctcgagcgttccagctcaggctccagcaacgcagcacgtggcgtcaagcagtggcatccaggctcattccgtcaggcatccagccgcgtcaggaagctccagcacctcccgcagctccagcgtctagcagctcttcgtggctctccaagtccttctcggcgcagacagcgatgaacgaggaggcgctcccgctccaaatccaaaccactctaaaagagatgacacagggagaggaacaaggcggagcccatctcctaagcccaccaaagtgcacatgtgggagactcacccggaattgtgacgagaggatcacatcatggagatattttccacctatggggaaaattaaacatgattgacatgcccgtggaacggatgcatccccatcgtgtccaaagggctatgcgtacgtagagttggagaatccagatgaagccgagaaggcgctgaagcacatgggatggaggccaaacttggatggccaggagatcactgccagcggcgagctggccgccttgggcttagggcagcccccaaggaagattccagccttcccagggagaatggtgtgcacacaacggctatggtgggccgcaggtctcccccgaggtatgatgagaaggtcccggatccccagagggacacaagtgtcccccccggtgcagccggaaaaatcacggggtgcccccggtgccgtctggcagcaagaaggaaagcggacacaagaatccaaaagatcctcccggatagaaacaggggcccatgagagagactcatagcgcatggtaacatttttattcccccaccacaggaacaagtgaggggtgacacatcacccagcacagcaggggaaaaccaccaggagaggggaagaaccctaggtagaccgcgagcggcagataggaacgcgcgaacggggagggcgaacccaccacttatgtaacaaccgaggaggccacccggcgggcagagaagacaaatgacggacgggcccagcacaaacagatgatggccctcacaacaccaataaaaccccccgagcagcttgggtggacggacaagccaacacacaacgcgtgcctaacaacaacaaaaaacaggggggtgaaccggaagaaaagcaacacgctgatgttgttaccaacaaacaacgagcgacgaatgactcactacagacaaaacacgccgcaagcagaccgtagagtagtaggacagacagcaacaacagacaa

SEQ ID NO: 704329 - DNA, 302 bp, Homo sapiens
  misc_feature (244)..(244): n is a, c, g, or t
  misc_feature (259)..(259): n is a, c, g, or t
aagcaaggtgtctttccacatctccatgccttgtattttcattaaaaaaaaaaaaaaaaaaaagcatttcagggccaggctcagtggtttactcttgtaatcccagcacttttggaggcctaggtgggaggatcacttgaggccagaagttcaaaaccagcctgagcaacatagcaagaccttgtctccatgaaaaataaaaaattagccagaaatggtgatgtgtgcctaggagttccaactnacttgggaaagctgnaggcaagaggatccgcttgagccttagggagtttcaaggttgg

SEQ ID NO: 704330 - DNA, 563 bp, Homo sapiens
  misc_feature (330)..(330): n is a, c, g, or t
atctagaggaccccacccgggtccttctccaccctagtcttccatttcctccgcgccagtctccatggaatcaggggtgcaggacagaaagccagtcagactaatttctttctttcctcgcacttctccccactcgtcatctttaaagtagggtatcacaaggatcctctgaaaccctctcggggccccaagtacagatcccattagttcggctttcgtatctcctcaggcaaaaggggagggtgccttaggggccctcctcataggtggtctctgcatacacgaacctaacccaaattggctggggtgccagaaaaactgagctatgtnggaacaaagatgtcgtgcaaagggtacggtgaacaagggtgggtttaaaatatgaggggcagggaggaggatgcatttcaaaggctggatggatgtgtacagagctaaatgaagaggagtttacagatcaaggaggggttaccatgttgggtcagagggtcggaggcggccattcattgggctccccagatatcctagagggcgtaaatagggtcatatggtgacggtctcat

SEQ ID NO: 704331 - DNA, 100 bp, Homo sapiens
cctcctccttcatgtaaatgaaaccactcaatgtggtagtgactccagcagacttaattacattttaatggaacactgtctttccttttttttttcctct

SEQ ID NO: 704332 - DNA, 1006 bp, Homo sapiens
  misc_feature (14)..(15): n is a, c, g, or t
  misc_feature (19)..(20): n is a, c, g, or t
  misc_feature (22)..(22): n is a, c, g, or t
  misc_feature (72)..(72): n is a, c, g, or t
  misc_feature (161)..(162): n is a, c, g, or t
  misc_feature (255)..(255): n is a, c, g, or t
  misc_feature (451)..(451): n is a, c, g, or t
  misc_feature (468)..(468): n is a, c, g, or t
  misc_feature (543)..(544): n is a, c, g, or t
tgcaggctgtacgnnccgnntnctggggtggccagagcaaggcaagtttcgcccgggacccgcccagctggncgggagccagtagcagggaagggccggctggcgcgagcaccgccacgcggagccatgggggcggggcctgggcgggggcggggccgcgnncgagggcggggcagggaggcagcatgctaaaccgggtgcgctcggccgtggcgcacctggtgagctccgggggcgctccgcctccgcgccccnaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggcngggctgtgcaaagcccnccggacacgggccgccgcctgccctggagcacaggctacgccgagaccctgttctgccccagagcccggaggcgnnagagcccggcgaaggatgagttggccagttccccgtcgcggcccggcagcttaaaggctaagggaaaaggggtttcacgaaggagcggggttctttttaataggggacatagcggttgggaagactcgctcacccgcttcccggctccagcgccccagttccctgtccctcttaccgtagttcccctccccctccacacccagaaatagcccgcgacaccaggaggccgccagcttccccaggagcggggagggggacgcccggggtagaggagggtcccatttagatgcccttcagcctgccaactcgtgctggcctggcaaagaagcggaccccctgcccggagcggccggctggcccccgggctgtgtgtattttaaatgcatctgccgggaacgcagagcaccgagggagatgggggcgctcagttcgctgaggaaggtggctggtggcccatggacc

SEQ ID NO: 704333 - DNA, 266 bp, Homo sapiens
agtcccagcactttgggaggctgaggtgggtggatcacctgaggtcaggagtttgagaccagcctggccaacatggtgaaaccccgtctctactaaaaatacaaaaattagccgggtgtggtggcaggcacctgtaaccccagctactccggaggctgaggcatgagaatcacttgaacccgggaggcgaaggttacagtgagctgagatcgaaccaatgatacttcagattggaaaaaaagagacaaaacaatgtctaaaaaaaa

SEQ ID NO: 704334 - DNA, 826 bp, Homo sapiens
  misc_feature (14)..(15): n is a, c, g, or t
  misc_feature (19)..(20): n is a, c, g, or t
  misc_feature (22)..(22): n is a, c, g, or t
  misc_feature (72)..(72): n is a, c, g, or t
  misc_feature (161)..(162): n is a, c, g, or t
  misc_feature (255)..(255): n is a, c, g, or t
  misc_feature (451)..(451): n is a, c, g, or t
  misc_feature (468)..(468): n is a, c, g, or t
tgcaggctgtacgnnccgnntnctggggtggccagagcaaggcaagtttcgcccgggacccgcccagctggncgggagccagtagcagggaagggccggctggcgcgagcaccgccacgcggagccatgggggcggggcctgggcgggggcggggccgcgnncgagggcggggcagggaggcagcatgctaaaccgggtgcgctcggccgtggcgcacctggtgagctccgggggcgctccgcctccgcgccccnaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggcngggctgtgcaaagcccnccggacacgggccgccgcctgccctggagcacaggctacgccgaggtcatcaatgctggcaagagtcgggaacaatgagggaccaggcttgctgtgacagtgggtgtatgtggaaggtcggaggagtgttcagaggagttactagggagcttaggccgaggacgggagaatacttgtttatagttatggtggactaatttgatgggacatgcaagtgagccggagcatgctgaaaattggacatcacgggatccttgcattcgactatatccgagagcagctaaaggacctggtagagattactttcaggaacccttcggccaccatcccatttgactcgcaacacttcgggaccaag

SEQ ID NO: 704335 - DNA, 220 bp, Homo sapiens
aaaaaaagatcggcccgggaagggagcaacacctgtccattcagaaggctgttactgcctttggggaaggatttggcctagtatttacaaaattttacaatgttttcggcaaaacttgggattagggacctattaattggagatatgacacatttagagaagagttggacacattatattttacacactcttatattgagggatatatttagcacacata

SEQ ID NO: 704336 - DNA, 335 bp, Homo sapiens
tgcggcctggacccctacatacacagtgatctcctgaaaaccgtagagggccctcaaggcctttaatgcctcctaggtcaacagggcactcaggagctctcgggtgccctttctagacaccacccaacttcaaattttggcacgaaacaaaccgagacccgtaaatttatgcgcgaaatttcctccggacagggatcccagacatttgaagggatgatgatggattctgtgtgtttagagagcaacgcaacattgcctactatgtgagcaatgaggagctgcggggaagtactccagaggcagcgcgcaaggtggtgcagttggtgagtttgttg

SEQ ID NO: 704337 - DNA, 779 bp, Homo sapiens
tacagtttttttaaggccccctgtttttaagatttatttacgcggcatctgtcttcctttctgtggaaaaagttatacacaaatccactggtcccccctttgctaattctatactttaggaacgccaacttttttctaagcggtccttttctttaaaaaaggttaatacttctttgtcaccctccttggagagacatcatataacaatgaatgcacattgttcgcgagtgacacaatttcttcgcccccccccaccctccttgtaccaatactgaactatctccccttggatcatcaatcattatttatcgagattttccactccgtccaagtaaatatcatttgtgagtgaaagaaaagagtcccttctctgagaaagtaaacagaaatatatgtttttacatttctatgacaagaaccctgtattcacacagttcataatgctgatgttatttgacacaatgtttgtatctccttgttgaggcgcagaactaaattgtgtgttatcttatctccaagacttaaacattccccgctttacagaaagtgcgatagatacaacttctccccctcctcctatactggacagtgtcgtggattcttccccgctggcgaacctcctcttgcccccaaaaacctttaaaagacagcacagaactatttaaatagaaatgcgtactaatttgtgtagtcacctatatatgcagtgactcccccattgtacgctagacaccttcttaagaagtaaataaaaataactacgaaacctatcaatgtcc

SEQ ID NO: 704338 - DNA, 426 bp, Homo sapiens
gtgggcacaaactaaagctggccacagtcctcaccacacccactgcaccctgggcactaaagaagattacagtttctggctgggcgcagtggcgcacgcctgttaatcccagcacttcaggagggcaagggtgggtggatcatttgaggtcaggagttcaagacgagcctaacatggtaaaaccctgtctctactaaaaatacaaaaattagcagggcgtggtggcgcacgcctgtagtcccagctacttgggaggccgaggcacaagaatcacttgaaccgtggaggcggaagttgcattgagccgaaattgggccactgcagtccagcctgggcgacagagcaagactccatctcaaaataaatcaatcaattatacagtttctgtctatcatcacatgtgttcccacttgctttgcgggggat

SEQ ID NO: 704339 - DNA, 664 bp, Homo sapiens
  misc_feature (67)..(67): n is a, c, g, or t
  misc_feature (82)..(82): n is a, c, g, or t
  misc_feature (84)..(84): n is a, c, g, or t
  misc_feature (94)..(94): n is a, c, g, or t
  misc_feature (165)..(165): n is a, c, g, or t
  misc_feature (182)..(183): n is a, c, g, or t
  misc_feature (197)..(197): n is a, c, g, or t
  misc_feature (243)..(243): n is a, c, g, or t
  misc_feature (260)..(260): n is a, c, g, or t
agattacagttgcgggcacagaaatttaaataatggaactttctctaagagaaacagaaaggagacnactagcagcacttcncnacatctttcntaaactcaaattaactcatcctctgtgatcatacctgtgacctctgggtgcttcagcagagaaagagagcnatatctcagggtgtgcnntgtggtctctgtcncagctcaagctttcctaggaatgatttgatgcaattatctgacaanttatttaacagcatatntgatgacagtaaattcaaattactcaccattgtatacttaccaacatagaaactgtaaagtatagtactagaaaaaaatattgaataggagaaagaaattaagggtaatcaattaggaaaagaggaagtcaaattgtccctgtttgcagatgacatgattgtgtaactagaaaaccacattgtcacagcccaaaatctactgaagttgcttatcagcttaaggagattttgggctgtgacaatgtacaaaattcacaagcattcttatacaccaataacagacagagagccaaaacatgagtgaactcccattcacaactgcttcaaagagagtaaaatacctaagaatccaacttaggagtgatgttaaggacctcttcaaggagaactacaaaccactgctc

SEQ ID NO: 704340 - DNA, 204 bp, Homo sapiens
cgctcgtcatcggtgccgtcgccgtatggcttcacaaccgctatcacaacatcgagctcccgctttcctcgggttcttcggaggctcacgcttcgttcccattgttacggctttcgcgggaatcatcattggcgcattcttctttgtcgtctggccaccaatccaggccgggatggtgtcagccggcactgcgatcgcagactg

SEQ ID NO: 704341 - DNA, 1080 bp, Homo sapiens
  misc_feature (12)..(12): n is a, c, g, or t
  misc_feature (524)..(524): n is a, c, g, or t
  misc_feature (713)..(713): n is a, c, g, or t
  misc_feature (735)..(735): n is a, c, g, or t
  misc_feature (766)..(766): n is a, c, g, or t
  misc_feature (787)..(787): n is a, c, g, or t
  misc_feature (865)..(865): n is a, c, g, or t
  misc_feature (895)..(895): n is a, c, g, or t
  misc_feature (915)..(915): n is a, c, g, or t
  misc_feature (987)..(987): n is a, c, g, or t
  misc_feature (995)..(995): n is a, c, g, or t
  misc_feature (1008)..(1008): n is a, c, g, or t
  misc_feature (1016)..(1016): n is a, c, g, or t
  misc_feature (1076)..(1076): n is a, c, g, or t
ccatccgaacgntggccgatccgccacacaagctccggcgtctcgtcacccgggatcctctcgccttgatgttgagcgtcctgcctcccgagatttggggcgtcgtcctccggtctcacaaagtcccgatggctctcctccagagagcggatcacctgagccggctgtttcgtcgtcatcgtatccgggcggtctggcccagcctcccgctccgccgactcagacgaccgggtccggtgaggaagagcctcagtcgcctcaacaatcgtgacatccgtgactggggaatggtcgttgtccctccccgtcggacgagtgtcgtcgacaaggcccctcgcgtggaccgtcttcatgacgtctgggttttggccggagtgtctaacttttctctctgtctcgccaccctcgcccagattctcgggagggtcacccggctcatccgtcggcgggactgcccgaggggacctggcctctttctccacgtcgggcttcagctcgtttaggggtagttgatcctggacaancacatcctcggacggaacggagggaacccggtgctcccggcactcctgtggtcctatttacacaattaggtccggaaggtgtttcgaccacggtcccacggtgacgggcacccaggcgtcggggtccagatgggggaccgttggggcgacgaccttgacgcgtctctccacatggtcacggcccggaanaccggtgtcatcctcgtccccnctgaccgggtcgtgaggggaagctgtcggcngaacgttgcccgtcggctccncaggttccctcttgggtcgttggttccacccatccgagcccccgtcttaccggcgaaggagggggtggagatggcccncaaggcgactcgccgggtcaacaaccgccngctgattctggtacgaccangtctctctcagttggcggtatggtatccggctctggtgacggagacgacgaacatgatgatgctgaatgctnatgcccancacatcttcgtgnagtgacanatgttgttccacggggaccaccgtctcgacccacatctcccttggttgctcgtccacttnctcc

SEQ ID NO: 704342 - DNA, 926 bp, Homo sapiens
caaatcgcacggtgtgatacaccgtggaagcgcagtaccaaccatggagcttggcactcgaggaccattcacaaggcgaatgtcctgacacccagacgtcgccagtgtcacccccactgttagggtcgcgaaactcaggaaaggggcaaccaagggtcaaactccgcgggccaaagaggccgtcgcgaagaaatttaaacccgggcccgaaaccaccaaagtggggtgtgcacaggagaaacgcgccccgagggccacgaggtccccccaaggcgcaaccacaaaacccctgggggacaggccgccccaactttttccaaccctgtgggaggctgggtgagaaacaacggttcgcccacagaaggatttatattgcgggaacagataccccgtctcccgtccgaagttattatgcccgccccttcttggagagaaggaggaaggcgcccatttctaagcacagcccacttcgcacgcagtggttgaggcgtcctggtgaacaccacagcgctccacaggcgcctcccaaagagagccaactgtgtaacctgtttttttggagaggattgttctcccacgcttttgttaagagaaagagctgccacaaggcgctgccgaataataggaggcaccctcgtctttcgcgaaggaagggggtaaaacacctggttgctgcgacaaatcacaacgtgcctccttatggcgtgatgaaccattcgacccgtgttgcagcgcattcttcccgccgctccccctgtggaaattaaggaggagaagagaaattgaagagctgtccaaagcgttatattctaaactctgtgttttctcttttttgttggggttaaaccccccccccgtttaaaaaaaaatttttttatcctttccccttttttttttggttccaataaaaaaaaaacccaaaaaaa

SEQ ID NO: 704343 - DNA, 1018 bp, Homo sapiens
ggccaatactaccaagtcaatactcatcattaataatcataatggctatagcaattaaaactaggaatagcccccgtttcacttctgaggtcccaggaggttacccaaggtcacccctctgacatccggcctgtcgttcttctcacatgacaaaaacaatagcccccatctctaatctatataccaaatctctccctcactaattcgtaagccttctccatcactctctcaatcttatccatcatagcatggcagttgaggttggattaaaccaaacccagtctatcgccaaaatcttagtcatactcctcatattacccacataggatgaataatagcagttcgtaccgtacaacctaacataaccagttcttaatttaactatttatattatcctaactactaaccgcattcctactactcaaacttaaagcccccaataacccagcttccatccttactagccagagcaaccttaggcctatccatttagacatactaatgtaaaactatccgtagggcatttctatcgtgcggttgcggaagaaaacgtagcgtctgtgacttggtcgcatggttgcacagtctggcttttccttgacccaggtttcttctctcaaggggttagatgtgggcggactccctatcgggaacgggtcatgaatttgcgaataggcccgtttaccctggattcgattgttcgggaaaatggcccgaatctggtactttctaacgaagatcctgaaagagattgaaaaagaagaggcgcctgctgctgagaaagcagtacccacgaacgaattcaggctgatggactgctcccgatcccgaatgactggtacacagcttcgaggtgcgaccggctgaaggttaggtggctctgtgccttccgattgctcaggaccatggtccaccgccggaagttagcgccccgtcagcccgatggaggccggaggttcagacgttctagctcaccgaaactgtgaaacacttcacaaaaaacagctctgcgacagaa

SEQ ID NO: 704344 - DNA, 786 bp, Homo sapiens
ggcaccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaagggcaggagacagacacgtaacaggaactccgaaggtagaacttagaattcagaacttgggtttcaattgtagaatttggaatctggaatacagaattgggaagaagaacagagatgacaaaagaccacttgaagagaggttcctaatactagacagatggagagtggcttggctggtttcccctgcatattggcgttgaaaactaaatgtggagtccagtccttctatgcagagtctttcctgcctaccttcttcctgcaggcaaatatccagctagaccctggtacttacctggatcccggctacctgattgccatttatcaacccaccctattctggaggcccccttggtgtggaggtgccgggaggggtagtgactcttggggtctctcaattaccccattcctaatcataacccttgggtagctgacccttctaccatccagaaaacttgcctgaaatgctgttggaacccttaaactttctataaaa

SEQ ID NO: 704345 - DNA, 103 bp, Homo sapiens
gctagctgagacgcagcgttgcactccagcctgggcagtacaagtgaaacgtctgtctcaaaaagaggcaaaaaaaatcataagggcaaatacattctccaga

SEQ ID NO: 704346 - DNA, 331 bp, Homo sapiens
gtacagactaaagaaatcactcaagcttcacattggtaaactgaactcagtttaagattaagaaactgatttcggccgggtgcggtggctcacgcctgtaattccagcactttgggaggcccgggcgcgtggctcacctgaggtcaggagttcaagaccagcctgactaatatggtgaaacaccgtttctactaaaaatacaaaaaaattagccgggtgtcgtggcttgtagctgtagtcccagctactccggagtctgagacaggaaaattgcttgaacccgggaggcggaggttgcagtatgccgagatcgctgcacttcagcctgggc

SEQ ID NO: 704347 - DNA, 132 bp, Homo sapiens
gtgcctatagtcccaactacttagaggaggatcgcttgatctcaggaggttgaggctgcagtgaattatgattgtggcattgcactccagcctgggtggtagatcaaggctatgtttcatttgaaaaaaaag

SEQ ID NO: 704348 - DNA, 286 bp, Homo sapiens
ctgacggcacctggcagtgcctgacatctgcgcccactgtgcttcaaccgcaggcttctgcggccgcaatgccacggtctaccgggaagggcgtgtatttcgccatgtcgcgcctccctgtcgtgtgcaggacctgctactctgcccccctagcgccgtatggccataatggcgtgtgttctgtggcaccgggtgctgacttggctgactacgggcaggtgccagccgcggtcttgcgggcgcccccttctgcgtgggtccttggccactgttgcttccttgcgct

SEQ ID NO: 704349 - DNA, 639 bp, Homo sapiens
  misc_feature (592)..(592): n is a, c, g, or t
tgggccagcatcctccgtgccgctgcgccgccaggtgctgatgagggatggaaaccgtggccgcctggtggtgcggggagaatgtgctgggccggcccgggagccgctcactttccctgggggggacctacgctgtgagacctctggctatcctggccttcctgaggcccacgaggatggctgcggcccaactgcctggggcctggagcattgagggccggaccctcgctgagacagcatgagcctggcctgacgctggaaaccacaccctggcccagagctgccaggccctgactgggacaggagccaggggcagctcaccatgtgctgcaaggaacagtgtctggggtgatgtacccccagcgtctggggtccattgtagcccgcctcaggtgcacagggcagagtgttgtggccccaccattgagctgagaagggcatgatgatgtgttgttgttgcccccggtgcccatgcgtcctgcccacagcgccctaagagccttgctcttctgctcttggtgcccccgcgcgaggttgggtgggagggtggggcccacgcgaaggagggctccttcggccggccctcagggcntgccaaccttgggttgtaccaaggttgatccaggcccttggggccca

SEQ ID NO: 704350 - DNA, 301 bp, Homo sapiens
ccaaaaaaaggcccttttgggtttttgggtcacgtggaacaccaactctgggcattgccacaaggcccaggccgtgttgggtgtgttttttaggcgcgaggcccccaagaagtttttggcctacaaaggggtgcgggcagcgcttaaggccctgttgccctaccttgaggggcccttttaggggctcagcaggaccctccaggcccccgcttttttggccttcttttggcccaacattaagctccctgtgccggcccccgccccccccccctgggaaacccataaaggggcgctgccctta

SEQ ID NO: 704351 - DNA, 245 bp, Homo sapiens
tgggaataggatctcgctgtgtatccaggctggctcgaactcctggctcagggatcctcccactttcagtctcccgagtagctgggacaacaggcatgacccacccagctggctggtttggggtaattagtttggtttggggttttgctacttttttggggaaacgtttgggcaagaacatgtgaggacagggataaggccgacagggggctatctggcatttagaatgtgttggggataacata

SEQ ID NO: 704352 - DNA, 221 bp, Homo sapiens
gagttcccacgcaaaatttactactacgattaacaaaaggggatgtcacaaatcagaacaataaacaagcgtagggcttatacactaaatactacgatagcactgggtcaccgtagacttagatcaaggcggcaatggcaatgccaacaacaccggcgaccacggcaggcacaccgctgaaggtagcagcaccatcattgccacccttctgtcgtcttctc

SEQ ID NO: 704353 - DNA, 104 bp, Homo sapiens
attgtaacacacgactcgtcactgagtcttccagtggctttgtacccactcccgtcattcaatctgcccgggggatcctactagagtctgaaccctgccaggcc

SEQ ID NO: 704354 - DNA, 316 bp, Homo sapiens
  misc_feature (2)..(3): n is a, c, g, or t
  misc_feature (36)..(36): n is a, c, g, or t
  misc_feature (58)..(58): n is a, c, g, or t
  misc_feature (77)..(77): n is a, c, g, or t
cnnacgccacactggtcaataaacccacagtagaancaaatttttttgttagggatgncttgtaaaattctgagcanatttttgcctgaacaagatgaatctcccttcctttccccaaccatctttggtaaagacaccaagcctggatgaaaataagctgtgataacccagtgtttccagttatttcactctccatcctctcaaaggtatagataaagcactcccattctgtttgagaatctggcctgatgaaatcaaaggtagattccgtgatcaaggaacggcacctgcttgagtcaagagtggctttagtgag

SEQ ID NO: 704355 - DNA, 229 bp, Homo sapiens
atttatttgaaacaggtggtgatgaaatttctgtgaaacctgtgaggctgaaagggggtgggatgggggtactcaatggagtatgtctgatggatccctgaagaatggatgaggaacacaatgcgctgagatatggcagcagcctgagagaccacaccccaccctgcaggtgcttgccctgatgcggcctggactttctgggttcgtgatgcgcaatactatgtcacgc

SEQ ID NO: 704356 - DNA, 599 bp, Homo sapiens
ggtcaggtggcggaactggtgctccggcgagtgtgaggtgtctgatgtgcgggctggacagtcgcctgaggttggtggatgagctggagtcatggagcgactaggcggtgtgtggagctgcctgtgaagagccgttcaggcggcttgggcgaggatcatcgaggctgaacttcggtccacgcaaggcacgtgggagcttactgtcgtgagggcgaggatgattgtgccgggagggcgatggcatgatggcccagtgtgtttcgaggcagttccctccagagggcctggcaccagagcgagcttgtatgctgacttggccagttgggaatatgttgggcgttcaagcaaagtgccaatggtcctaacaaagtaggattctggtgtgggataagagtagcttggtgacagggtccctggggatgttgccggagattggttgggacaaggcattgggaggaattgatggatgccactcagtgactggaatcatagccttgtgtcacagggggtgtgcgtacaagagtctagacgaaatgttggtgtgtgaggagaggcagcatgggagggagttgatcgaagagtggaggcagtgagagtga

SEQ ID NO: 704357 - DNA, 102 bp, Homo sapiens
aaacaaaaaaaaacaaaaaacaaaaaaacgaatctatgcactatataggcgccacgttttttacgaagacgagcgcagcgaagtatgtgagcgaggaagcgg

SEQ ID NO: 704358 - DNA, 255 bp, Homo sapiens
acgcgtccgcccacgcgtccgaaaaaggtccagatttctggcttctcttaaaaaataggaagatgtggccaggtgcggtggctcacacctgttatccctgtagtttgggaggccgaggcaggtggatcacccgaattcaagagttcaagaccagcctggtaggagaatcgcttgaacctgggaggcggaggttgcagtgggctgagattgcgccactgcactccatcctggttaacaagagcgaaactccgtctc

SEQ ID NO: 704359 - DNA, 520 bp, Homo sapiens
  misc_feature (390)..(390): n is a, c, g, or t
  misc_feature (392)..(392): n is a, c, g, or t
  misc_feature (398)..(398): n is a, c, g, or t
  misc_feature (416)..(416): n is a, c, g, or t
  misc_feature (423)..(423): n is a, c, g, or t
  misc_feature (451)..(451): n is a, c, g, or t
  misc_feature (470)..(470): n is a, c, g, or t
  misc_feature (477)..(477): n is a, c, g, or t
  misc_feature (498)..(498): n is a, c, g, or t
  misc_feature (512)..(512): n is a, c, g, or t
cacggcacccggcccttttgctttttataaattgatacataatatgtatcacttggaagtaagggaaatctgaagtgaactgctttcctatgctccagaaatatctctctacaaacacttaacacattagttacagatctttttcctattctttgaaataaggccccaaataatctccatcagaacagttagcttaatgtgaattactttatatatttgaaatttaaaaaagacatatattgtaagtaaggtatggctccacattttaattatgccaccctgcttcctcccttaattaaactgaagaaaaaaaaagtttaatatactggtgctaccactatatcctcttttccaaagaaaataataatatatttaaagttagtaatattntnttcccnaaacatgatttgccattncttacanatttgtaggatcccgggggaggattccnaaatccccaagttattatnatatccnaccccgggatcccggaacggnacctgccaggcttnccaccttc

SEQ ID NO: 704360 - DNA, 136 bp, Homo sapiens
cgtatataagcttatacgtatgtgctaggacacaacatgtgtcaaacagggcactttctgttccttttccataaatggcttataacagaatgtgggttgctatcgtgggagtggtatcacttagttcagcgtctga

SEQ ID NO: 704361 - DNA, 340 bp, Homo sapiens
  misc_feature (72)..(72): n is a, c, g, or t
  misc_feature (106)..(106): n is a, c, g, or t
  misc_feature (169)..(169): n is a, c, g, or t
  misc_feature (263)..(263): n is a, c, g, or t
  misc_feature (288)..(288): n is a, c, g, or t
  misc_feature (330)..(330): n is a, c, g, or t
aatcattgtttattactggtcacttagaaaattaaaagggatagggccaggcacagtggcttatgcctgtanttgcagcacttttagaggccgaggcaggcggatnacctgaggtcgggaagtggatcgcctgaggtcaggagtcgagaccagcctggccaacatggcnaaaccccgtcgctactaaaaatacaaaaattagccaggtgtggtggcatgtcctgtaatcccagctatttgggaggctgaggcaggagaatcgnctaaacccaggaggtggaggttgtngtgagccaagattgcaccgctgtgctccagcctgggcaacanagtgagactc

SEQ ID NO: 704362 - DNA, 669 bp, Homo sapiens
actttcagaggcagaagtgggagaatcatttgaacctaggagttcaagaccagcctggacaacatggtgaaactccatctcatatatatatataaatggccaggcatggtggcatgcacctgtggtcccagcaagtcaggagactgaggcaggaggatcgcttgagcccaggaggtagaggctgcgccaacccctgattgcaccactgcactccagcctgggcaagagagcacagcgcgtctcaaaaaaaaaaacaaaaaaaaaaaaaaacaccccagagaggcatctcatatgtgcgcgcggggcggacaaaacaagaggatcaacgtgaaacgtgggccacagagggcccatacacacgagacccaggacacccagccctactccgggctcccacggcggacaacacactccggcgcgaggcccacacacactaatgcgcggcagggcggacacatacaactccccgcgaaaaaaaccgcccaagcggcaccaccccccggcaccatcacacaggacaaccccggcgaccaacaccgcacaccccaagccgccaccacaccaccccaccgccagagcaccccacacacacacgcccccgctcccgtcgccaccgcacacaacagccacccacaccacaaccgcacccgcacagccacgccagcagca

SEQ ID NO: 704363 - DNA, 1144 bp, Homo sapiens
ggctatgtgccaagatcaatcctccatgagtagtggtggtggcagtggtggctggttatggcaatcaagaccagagtggtggatgtgtggcagctggtggctatggacagcagtgacctgtggaggactgaggcatggggtggcacgtggtggctggctgtgtgtgcgtgtggcgtgtggtggttagcaaccgaaagcagtgggtggctaatgaacccagaggtcgtggagggtggcgcgtggacggcaggaaggtgtgatgggcggaaagtgaccgtggtggcttcaatacacatcctggtggccctcgggaccaaggatcacgtcatgcactccgaacagcgatcaattcaggacaacgaaacaccatcatattgtgcaaggcctgggtgcgcacagtgttacaatatgaggtctgtggctgattacgttcgaatgcagcattggtactacgttaacgagcaaacgaaagaacacacgggacaatgtccaatgagtataagttatggtacaccagcacagtggaaaagctgggcaaagcttgaccagggcagagggccccacgcgtcgtcttcacctgagtcgaccacgaagctttcagcctaaaatgcacggttaatatcggactgggctctgacttctgctaccacgcaatatcttccgcgcacgagtccgtaatccacaagggtcatcatacttgagctcacgtcagcaccggacgccacagcaaccatactccaaagtccgcggcccggtagcgcatgcggcacaacagcggtccaggcagcgacaagcgcccagaagcggaccagcacgggaagcgaaccaccaacgcgacgccgcgataggcaacacccttacctcgcgcacgagcgtcggagctcgcggcaacgccagcccgaccaggcacacgcactgccgaaccagcaaacggcagaggggaaaaaaagaccgacgaacgagcgaaccgaacccgagcacgaccacgcgcacgcgaagagcgaccacagaccaagcacacgcacggccaccacagcaaggcaacgagcacaccaacgagaacgaccccaacacacaacccacacccctcagcagaccacaaccacctaacgagacatcgcacacagccgaacgagccacgccc

SEQ ID NO: 704364 - DNA, 172 bp, Homo sapiens
gaaggctgcaggcacgatgtagagagatcccctcagggcggcaggtattcctaggccccacaggtgccaaaggcctacgaggaatcccaggcttcgcaggagctgatggaggaccagggcccaggggcttgccaggacccccaggccccacaggtgccaaaggcctccgagg

SEQ ID NO: 704365 - DNA, 349 bp, Homo sapiens
cggtcggcctgctgttctctcctcggctctgctcgtcatttactatcacacccaactatctattaatctagccatggccgtccccttctgtatgtcgggcgcagggcattgatggctgtcgctctacgattaaaaatgccctcgcccacttcttaccacaagggacacctacaccccttattcccctactagttattctcgaaaccatcagcctactcattctaccaatagccctgggcgtacgcctaaacggtaacattactgaagggcacctaatcatggacctaattggaagcgccaacctagcaatatcaaccattaaacttccctctacacttatcatcttcac

SEQ ID NO: 704366 - DNA, 318 bp, Homo sapiens
  misc_feature (219)..(219): n is a, c, g, or t
  misc_feature (223)..(223): n is a, c, g, or t
gctagaatggctgcgggggccgtacgcggtgctcatacctttaatcccagcactttcggaggttgaggcgggaagatctgttgcgtccagctcaaggccagcctggacaacatagaccacccctgtctctacaaaaaaataaaaaagaaagaaaaaaagaaattagccgggcgtggtggcgcgctccagtagtcctagctactcccagctacgccggantganggcggagaggtcgcttgagctcggtaggtcgaggctgcagtgagccatgatcgcgccactgcactcagcctgggcgacagagtgagactgtctca

SEQ ID NO: 704367 - DNA, 672 bp, Homo sapiens
  misc_feature (162)..(162): n is a, c, g, or t
ggtccggaatcggtgtacgtcaggtgcgcgtgtatccgcgatcggctgctggtgtctctgggagcgttgcatgttccataccatactccagttgaggataactgtgatactcactaaagtgaggacttatcgactaattatcaacgaggatgtatccaagtntcttcactggattcatattcgccctctggtgcatgtataattccacttagtgatgcctgtcaatagatttatagtactaatggatcgttataaaatcaagatctgactggttgccaatctcataggagtacaccagtccatatgaacaatgtctctatgtatagactcgtttgaatctcgttacctgaggggaacacaggaggacaacacacgaatcgtaatggactgcagtggaaacgtagatatcgagaaattacgtttggtattgatccacgcccgctaaattcttaggaagccgtggacatcgaccagagtgtcggcaagagtacccagtcaagagagcttagggttactggtactcgatgtgtactgtgagcaaacgagcacaaagatttccacattggcctttcactacatcccaggtggaaagaccagggtggaggcctctaatggaccgcaaggtgaactggagtgtggttaccaacgacaaagatacagtcaatgtacaaa

SEQ ID NO: 704368 - DNA, 360 bp, Homo sapiens
ataaaggaagcaagtgatcccacaagatgaagctatatatatcatgctgcaccatgcatctatagagactaggaacggtgggtggtgggaccaacctactacctcagcaagcctgttagcagatgttaggtgttcaaggagcatgcaaagataatcctggggcaaatgcccggtgcttgcccgaaatgtgtgtggaaccgaaatgactggggaatcgtttttaatggcagcatcggcaacaggacatctagtcaaaagtcacatgatacacaacaggtcgacagatcaaataaacaagacctccaaggagcttgcaccaagacagacagcctgactcagcccgacagttctgaactggaa

SEQ ID NO: 704369 - DNA, 561 bp, Homo sapiens
gggaggggccccccccgcccctttaaaaaaaccaaaacccccaccaggtttttcggaaaaaaaggaacaatcgaaaggggcccctaggggaaaacctggcgcccaaaaacccatttccaaaaaaaagggcaaaaggcccctaaatttaccagcccccccccaaaagggcccaatcccggggccccaacaaaggggcgccccccccgaaaaaaaaaaaaaaacctccccccaacccggggggggggcgaaaataaggcaaaaacgcgtccccggggaaaaaactggcccccccccacacggcaaagaccctcttattttttgggcccgcggtttcccccacaaacccccgggaatttccccacgggaaaccccccgtaaacccccccccccgggggccccgcccaaaaaaacccccccggtatcttgggtatacgccccccccctcgaaaaaaaaaaaaaaacccctcggatttctaattgggcgcccaaaaaaggcgggcgcaaaactggcgacacgctgtcctccgggggaaaaactccccccccccacctcccccacac

SEQ ID NO: 704370 - DNA, 617 bp, Homo sapiens
  misc_feature (3)..(3): n is a, c, g, or t
gcncctttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgcccccccgggtcctgcgccgtcagcacaagccacgcttcaccaccaaaaggcccaacccctttttttaggtgcagggccctcgtccgggtgtgccccaaataaactcaggaacgccc

SEQ ID NO: 704371 - DNA, 495 bp, Homo sapiens
ggacgagccgcccatagacttccagacgagatcgccatgcgtgtgaggtgaaggccgaccccgctgcgctcatggcctcgctgctgctcctgctgtcgcccatgcgcaagctcgagatcaagtacaccatgatctttattaacaatgaatggcagaactcagagagtgggagagtgttcccgtgtctgtaatccagccacaggagagcaagtgtgtgaagttcatgaagcagacgaggtggatatagacaaggcagtgcaagcagtccggctttgccttctctcttggttctgtgtggagaaggatggctgcatctagaaagaggacgtctgttggacaagcttgcagacttggtggaacgggacagggcaactcttgcaattatggaatccctaaatggcggtaagccattcctgcaagcttttaacatcgatttgcagggagtcatcaaaccctgaggtattatgcaggcgggctgataactcacggatgacc

SEQ ID NO: 704372 - DNA, 1869 bp, Homo sapiens
aggggtcctagcaggatgaagccatttaaatacaaccatcctcagggattcttcagtccatcgctgatcgtcccgcgcagaccgtaggtttcccccaaggccgtcaccctgagacactgggcttctgctttactgctacgtggacccagcatggtgagctctatgaagtagttgcgtccagaagtacgaaccaggcgcaacttataagaaggcggtcaccctgagaagaagagaatagaaacaggaagaaacaaagaaaaggagaaaacagcggagacagagaagaaacagaagagaaataagacacaaagagagggggggcgcggaccggccctggaagtctacctgggtggttctccggaggaggggacactcgcacccctatgctgccctctaaacctcggaggaaaggacaagcagggagacactcaacgagaacacaaaaacagagacggaacagagagaccacccgaccaggcacacaagaaaggggggcgcagcatccagacgcccaccgggaaaagcagaacagaggcagggacgcggcgtacgccgaaaaacaccacaagtggcagccgagcacagacgagcggtgtggggaacaacgcaccgaaaacaaacgccgaagggagaagcccagcgaccacgagaggaaacaaaggccagacagccggacgacacaacccccaaccccacagcggggcgtctcctccaaaaggaccacaccaagaaaggacgcaaaacccaccacaggagagcagcaccacagcaacagaaggcagagagaagaagcaaacaacaaggatctacaacacacaagacatcaacaaacagctgacaaagagcgctccaaacaccacagaacagcaagagacggacacagcaccacaagataaagacagggcgcagccacacaccaccatagcagaaaggtagacacacaccacagctgagacgtcacgaaacgacacgagcatcagagcgccggccaccacaacaagcacacaccgaaggagtgaataacaacacaccccccagcacgagtaggagagacgtgacggagaggaaacacaaacacgcgcacggcagcgaccaaatacaagccaaggcgtctagacagagccgacacacaaacagctgagagacagcacggaaagcacaccacaagaccagtcacgagcagcacagacgatagggcacaagagcgaaaaagacgcagctaacacgaccgaacgtcgcggagagcactgttagcacatgtcaacacagacgactacaccgagcgcacggagaaccaaccaaccggagcaggcgaacgaaccgaacgagcagtcggcacagcgaactacagagaaggggggcagagacaacacctactacaaagagaccactagcccaccagcaagagagagagggagataaacaacaatatgcgaccagagagaacaaagaaaggtggctgagaacacacaaaaagagacaccccaccccagggaggaggaacgactaatcactactggagaaagtgaaagtcaggactagacaacccacaaaaggagggaaacgggcagaccagaagcacaaaccatcagggaaggggaagagaggcatagagcgcagtagagcagaccacgcacgcgaataagagcgggacggccgagcagacaggaacgaccccgcgagagaggggaaggaacgcagagagcacgcggccaacccacagagccaacggaagaggcagtaggggtaggctcggagacgaaagctacagccaaccaccagcaagaatcgtgagagggcagagaaataactgacgtaggagcagccaagcgacagagacaacaacacacccgaggacgaggaagcaaa

SEQ ID NO: 704373 - DNA, 1089 bp, Homo sapiens
  misc_feature (3)..(3): n is a, c, g, or t
gcncctttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgcccccccgggtcctgcgccgtcagcacaagccacgcttcaccaccaaaaggcccaacccctttttttaggtgcagggccctcgtccgggtgtgccccaaataaactcaggaacgccccgaaggtacaagctgctgttccggatgactttaaggacttcagtctgctgtaacgaggaggcgcgctaatatcagttcaagaccatggtgaggcgagcttggagcgctggcacgcatgacccggagaagagcaccggaaaccgggatggggaacggctggatgccaagtcaagcgccagaagatgggccaagcgggaccggaccacacgacgagcactgcccgcttaagaagaataccacagcaacgcgaaagcaacagtaaggcagaacaaaccgaggcgacaccagagcggcgcgaaagaaaaaaacgcagcacaacgaacacgcggcagcgcaatacgcagcgcgctctaaagagaccgacagaaagcaacccgtcggggacaaccaaggcgagacgaagcccccgggacgcaaacgggagggagaagagcgcaccgcaggtccgaataaagagaggaacagccgacat

SEQ ID NO: 704374 - DNA, 755 bp, Homo sapiens
  misc_feature (3)..(3): n is a, c, g, or t
  misc_feature (730)..(730): n is a, c, g, or t
  misc_feature (732)..(732): n is a, c, g, or t
  misc_feature (736)..(736): n is a, c, g, or t
  misc_feature (738)..(738): n is a, c, g, or t
  misc_feature (741)..(741): n is a, c, g, or t
  misc_feature (743)..(743): n is a, c, g, or t
gcncctttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcagggggacgatcgggcctcacgtgtggggcagggtgttttgagaaatggtccccccttgcgggttgaaggaactcccggggatcgtgggctggcggttatagactcccggagggggggcaccccacaaacattgtaccgcgggaaatacgggggacctttgaaccaccgaaggcggggtcaacccacaggtggcctaccgagcacaatggggtgtgcgccgcgaacccggcgcccagagccccaactcccattcccagatcatgggagggtggcaggaagatccggggccaggccaaggtggccgccgggccgggtttgggcaaagaacaggtcccaggacttccaaagatcaagggtcccccgcttgcccccaaagcgggtccctggcgccgccaggaaaaagcccaggttcaaccaagcaaggaggccaaaaacctttcttcctagggtgagggcccccttggtcgggggggtgcccaaattaaattaggaacggcggggaaaaaaaaaacaaaaananaaananaanantttttggggggc

SEQ ID NO: 704375 - DNA, 167 bp, Homo sapiens
ctctcggaaaatgacatagaggcagcgtcagggctggattcgtcatgtggctctgccggctccccttacccaagtctacgcatcgtcccatctctctgatcctgtaatcaacacctgtccccaaggtagcttaggtgtgtccaggcacgacggcacacgttgggtac

SEQ ID NO: 704376 - DNA, 665 bp, Homo sapiens
  misc_feature (3)..(3): n is a, c, g, or t
  misc_feature (640)..(640): n is a, c, g, or t
  misc_feature (642)..(642): n is a, c, g, or t
  misc_feature (646)..(646): n is a, c, g, or t
  misc_feature (648)..(648): n is a, c, g, or t
  misc_feature (651)..(651): n is a, c, g, or t
  misc_feature (653)..(653): n is a, c, g, or t
gcncctttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgcccccccgggtcctgcgccgtcagcacaagccacgcttcaccaccaaaaggcccaacccctttttttaggtgcagggccctcgtccgggtgtgccccaaataaactcaggaacgcccgcggggaaaaaaaaaacaaaaananaaananaanantttttggggggc

SEQ ID NO: 704377 - DNA, 1039 bp, Homo sapiens
  misc_feature (172)..(172): n is a, c, g, or t
  misc_feature (440)..(440): n is a, c, g, or t
  misc_feature (780)..(780): n is a, c, g, or t
tatgcgagagagttattaatcggtgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagngagtggcgacgatgtagatttcgggcagacaacttgaacaagctgaagaacctatgcatgcaagacaatcggagagaaaatgaagaaaaaagagccagtgggagatgatgagtctgtcccagagaatgtgctgagtttcgatgaccttactgcagacgctgttagctaacctgaaagtctcacaattcaaaaaagtccgactccctcattgatgaagccatcctgaagtgtgacgcgggagcggataaagttggaagcagagcggttngagaacctccgagagattgggaaccttctgcacccttctgtacccatcagtaacgatgaggatgtggacaacaaagtagagaggatttggggtgattgtacagtcaggaagaagtactcctcatgtggaccctggttggttgatggtagatggctttgaaggcgaaaagggggccgtggtggctgggagtcgagggtacttcttgaaggggggcctggtgttcctggaacaggcgtctcatccagtattgccttcgcaccttggggaagtcggggctacatccaatcttaccccttctttcatgaagggacgaggtcctgccgggagtggccagctccgnccaggttgttgaagacttattagggatttgtcaacggggaaagttcgatgaattctttgcgagcaatattgttgcgcctcaaacgagccttcggtctgccggaaatgggtcggcaagatgtgcacagaacaggcccccggtggggagggaccaggggacccggtcggcacaagaagacggttccccaatgggagattaaccgaatttgggagcgaattgtcacaaaacggcgcttctgtatgtcagtacgactgagtcc

SEQ ID NO: 704378 - DNA, 436 bp, Homo sapiens
  misc_feature (3)..(3): n is a, c, g, or t
gcncctttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctacgcgagatatgggagcccggacagatgctgcacgggctcagtccatgcacatcatgaagcatggaagat

SEQ ID NO: 704379 - DNA, 565 bp, Homo sapiens
  misc_feature (172)..(172): n is a, c, g, or t
tatgcgagagagttattaatcggtgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagngagtggcgacgatgtagatttcgggcagacaacttgaacaagctgaagaacctatgcatgcaagacaatcggagagaaaatgaagaaaaaagagccagtgggagatgatgagtctgtcccagagaatgtgctgagtttcgatgaccttactgcagacgcttcatcaatgaggagtcggacttttttgatttgtgagcggcacgaggctgagtgctgcggcgcgatccgttgacttccctgagcgttggccgggaggaaagaagatggtgctggactctggatttgttacgggtggataaaggaggggacccagccctcatgcgagagatgcaggagaagcgcttcaaggacccgggaggtagtggacagctggtgaaggcagacagcgagtgg

SEQ ID NO: 704380 - DNA, 940 bp, Homo sapiens
acgactcgatctgtgctagagaaagtaactggtcagcgcgtttggcaggagtgtttctcgaaaggttgcttcccccaagggcttctggggccccacttatcttggcagagtacttcctgggcgaaaaattgttgtccgaccaccgtatttctgggttatgcgggtttccccccaaaaagttggggttggagcccttttaatgcccgctgttgacaggcgcgcgtgtgagtaacacgtcgggggcgccgccacgagcatagtgtgcgagctgtgtgctccgtccgccaagcaagatgatagtcggttgagcgcccccatacgggaagtgtcgcccccccctccgtggacaaaggttgtggccgcccaaacgaagacgtcctccctctacgtgaaagaatgcaaatcctgtgcgcgaaagccaggtttcagcgcctgtaaccttctatacatccccgtaccatgcaccctgtgaaacttactatgcgagcgagatgctaacagtggcgtgtgattcgcccccccccttgccattgaggtcgagaaacaccaacaatgcttacttatttcctagctgcataatgagtggtctaataattacgcatagactccgcatcggaggaagtcttacatttctgtctgatacattcttggagtggtggatcaatcatctttccctagagaccacctctgggccccgaaaccatgaggggcagcctgaatatgtgcgtggtacttgcggggataggcaaggaaaacctggggttaccccattttataccgtgtggaatattgctggacagcgttagttgtagtgcatgagcaagacatatagatttcaagtatgctacaaggggagaagaatcactgtagtggtttccaaaacattcaaatgttatgggagaaccccccccaaaattcagattcttcgccaacatgacaa

SEQ ID NO: 704381 - DNA, 163 bp, Homo sapiens
ttaggcatcacatatggtgaactcaccggaagctgtgggaccaccaggttgactagagatgggtatcacgcatatgttgcccaggactggagtgcagtggctcttcacaggcgcgatcccactactgatcagcacgggagtatcgacctgatccgatatccgg

SEQ ID NO: 704382 - DNA, 470 bp, Homo sapiens
  misc_feature (161)..(161): n is a, c, g, or t
  misc_feature (230)..(230): n is a, c, g, or t
  misc_feature (236)..(236): n is a, c, g, or t
  misc_feature (257)..(257): n is a, c, g, or t
  misc_feature (295)..(296): n is a, c, g, or t
  misc_feature (307)..(308): n is a, c, g, or t
  misc_feature (312)..(312): n is a, c, g, or t
  misc_feature (366)..(366): n is a, c, g, or t
  misc_feature (369)..(369): n is a, c, g, or t
gggtggataaaagaaagtactgatggcagactcctcccagaaggcctttgtgagcagacgaaattggcatgcaaaggcagtggtgtggcccaacgactctcccatgtggaagtttgggaagtgccctagctaaaatatagagtaccagtctggaaaagatntcattacgatagcttttgatgtatgtacttgtatgctatttttagaagcagtttgataaatcagtgatnatacangtgttgctcttaggagtactntgaataagttggactcacttgccaaatactttgttctnntggttgttatnntctntgcaacaaatagttgcttttgatttttaagatctgtgaataataaataaaatcnaangtccaggcaagctgacataccgttcattctaggaggcaagtgatatttgaggtcaaggccagctacattagtgacaccctgtcttaaaaagtacatttaaa

SEQ ID NO: 704383 - DNA, 215 bp, Homo sapiens
gtttgccgccagaacacaggtgtcgtgaaaactacccctaaaagccaaaattgggaagggaaaggtacttcatatccaccattgttcgttcattggaccacgtaggattccgggccaggtccaccactactggccatctgattctataaatcgcggtggcatcgcacacaggacccattgaaaatatttgagagggagtcttgctgagatgggaa

SEQ ID NO: 704384 - DNA, 390 bp, Homo sapiens
  misc_feature (199)..(199): n is a, c, g, or t
  misc_feature (201)..(201): n is a, c, g, or t
  misc_feature (207)..(207): n is a, c, g, or t
  misc_feature (227)..(228): n is a, c, g, or t
  misc_feature (237)..(237): n is a, c, g, or t
  misc_feature (257)..(257): n is a, c, g, or t
  misc_feature (267)..(267): n is a, c, g, or t
  misc_feature (279)..(279): n is a, c, g, or t
  misc_feature (288)..(288): n is a, c, g, or t
  misc_feature (290)..(290): n is a, c, g, or t
  misc_feature (302)..(302): n is a, c, g, or t
  misc_feature (320)..(321): n is a, c, g, or t
  misc_feature (325)..(325): n is a, c, g, or t
  misc_feature (327)..(328): n is a, c, g, or t
  misc_feature (332)..(332): n is a, c, g, or t
  misc_feature (334)..(334): n is a, c, g, or t
  misc_feature (339)..(340): n is a, c, g, or t
  misc_feature (342)..(344): n is a, c, g, or t
  misc_feature (346)..(347): n is a, c, g, or t
tcgtctttgacgtcacagaagcgatactccaaattgcctggtcggtcattgtcatatccacagaagtgcattctgcccccagaggatcccgttatccccaacactccccaatcttcataaatttctcttgtggggctttttgagttccaggagggcataatcataatccatgccgatgtcattggcattgcccttgatncnaccctngggcacatgggtgcgtttcnnccggatccnctgaaatttcatgtgctcgngcatggctgnagtggagtcgtnggcccctcnancaccatctttanccttgggctttaggaagnncacntnntaancntctgnngnnncnnttcactatagagtttttccactcgtcgtatgcatgtgggcagc

SEQ ID NO: 704385 - DNA, 187 bp, Homo sapiens
ggtcaagatgaagaaccatttacttttcttgggagtctggcggtttttattaaggctgttcatgtgaaacccaagaagatgaaaggattgttcttgttgacaacaaatgtaagtgtgccccgattacttccaaggatcatccgttcttcccaagatcctaatgaggacattgtttgagagaaacata

SEQ ID NO: 704386 - DNA, 932 bp, Homo sapiens
  misc_feature (616)..(616): n is a, c, g, or t
accatggttgctgtctacctgtcgactagatcaacgtcgaatggccggcttggtggtaaggtctgcgcgcacgctgtgtcggagtatggtgcggtaggccctggatgaggatgttcctggtccttccccaccatcaagatctacttcccgcacttcgacctgagccacggctctgaccaggttaagggccagggcaagaaggtggacgacgcagctgagccaaacgccgtgtgtgcacgtggacgacgatgctccaacatcgctgtccggaccctgagcgaccttgcacgtcgcacatagctatcggtgtgggaccacggtcatacatcaaggctccgtaaagccactgagcatgctggatgatcactgggtcggtccagcctcctccgctcggagttccaatccccatgtcggtggcatggcactcccgtggcacgaatgttccctggagttgctgttgaggcacacgatggctggactcgttacagagataccctgctttgaagctcggaagctctcgggtaggtccatgcaatcgtagtcaccttgagaggggctatccaagaaggctgcatcggggggacgcggggtggagggaatggggaacccccccggngactcgggctggcatcattacaatgcgagacgcgtacggccaaagttcggaaaacgaaaactcaacacaaaggaagacacccagtaactctcagaacataacgggtgtgtatcctacatcgttacgggcagggacattggaccaggggttgagcacgtatctgtcgcatttgtgccagtgcgcgctatcttcacggacacttgtgtggttcttttctacacgcggctggattccctgtataccctccgctagcacatacttctgcccgtttatcctagatatcccagcgatgtctaaatgcggtcgcgctcccgct

SEQ ID NO: 704387 - DNA, 186 bp, Homo sapiens
tgctcacctcccattccgtcacatccccttccacccttactccccactcaccgccgcctcggttccttctcttccttctctccttaatgccacttacactcttctcacccgacctcctaggcgacccagccaattataccctagccaaccccttaaacacccctccccgcgtcatccgggataccg

SEQ ID NO: 704388 - DNA, 610 bp, Homo sapiens
agcggctgatccacaattaaccagtgcattcttcccttggattccctaagcttgtgtgcctgatgagctgctctccagttatgccaccatgatttccattcctgagggaaggctgtgacgaagagccaggaaaataagagcacccctcctactctcatagtgcagtggttgaggatccttttttctatacaattttaaaactggaaatacacaaaatacgccaacataattaaaaataaaactaccatgaaatagcacaaatattctgcacatgaaatgttaagaactaaaatttaaaaatctgcttttagtaggactacataaaactgaagaaaaccagtcaatacagaattgggccaatgtacaattattcttgaagtaatccaaacacattaagttctctaatatatctaaaataatctatgacaaaggaaataatctgaaggaaagaaagaaaagataatgtgggaaattcttatgtgttatacttttactgtgtagataagctgaatggacaaaacgaacttattgtaaaatattgagaacagattagaagatatgaaataattaagaaacaagagaataggtaaaaggagccatggtgatgaaa

SEQ ID NO: 704389 - DNA, 379 bp, Homo sapiens
atttcccaaagtttcataaagcccctaagctcatgattttcatcaactttttgcccccaaagtcatttacccccccaaccgtttgttgtcataaaaagggggggggggtttggattttatttttttcaacctccagtgaaaaataggataggggccaaaaccttacttgtttttttaaaacaattcagggcttgagcatttctgtcaaaaaaggaatgaaaaactgttagcccattaaaattattttatggattggtattgtgttttgctgatttttaaatgaaaaaaaaaatattcatttttgatctctggaagccatcattattatgaggatcctttttctttggaaaccccttcataataaaaataaggtttaaga

SEQ ID NO: 704390 - DNA, 1009 bp, Homo sapiens
  misc_feature (880)..(880): n is a, c, g, or t
cccaacgtccagcgttactaccagcacaaccttagccaaaccatttacccaacataaagtataggcgatagaaattgaaacctggcgcaagtagatatagtaccgcaagggaaagatgaaagattataaccaagcataatatagcaatggactaacccctataccttctgcataatgaattaactagaaataactttgcaaggagagccaaagcgtaagaccgcccgaagacccagacagagctacctaagaacagctaaaaagagcacgacccggtctatgctagcaaaagtagtgggaagatttataggtagaggcgacaaacctaccgagcctggtgatagctggtggtccaacgatagaatcttagattcaactttaagattttgcccacagaaccctctagaagttccccttgtaaatttaactgtgtagtccaaagaggaacagctcttggacactaggaaaaaaccttgtagagagagtaaacaaatttaaccatgccatagtaggcggctaaagagcagccaccaatgaagaaagcgttcagagctcaacagccgacgtaatctaagaagaatcccaaatcaatataactgaactcctcacacccaatgggaccagtctatccagcctatagaagaactaatgtgagtataggttacatgaaaacattcttctccgcataagcctgcgtcagattaaacagtgaacgtggcaagtaacaagcccaatatctaccactcgagcaacaggtgaatatgacctcagtgtcagccagagaaacatgctcatagggaagttaaaaagtaaagagtgggaatttaccgctgttacaaaaaatccttagatacagttaagccgcgccaagagcaatgtnaggggacctacggcagggaacagggctaaaggcggataaggcaggaggcgaaaaaatacgcgagggagaaaaagacacggatgagcaaagaaatattggggccaacactatccccacacgacacaccag

SEQ ID NO: 704391 - DNA, 283 bp, Homo sapiens
gtatgggcgtcgtgtaaagaagcttagtatactagtacaaggcatgctgtctcatagaatgagttagtgtttccttctcggccgggcaccgggtggctcatgcctgtaatggcagcactttgagaggccaaagtagatggatcccttggagaccaggagttccagaccagcctggacaacgtagggaaaccccatctctactgaaataaacaaatatataaaaaataaaaattagccaggtgtggtggtggggacctgtagccctagtcactctgtgactcca

SEQ ID NO: 704392 - DNA, 321 bp, Homo sapiens
ggatccccagtacctacttgcactctcccaaagtactgagattacagggtgtagggccaccacacctggcccaggactccttgggatggcgtggccaggaaggtctctctgagtgacagacattggaaagatgacagagaggctgctgtgagagggtgtggggcacggacgctccaggcaaaggcaacagcagagacaaatgatttccacgcaagaccatgctcagtgtgggctggagacagtgttaggagacacggtgcatccacagaggtctcctgcaggtgcactgaagagacgtggcccagatgctgggttggtggt

SEQ ID NO: 704393 - DNA, 440 bp, Homo sapiens
ttatgccactgagtcctgtattttttctattttcacaaattggagatgagttttttttctcccatcaaagcttaagataccataggaatttaatatggaagtcctgtccccacagaactaccttaccaaatgtaaagctggggcagagtttgagaacattggtaacgtgatagattccgtaaaacgggtagaattttcccatggccttacactttggaaaattgtatagtggtcacatgcgaaaggcttctaagtaatggctcctaagatgttataatcctggacaaagtcccctaaagtcttaaaataagtcctttatttttcctaaaaccggactttatgaaaatttcgcctcagttaaatcacggtctgggcatcccatgagatggaagcataggtcaaagctgttgggagaaaatcagaagtccagtttcatctag

SEQ ID NO: 704394 - DNA, 395 bp, Homo sapiens
  misc_feature (21)..(21): n is a, c, g, or t
  misc_feature (26)..(26): n is a, c, g, or t
  misc_feature (28)..(28): n is a, c, g, or t
  misc_feature (66)..(66): n is a, c, g, or t
  misc_feature (71)..(71): n is a, c, g, or t
  misc_feature (85)..(86): n is a, c, g, or t
  misc_feature (237)..(238): n is a, c, g, or t
  misc_feature (251)..(251): n is a, c, g, or t
  misc_feature (386)..(386): n is a, c, g, or t
ctctgtgtttaaccttttganaactnanacatggttttccaatgtgactgcactctagcctggtanaaagnaagacctggtctcnnaaaaaaaaaaaaaaaaatccagggggctaggcgtgttggctcatgcttgtaatcccagcactttgggaggctgaggtgagaagatcacttgagcccaggagttcaagaccagaatgggcaacatagtgagatcttgtctctacagaaaatnnaaaaaaattcgcnaggtatggtggtgcgtgacatggtggtgcatgtgatcccagctactcaggaggctcagggggaggatcccttgagcccaggaggtcaaggctgcagtgagccatgatcacaccactgcactctagcctgagtganagagtgaga

SEQ ID NO: 704395 - DNA, 156 bp, Homo sapiens
tggcctgggacgtcctctgcacgagacctgcccctgtgtcggtgtcctgtggacggtgacgacgccccctggatgggactctgactcagcgacatcaagacaagaccagccgtgctcaccgcaactgacgtacagacttacgtggtaccgacgctc

SEQ ID NO: 704396 - DNA, 512 bp, Homo sapiens
  misc_feature (410)..(410): n is a, c, g, or t
  misc_feature (423)..(423): n is a, c, g, or t
tcggctcggtccactagtcacggttggctcacctccatggcttgttaggaactgccacacagcaggaggtgagccaaaggcaagggagcaaagcttcatctgtatttatagccgctccccattgctcacattacctcctgagctctgcctcctgtcggatcagtggtggcattagattctcataggagtgcacaccctattgtgaactgcgcatgagagggatctagattgcatgctccttataaagtctaatgcctgatgatctgaggtggagctgaggtggtgatgctagctctgaggagtggttgcaaacacagattaacattagcagagaggtttgactgcccagagaccataataaatcagttgcctgcagacgcatatcaaaaccctgtcagtgagtggcaggntgataattcagcntgcatctggtggctggctttatagtggcaagtgcgttgatgtacttcaactgtacagctgcatctggttgctggctttatagtggcagt

SEQ ID NO: 704397 - DNA, 139 bp, Homo sapiens
tattctggctagctgcagttgtctgtgagcacgagcaatgctgggagctggtgccctgtctggtgaccattgacggcccctccaaggtgaagatggattgccagtgagtgcccatgagggctacctgtgtcaccctata

SEQ ID NO: 704398 - DNA, 723 bp, Homo sapiens
  misc_feature (498)..(498): n is a, c, g, or t
agactagagtgtgcaggcatgagtcaaggtttactgtagacttgacctatctggctgaagcaaatactcgacctcagacttatgagtagctgatgctacaggcatgtaccaccatgcccacctaattacgaccattttgtggagagataggagtctgactgtgctgcccatgctgatgtcaaagctcctagacatcaagcagatgccttccaccgacagcgctgccaatgtcgctggggatcacaagcgtgacctatcacacctggtcggtttttgattcttgaaacgtgaaattacaaggctactcctctatgatgcttagatcgcatgtgatacttagataaccccacttcataactataaaaatactgtaccatgtgttcttatgatattgcatttgtaatatatgaatcatttatcaagttgaaatctcctctgatgtggagagcatgatacggatccagccttttcttttttgcaaatggctgactaagttgnctgcaacatgattgattaatcataaaatggcatgtttatcatatatttaatgcatatgtatccttgggctatacctagattatctttatgggggcatgatcattttggttctgaggcattacaaaattgtggtattaccatatcggtggtgccagttttatatctatagcccattgctatagtagctaaaggtctcattggcaaggtctatgggatataatggaa

SEQ ID NO: 704399 - DNA, 429 bp, Homo sapiens
gcagaaggctgttgctaattggagaagccccactaagcagcggcagcttcctgcttcggatcctctctctgctgcttgcatttaaagagcaaactcgtcttgtctaccactctccatctccccaaaatagcctcgtgatctcggaagtatggacgtagagatcacgagctcttcctataccttaccgcgtggactctgtgtggctcccaactcgccgtcagacacccacctgccccggtggtggaaagcgcctgagacagaccatgaacacacgccaagtgagtcgagcgcttcgacggaactccgtgcagcagcacggaaccaggagctggtggcggagataccctccgcaccaggaacttggaaaggaactagcccattgctacatgcttgtcattctggtcatctgctcactgactcgctcactcg

SEQ ID NO: 704400 - DNA, 176 bp, Homo sapiens
cgctagcggcattcatgacgcgagcagtagcccaaacaatctcatatgaagtaacactagcaatcatcctactatcagtactcctaataaacagatcatatactctatcaaccctaatcacaacacaagagcacatttgaataatctttacatccgttcacttaatgccgctaggg

SEQ ID NO: 704401 - DNA, 1045 bp, Homo sapiens
gcgtggtcttcacccttggcgtgttctccgccggctctcggatcctcaggcacatgcgaatgacccggagtgtgtgacaacgtccatttacctgtcgctttctcaccacgggaagtctagtagactcttgggctggctgagcttatcgtgggccttcgacagaggacgactggcgaatctctcatcgtcggtcaacgacaagatggagtagctgacgcattcaagagccatggtataatcttagggcactactcttgcagttagctggccttcgggagagcctgtgtggtgcgtccgtacagactgcacatccgctgcgtaggggtccgttctccctgcgcggttactgcgctgacttttcgcgctcgctgtggtacctcatgccgcgtggaggcctcgggctttctaggtcaggtttgcggcccgtcttctgcactgtggttcttcgctctactctagtccatgtaaccttctacaaccaactgggcttagacatatgcggttcactggtgcattcgaaatacgtcacattccaacctcggaatgtcgtcgtccttacacgcatattcgagcgattgcttacctcggtatctctaccatcgttgctcatccataggttggcctcttcattgggtttccgcacatcagcagatacgcctatattatcgatgcgtgtctcaacgtttaccaagcgaatcgtgcaaccgagcttttgatccggcgttcattggccttctgctggaagtaactcccctaggagcaaagacaggaacgtactggctcctagcgagtacctgagggctagctcagtctgaaccactgggtcaccttaagtgaccaagcctgtaacctaaagagaacctcccttggtttggcaggcagtgggcctgctggtccaagctgttcccaggttgcaggggggtcgtggggaacaagagatgaccttggggggattaacaggatgcaaaggaaaaaggctttacttagatgattgacttgggagctacggagaatgaacatccacttttgaatgttaagcaggatt

SEQ ID NO: 704402 - DNA, 543 bp, Homo sapiens
  misc_feature (532)..(532): n is a, c, g, or t
acatgtcgatgcttatatcttttcatatgctgaatttgatttgctagtattttgttgaggatttttgcatcaatattcatcggagataatggtctgaagttttcttttgtgtgtggtgtctttgtctggctttggaatcagggtaaagctggcctcatggaatgggcttggaaatgttccctcctcttcatttttttggaagagtttcaggaggattggcgataattcttctttaaatgtttggtagcattctccgatgaagccatctggtcctgggcttttctgtgttgggaggtttttgattactgattcaatctctctcattattggtctgatcagactttccatttcttcatgattcaatcttggtaggttgtgtgtttcctctagaaattggtccatttcttctaggttattaaatttgtaggcatacaattcttcataatattctcttataatcctttttatctctgtcgtattgggagtaatgttccctctttcatttctgattgtagttattgaatgtgctttntttttcttaat

SEQ ID NO: 704403 - DNA, 467 bp, Homo sapiens
ctaaatactaacgaatggcccagcataattacccccgatactccgttacagctatttcctcatcagccaattaaaaatattaaacacaaacttactcactcctaccgtcctcgtcacacgaataaccacactaacaatataagaagaattatagcaaagcctgagaaccaaaatgaacgaaaatctgtgcgcttcattcagttgaccccacaatccggtaggccgtacgccggccgctagtactgatctagttctatttgcccctctattgatcctcgcagactgccaaatatctcatcaagcagaccgactaatcagcaaccaacaagtgagctaatcagagctaacctcaaaacgaaatgataaccatagacaacactgatggatcacctagtgatttgtggtagagaatcattaaagttaaaggtggatagcaaatgcttgtacactatgagtcgagatgggta

SEQ ID NO: 704404 - DNA, 770 bp, Homo sapiens
ctgcgaaggaaatgggggggtgctgcaggtagtagaggaggacctggacctgtggggagacaggaaggctggaggctgggctccctgtccttggactcgtccttgctgactccagcctgtgttgcccctcccactccctagactggctccgagcaccgccccttcctggggagcccaggtgtgtttgccatttcttgcagccgtggaaggtgctacggggcagagggtcgggggcctcagggccacttccccaacctggccataacttctgtctgtctgaggcggcaagtcggccctgctctgggtcttgcaggaatcccaggaagctcccgccttgaagcaactcagagcttccaccatgaggacaagggcccagatctccccacctgggttgttctgagactgaggccctcctgagaatgcagcagcatctctgggcctggtctagctcacatgttgtatggcctggaggggcagaagtgtctgagtctgctcctggtgaacccatagcatcaacccagttcccagagggagaggtgtggggatctggctgtcttctctctaggggtgtctcacctcggcagacaagcccagggcaggtactgtgcgatgctggacgcacctcgcagacaggcggcgtgcagtctggccgagtatggactacctcgagaaggccgcggccgtctggccgcgtctggcgccccgcacggccgggcgggaagcaaatggacacaaaaaagcgggcgcactcgctgacaacgcggcaaacg

SEQ ID NO: 704405 - DNA, 1495 bp, Homo sapiens
  misc_feature (882)..(882): n is a, c, g, or t
  misc_feature (1495)..(1495): n is a, c, g, or t
ggagagaactagtctcgagtttatgatgttatattgtgtggtatttaacctattctattaacaaacaaggcctacaaactaattccttcttggacacacccacgtgtgacggccacgggaggccagggagtcttgggagtgctgggcctcggactaccgaagggctccaaaatgtagacgcaggccctctatgggcccgaatcttcttacagtcagctccaggtactatacacggagcttagtagtccacaaccatagggtctagagacctggctagtgatttagccaatcctattaaatccttactagtactggatctcaagaaacctcaagccttgtggcgaactctttgatttcagtggcgtgtggaaattcgtgacattagcgtgcgtgtagatctcagcagcgttctctcaccttaacaaatccgtcaggagagtagaattcttccgcggcccattatatggtatgaagagcacaaagaagactcaatgtatgaaactaccatcaaagcaacacaatcatgttgaagccttattatctcttttgccgtagactcccgaaagagcccccgttattacacgttggaccacgggttgacatgttgcgcacaaaggagggctgctaatcttctacccgctgatccgccggtccccacaacttccgataagtctgaatgtagcgacgatcgtctagtggaaggaattcacccctgcggcccaacaaacagcaacgtaactagtcccggtgggcgacaacacatcattatatcaatccgacggggggacaacttccaccctataagaacaagacacctatagtggaggactatgctaccagaacacaacaatcaatgccaggaggacggagggacaacaaganacagcaaaggacgcctccccgagagcacgctaaactgcgacgatgcaatagtcgaccccggatgccccttattgagacaccgaccaactcagtggcgccaagcacagcaccacgacgaccagtacgaaacaccgagggatattgaacaagaacacagagttcatacgataggtatcgaagcccgcgcatctgcataacgcaattacactccatgaatcgtcgttataacaacaccaatccacagaggcaagctaagcaaaccaataaaaatgaggagcggagccaacaacagagaagagccacactgaatggcatgagaaattgggttgaaatatccacacgcaaagactatgtacaactatggaaacgacccccggagaacaacaatcacatataccgccactaaacgatcaagagaaagcagaaacagagctaccaagcgagggcaaaaatgatccccggacccccactgaacaccagagaatcacgccgacagaacacagaatctagtacacgcagacccactccatcacaatgtgcagtagcaccaccctgtagctagagcaatcaaccagtaaagagcgagagcatagacaccaacaacaccagaagn

SEQ ID NO: 704406 - DNA, 808 bp, Homo sapiens
  misc_feature (105)..(105): n is a, c, g, or t
  misc_feature (256)..(256): n is a, c, g, or t
tgtgcctatcgtaggtccgcgccccttaaccaaaaaagataaaatggccgccgtcggtttgcaaccgctctctcggtagtatcgtcagagaagatgcttattccncggttctgagtcgcaagacgctagcaaattccatgtgttatgtagtccactatctaggagatcaagtaatctaataactgctaggctgacactatgagtcacagctctaatctactcgcccacagtagtagtaaacaagcactctacacanaatgtcagtcatgttgatcacatgtcatcccaccctatcatctgctaactacatcagctccgtaagatctcttctaatggtggacagggccccgatcatctccaggagtcatagaagtagtagttatgcaccagtttatacgatcatgtagttacatatgacatagctatatgcaccacccatagttcatacgcacgctgtcatcatgctacaacatgacagtatcacagatgtactattatcccgacaagaatgtcgactctgcacttggttggtcattcatctgaccagagagtctgatctctctcgccaccaggaatggagtagtcatggcagcgatctatggcaccactacacctctgctctcacaagaggctcccagtgattgtcctgacagcagcctagtagagtaggtggaacatcaggcgcttgtctccacgtccagccgtcatttgtttttattagtagacatgggctctgaccacaacgaacagacatggtctcgagctcagtgacttttagtgaccaacgtgcgtagacctcctgaagtac

SEQ ID NO: 704407 - DNA, 407 bp, Homo sapiens
cacgcgtcggtggggggtgtgtgtgtgtgtgtgtgtgtgagagagagagagagagacgtttacaggttaagacttcagtgttgttactttagaaatgggtaaattcagctgggtgaagtggctcacgcctataatcccagcactttgggaggctgaggcgagcagatccctgagcccaagagattagagaccagcgtcgggaacacatgggaaaacaacataccacacaacacacatcgacacaatatcgacctgagggtatagtggcgcgtgcctgtaagtcccagctatacagggaggctgaggtagggaaagatactatggacaccacaggtgccacagaaagacgggaccgtcgagcacaatgaagtgcacacggagacactcacaacacgaggtgcacaaaa

SEQ ID NO: 704408 - DNA, 481 bp, Homo sapiens
gtatcttgggttctcttccttgaccttgacatgtccatttaatgaaacctgctcaaatttgaggctcatttaatttgtttctcacaaaccttctgtatctacttttacatatgttcttacgcctgtgaattctcatggccgcttgtcctagggcgcctcagcataaccctcctttattagtaatatattatatatgttacattaatgccttaaggccttgaactattcacttatcctgaaatactttcttcagatctttctgattggctttttcttgttatccaggtcttagtttatattctaccgctgcaaaaagctctctgatcatctaacgtaaagtaacttcccagttactgtctattttattgtcatgttttactttcttcatagcactatttaaagttattttatgtatgtctctcattaaaatgtaagtttcctggagacaaaagatgctcaataaatatgtaatgatgataaa

SEQ ID NO: 704409 - DNA, 81 bp, Homo sapiens
ggatttgctggtgctgtacaactaggcttaatagggagcttgaattcgagcttctaacgttagaagcttgaattcgagcag

SEQ ID NO: 704410 - DNA, 417 bp, Homo sapiens
tgctctgggatagaggaactgctccttttcatcagctcttccaatgccgtgggagaggtgatcccagtcttctctgtacatcttgtgcttttccattaagacttgttccagtgggaaggagctttggaaaaattgcacaggtctgaatcttcagggcatcttcatgacaggacttgccaataatcataataataataataataataataataataataataataaagctccagaggcctaactggcttctcaagtcatttcagtgatatcattgaaacgtttttgtggtacttccctttgtctttcactgctccacttctatatcgcttcattctacttcttctgcttctggctttgctcttcgacaaaacaattatgacgcctcttctgcatcgttgactgcgactactacgttac

SEQ ID NO: 704411 - DNA, 1323 bp, Homo sapiens
  misc_feature (1323)..(1323): n is a, c, g, or t
taaaggaagcacttttatttttccttacacaaggacgtcgtggctggggcctaaggttctcacataacagtagaaaaccaaaattgggtggtcattctcttcaaagaactcgagaatggcgttacaaaaaaaaccttacattaaatttaagaagtgaatacattttacagggggtaaagtgcaaaccggcttccaaactcaaagcaaggtaacaggcccacgggggtctctgggccaaagagacattcaggcataaagaaagggaacacggggctccatacgggcttgggcacttctccagacccggacaagacccggcaagagacaaacacaaccgggtctctgggcacagcctcttagagagaaaactcccagaaacacttcgagccccgtgacagcgtttaattaccagaggggaacacgaggtataactttcaattacagagggtcaaaattcgagcaacagagtttttacaactccaggtggcgtgatatcagaatccaagccttcagagggacaatttctttccgaagaggctaatcccagttccggagagaggctagctatgagggggtgtgcattggccgaggggccaaattcctatcctcaattaaacccaggcagcaaatggctaacgcatctggctggagcccgtctaaagaagctattggcgggggacgatgcgaggggcccgatccgtagaactccgggtggcaaatccaaatctggtgggaagggtggacagtgaaggccgtgtttgagccaacgatcaacacccgaggtactggagccctggagggaggacagaacatggagactacaagggggcggagcgccaggggggagaaccctatgagaatcctgaaggacaagccgggtaacatgggtgtagcggccggaaaaaaccgctgtgggaggcacacaggtcctaggggagaaggtcccggtcaaacctccagagaggaacacaaagggagcaccaggatagaagcccaagttaaacccaacaacagggaagagaagtggagtacaagaagactctcggagaacaggataaagctcttattggccaagtgggtacaacaagcccactgatggcagaggaattactcacccagacagaaagacgagaggcagggaggactcatcgtcagacacaagcagaagacacaatatatacataacagacacacgacgagaggagaagaaaaccaaaacaagataagataggcagcacagcacaccagacaagcgtgagagcagaaggaacataatgatgcgtggtcgtggttgtcgctcgctgcgctgctacgcgagagacn

SEQ ID NO: 704412 - DNA, 681 bp, Homo sapiens
cctgcctcagcctcctcagtagctgggactacaagtgcctgccaccacgcctgggttattttttatatttttagtagagacggggtttcactgtgttagccaggatggtctcgatctccaggatggtctcgatctccaggatggtctcgatctcctgacgtcgtgatccacccgcctcggcctcccaaaatgctgggattacaggtgtgagccactgtgcccggccaaaagaacagaaattattttatcctgaagtaagctgtttatatttgggattatactgaacctatttgtccaataacctgagttttcaaataattttagttctataagtactataattatataaatattaatgaattcagattagctgaaaggaaaaaaagtagaagcctgactacttggtgctaactactaaagattttggcagaatcaatgttggatttggctttcctgtcccttccccatgccagccccccagagtgttctgccttgtgctgcctcccttcacctggagtgccacacccctctctctgccagttcagctcttcattcttcaaggcctgaccttgtctgacccttgtgcctctaaacccagctatctcaggaggccaaggctggagaatcgcttgaacctgggaggcagagtttacagtgagctgagatagcaccacccagaac

SEQ ID NO: 704413 - DNA, 310 bp, Homo sapiens
gttcgagaccagcttgggcagcaaagcaataccccttctctattaaatattaaaaaaaagattagccaggtgcagtgtggcccgtgcctggagtctcagctacttgggaggctgaggtgggagaatcccttgagcccaggagtttgagctgcagtgagctgtggtcacaccactgtactccaccctgtgtgacacagcgaaaccctgtctcaaaaagaacacacacacacacacacacacaacaccaaaaccccaaaatgttgttgtgttgtttcttttgaattttctgcgtccactatcattacctaca

SEQ ID NO: 704414 - DNA, 979 bp, Homo sapiens
ccacgtcgtcgcattcgcgtctaggactccagtactcttgactcaggtggactacgctggtagagaggctaggtggcacggctgcaggcccgttttgtcactacgggagctggcggtgaccgtgaagccatccaagatggacgtctaagagatggtaacatagatttctggcgccagcatgcctctggacttgtctgtgcccgacgcctggggacaggatgctcattcagtctcccactgattctcttcgggtcctgcgtctgaacagttgcactgaccgcagctatgtccgggtgtgatggtgcagcgtgctgtgcttttcgtgacgtaccgttcacagaggcttggtcacggaggcgcctgctgagggacccccttgcctgtccccctcgaggtcccctccgtgcggagccgcactcgccagtgctcccgagggtgccagggggggtcgcgttgccgaggcggaacgctccatgggtaaccgtctcctatcgatcgcaaccaggtccttcgcccggggtggtggtcgcccgtgttcctgggtgtccgtcgggggggcctgggtgggtgtcctcgatggtcggccatggaagggcgagggcctcgcgctggcggagttcgcttcttgtctctgatcctggtcgcggtcccgagggcccgcctggcgggcctcgtcgtgagcccggcttcgacgctgataactccgtgggcattaggcgagcgcctattacgccctctaggcacctgtgcaagattagcttgcaggttggtgaccctttcctggtgttacatggttctgtggaggatgaaagagaggtacacgcttttataggaaaggcgggcccaaatgagaggccaaaaaaaggcggcggcgggcgaagattccctaggggggcgggaaaagtgcaacgtgttttggaagccccaatgggggtaaaaggccggcgtaaagggtggaactaattgtgtgggccctggg

SEQ ID NO: 704415 - DNA, 2025 bp, Homo sapiens
  misc_feature (1504)..(1504): n is a, c, g, or t
  misc_feature (1521)..(1521): n is a, c, g, or t
  misc_feature (1524)..(1524): n is a, c, g, or t
  misc_feature (1527)..(1527): n is a, c, g, or t
cctgcctcagcctcctcagtagctgggactacaagtgcctgccaccacgcctgggttattttttatatttttagtagagacggggtttcactgtgttagccaggatggtctcgatctccaggatggtctcgatctccaggatggtctcgatctcctgacgtcgtgatccacccgcctcggcctcccaaaatgctgggattacaggtgtgagccactgtgcccggccaaaagaacagaaattattttatcctgaagtaagctgtttatatttgggattatactgaacctatttgtccaataacctgagttttcaaataattttagttctataagtactataattatataaatattaatgaattcagattagctgaaaggaaaaaaagtagaagcctgactacttggtgctaactactaaagattttggcagaatcaatgttggatttggctttcctgtcccttccccatgccagccccccagagtgttctgccttgtgctgcctcccttcacctggagtgccacacccctctctctgccagttcagctcttcattcttcaaggcctgaccttgtctgacccttgtgcctctaaacccgtggccccacctctcttggttcctatgtcaggtgatgtttgtgtttttggttatgcccatctccatagccagaccaagcactctggaagccagggttgggtgcttatttatctgtttgccatgcagaaaatatcttgcacaaaattacctctgttaaggaatctgaagctgaatttagtttggctgagtcagggttgggttttttttaaggggctgtggggtgaaatgttgactggaagccacccacaaacacacacctgctggttaggaacccggctgtgggtggttctgagctgtttggcttcagttgacagtttctgattgccctgagcaccaggtctcatcttgcatctcatcctggcctggagaacattcagtttccttccaacccttcccacctttcccccactcccttggaggaactgaagttggggttgaggagagccagatggctggagtgggtatttgaaggtctttctgtcacctgttcagtgtggtctgccccacccctgctgaccaagactgactgaaatgtaaaataatacagaccatctcacactcagaaagctggcacatttttgaaagcccaagtgtgggtaagtgcgtggaacaacgataattcacactgctttatgagtagaaattgtgagaaatattgtgccaggcaatttgcaaaatcttggaaggttgtgtgcacttaaccacccagcaactactcctggatgcatcctagagaagtgccatgtgaacagagaatgattttaagacttcactgaagtattgtttaggtagcaagattgggaaaagcctgcatttcatcagcagaagaatggataaataaatgggttgtttttggtccttggaaagtgaatatgaaagagttacgtctcaacacagatagatgaaanattatgctgagaaagtnggngangctacatacaggtacccttagtgtaaagttaagcatactgtgtacctgtgggcacgttacttcaacttgtttttcactttttctgtaaaatgggatagtagtggcaatctcacagggtgattgtgggtgggggggtggtcaatgaagtaatgcatgtaaaatgcttagaatagtgtctagcatgtaagccttgtggacatatagaaagtgttattgttttgcacagtaatctattttctgtggattcaaataatatgaaatgagtataaaatcatgtattggaacgatgtgtgcaagtcaccattctgccttcctaaggcaggagacctgatggatttggggagggtacatggggccttcagttgtgttttctttgtttttttctaaaaattgatgcagaggcatcacaatgttaagattttaacagggtagtgtggtgggtactttttaactgtttgcttaaagtgtttcaaagtaaaaatatttcttaagcataga

SEQ ID NO: 704416 - DNA, 914 bp, Homo sapiens
atgggtctatcacaaatgtgtcgagggagtcttgcggcaccctggtgggcgcccatgtgggcccgccgggaacccgcggcgtgcccgtccccgggtgttcgcggtcccgcccgtcgccgacttgcgcccggctatcccgccgttatgggggttgcccccggcgtttcacatttgccagtacagactgtgtcgtgtatgtcttcaggagaagtcgctgttccccctcttctggttcaaaacgcgtgtggatgcgggcgcccaattgtttaagagcttgttgcgggcagccgtcgccacgtggtcgggtaacaggtctccggacgaagacccccggtctgtgtgtgagaccttctccacgcaggcgcacccacctccatggaggcagccactgtccggtcgctgagatataacaccaccaacaccatgccgcgcggggaggttccttccaacaggcacccgtgggccaccaacgggtggatcggcgcacaggccaagtggcccctacttcggcccccgtcagcgttcgtgtaaaagaggcttcatagcctgattattcatccccgctaactgatgctcgccccccccccccttattacatagacactgcggggcaaacacggctatgtacaccacacatctgtttgatttcaacagccccctttcatcatattactattcaataaatctggttctctgatgcccaacagcactcttttagacccggtctcgaacaggtaaatagataatcttttccggaaccccaccttgtgctattttctatcgactgttgaccactgtattcatagtcactaatctgctttatagaccctatacggtttatagtggagaaccacatcggccccaccaagttgtcaccaaccaaatttttagaagcccccctcaaaaaacataca

SEQ ID NO: 704417 - DNA, 950 bp, Homo sapiens
  misc_feature (429)..(429): n is a, c, g, or t
  misc_feature (446)..(446): n is a, c, g, or t
  misc_feature (449)..(449): n is a, c, g, or t
  misc_feature (452)..(452): n is a, c, g, or t
gggggagctgtctgtccatccaggccttggcccccagcccatgtgtttttgcagcaataagggatatggggtaatggcccaaaaaataaaatggtttgtgtgtctatggggaggaaagggttgcaaagctgtggggaccgctgaaggggaagggacagacgaggtcagtactgggaacaccgaaggtgggagcccatttcataacatttcttgttgatcaaaccacccagcaactactcctggatgcatcctagagaagtgccatgtgaacagagaatgattttaagacttcactgaagtattgtttaggtagcaagattgggaaaagcctgcatttcatcagcagaagaatggataaataaatgggttgtttttggtccttggaaagtgaatatgaaagagttacgtctcaacacagatagatgaaanattatgctgagaaagtnggngangctacatacaggtacccttagtgtaaagttaagcatactgtgtacctgtgggcacgttacttcaacttgtttttcactttttctgtaaaatgggatagtagtggcaatctcacagggtgattgtgggtgggggggtggtcaatgaagtaatgcatgtaaaatgcttagaatagtgtctagcatgtaagccttgtggacatatagaaagtgttattgttttgcacagtaatctattttctgtggattcaaataatatgaaatgagtataaaatcatgtattggaacgatgtgtgcaagtcaccattctgccttcctaaggcaggagacctgatggatttggggagggtacatggggccttcagttgtgttttctttgtttttttctaaaaattgatgcagaggcatcacaatgttaagattttaacagggtagtgtggtgggtactttttaactgtttgcttaaagtgtttcaaagtaaaaatatttcttaagcataga

SEQ ID NO: 704418 - DNA, 1132 bp, Homo sapiens
cctgcctcagcctcctcagtagctgggactacaagtgcctgccaccacgcctgggttattttttatatttttagtagagacggggtttcactgtgttagccaggatggtctcgatctccaggatggtctcgatctccaggatggtctcgatctcctgacgtcgtgatccacccgcctcggcctcccaaaatgctgggattacaggtgtgagccactgtgcccggccaaaagaacagaaattattttatcctgaagtaagctgtttatatttgggattatactgaacctatttgtccaataacctgagttttcaaataattttagttctataagtactataattatataaatattaatgaattcagattagctgaaaggaaaaaaagtagaagcctgactacttggtgctaactactaaagattttggcagaatcaatgttggatttggctttcctgtcccttccccatgccagccccccagagtgttctgccttgtgctgcctcccttcacctggagtgccacacccctctctctgccagttcagctcttcattcttcaaggcctgaccttgtctgacccttgtgcctctaaacccgtggccccacctctcttggttcctatgtcaggtgatgtttgtgtttttggttatgcccatctccatagccagaccaagcactctggaagccagggttgggtgcttatttatctgtttgccatgcagaaaatatcttgcacaaaattacctctgttaaggaatctgaagctgaatttagtttggctgagtcagggttgggttttttttaaggggctgtggggtgaaatgttgactggaagccacccacaaacacacacctgctggttaggaacccggctgtgggtggttctgagctgtttggcttcagttgacagtttctgattgccctgagcaccaggtctcatcttgcatctccatagccagaccaagcactctggaagccagggttgggtgcttatttatctgttttctttgtttttttctaaaaattgatgcagaggcatcacaatgttaagattttaacagggtagtgtggtgggtactttttaactgtttgcttaaagtgtttcaaagtaaaaatatttcttaagcataga

SEQ ID NO: 704419 - DNA, 328 bp, Homo sapiens
  misc_feature (242)..(242): n is a, c, g, or t
actggggctgaagcagttagtcgtgtaggcggtgatcagatgaacgttagcagcatgtggggtacataatatggatgcgaagatatcagttcgctacttcaattcctctacttcccttttttccaaaagaataatcagaaggattcaagaacaaataatacccattttgaatctcagagaaaaccttaggtcttatcactacacacgcctttgtaagacaacatctttaacttcctctcagntttctccgtttttttttgtggtttccagtattcccctggccgtgcgttcccaggtggaattttaagccatatcgggggtctcatag

SEQ ID NO: 704420 - DNA, 123 bp, Homo sapiens
gcgtcataaaccaaacaaagggactccttaatattaatggccaggttattataaggaaaaattatcatttcccctggagggggaatggttacattaactttcacagccaggaaaaccaaacct

SEQ ID NO: 704421 - DNA, 259 bp, Homo sapiens
caccagcatggcacatgtatacatatgtaactaactgctcattgtgcacatgtaccctaaaacttaaagtataataaaaaaaaaaaaaaaggaatgggaaatttggggggggggccccagggaaggacaggaaaggggtttggggtttttttaaggggaaacaaaaaggctcaaacattgatgggggggagggttgcacaatcctgggagtttcctaaaatccaatgaattatttactttaaaggggggggctttcaca

SEQ ID NO: 704422 - DNA, 253 bp, Homo sapiens
cccgtgccatgcaataacctcccctttaacccttaccaatctcctatgcatactacagagcccactcccaagtggctctttcacccagagaaagccttccctgggaatggagggtggtgcaggcagaggagcactcaccagatagttgagggcataggccagctgtttgaccacctgcagcttccagctggctggcaccaggtggccacgttttcgcagatacatgtctatggcccccaggtgtacaaattct

SEQ ID NO: 704423 - DNA, 644 bp, Homo sapiens
caggttctccggtgctccccggggccgcggggctgcccagggtgttcgaagtctgttcccctgttgcgcaggctgcccgtggtatgccaagtcgtgtccccgagatgtcctcggctgtggcccacggcgcaacggcccgacggtgttccccgggaatagttggcgctcggtcccccgttttgctatcgatgtgttcccgctgcgcgatggcgtgttgttctcccgcagagggaattacccaccggggtgtgtcctccgccacgacgcacttggggtttgtctcccccgggagacaattgccccgtgtgtgtggctcacacgaccgtgtacagtgcttgtccacgacaacagtgacatctctttggcccacccagtcaccgggtgtggtccaccatcagagcgtccacaatgtctccgacgaaggatccccgtggtgttccccacccgataaatacggggttttcccgctgaggagcccaccggctgtcccccgagcatctcccgatgcttcccacgagaatcatcacgtgtctctcccgagacaccatccccgattctcccagatgacccctattctttccccgcccatcaccattttccgggcaatttgggggttccataaaataacttcgcccacatacaaa

SEQ ID NO: 704424 - DNA, 124 bp, Homo sapiens
atacttgaaaatgaaccctttaaaatgtggatcaatctgtatttctaaaattaaggaaaacgtacttgtttctgaatcacagttggcattgaatttatgcctaaaatcactggtctgtatagca

SEQ ID NO: 704425 - DNA, 276 bp, Homo sapiens
ggctgtggcctgcagcttatggtaccctgctgggagtcagctcccatgtgggtcagacctacgagatgttctcctggttcctgctggcccctgccaggccctggctgccagtgagagccctggcttgtgctcactcgtggaagtgaatgagctcttccacgcaaccctatgcccctataccactggtgacctatgacttgtcacatgtgacctatcagatgcacatgaccaatgtacaccccacactccacccggtgtgtgtgtacctgatgtctt

SEQ ID NO: 704426 - DNA, 219 bp, Homo sapiens
gctatcatatagtaaaacccagcccatgaccctaacagggcctctcagccctcctaatgacctccggcttagccatgtgatttaatttcattccataaggttcttaatattaggcttattaaccaacacattaccatatacaattgatgcgggattgtacaagaggaagcacatacaaggccacaacaacaactgttcaaaaggcttgttagggatatc

SEQ ID NO: 704427 - DNA, 809 bp, Homo sapiens
  misc_feature (68)..(68): n is a, c, g, or t
  misc_feature (120)..(120): n is a, c, g, or t
  misc_feature (213)..(213): n is a, c, g, or t
  misc_feature (363)..(363): n is a, c, g, or t
  misc_feature (507)..(507): n is a, c, g, or t
  misc_feature (525)..(525): n is a, c, g, or t
cccacgcgtccgggatgagagctgcaccgcgcgggacaagtcgccggcggcgcccgacggagcagaanagagagcatggagctggagaggatcgtcagtgcagccctccttgcctttgtncagacacacctcccggaggccgacctcagtggcttggatgaggtcatcttctcctatgtgcttggggtcctggaggacctgggcccctcgggnccatcagaggagaacttcgatatggaggctttcactgagatgatggaggcctatgtgcctggcttcgcccacatccccaggggcacaataggggacatgatgcagaagctctcagggcagctgagcgatgccaggaacaaagagaacctngaacggaggagactctcggtgtgctcccggtgctcgtgtgcatatctccacgcagagcctgctgcaggcgggccgatgattgctcagaagagaagaggtaggttcgcggttgttgttgttgcagacacccaagatgaggcaacnggcgctgaggaggagctnctgccagggtggatgtactcctggaggtgttccctaactgtgtcgcggggagcaggccccagtgggtgctggccaaagctcggggggacttggaagaagctgtgcagatgctggtagagggaaaggaagaggggcctgcagcctggggagggcccaaaccaggaactgccagaacgcctcagaggccccccaaaggatgagctgaagtccttcatccggcagaagtacatgagggtgatagcgcaaaggatcaaaaatcaccggcccaggtcccaagaagccca

SEQ ID NO: 704428 - DNA, 812 bp, Homo sapiens
  misc_feature (68)..(68): n is a, c, g, or t
  misc_feature (120)..(120): n is a, c, g, or t
  misc_feature (213)..(213): n is a, c, g, or t
  misc_feature (363)..(363): n is a, c, g, or t
  misc_feature (510)..(510): n is a, c, g, or t
  misc_feature (528)..(528): n is a, c, g, or t
cccacgcgtccgggatgagagctgcaccgcgcgggacaagtcgccggcggcgcccgacggagcagaanagagagcatggagctggagaggatcgtcagtgcagccctccttgcctttgtncagacacacctcccggaggccgacctcagtggcttggatgaggtcatcttctcctatgtgcttggggtcctggaggacctgggcccctcgggnccatcagaggagaacttcgatatggaggctttcactgagatgatggaggcctatgtgcctggcttcgcccacatccccaggggcacaataggggacatgatgcagaagctctcagggcagctgagcgatgccaggaacaaagagaacctngaaaacgcaagagactcatggatgtaccaacggtcagggtgcccatcatccccagaagccccatgacaagcggaaccgaaatggctcacagaagagactaggtctatcggctgcatgcatgctgaagacacccaagatgaggcaacnggcgctgaggaggagctnctgccagggtggatgtactcctggaggtgttccctaactgtgtcgcggggagcaggccccagtgggtgctggccaaagctcggggggacttggaagaagctgtgcagatgctggtagagggaaaggaagaggggcctgcagcctggggagggcccaaaccaggaactgccagaacgcctcagaggccccccaaaggatgagctgaagtccttcatccggcagaagtacatgagggtgatagcgcaaaggatcaaaaatcaccggcccaggtcccaagaagccca

SEQ ID NO: 704429 - DNA, 530 bp, Homo sapiens
gagacgggtccaggatgtcaagcacagcctgggtgaccacgttggccgggaagctacagacggaggatttacacatcagacaaagggctgagtatagatcacacctttaagatggtcctccaaacaaaagattctacaactttagttatttagaattagcttggagacttggggcaggtcacaatttttctctatctcctatcctgtaacttcagaaccagacacactactaacatcataacatccaaactgggttttggtttttttaaacagataaaaaatgtgacggggcacaggggctcatgcctgtaatatcagcatttggggaggccaaggggggaagatcgctggaggccaggagttggagaggggccggggcaacataatatgatctcatctctacaaaaaaaaaaaagggaaaaaagggcaccatcggggggggggggcatggagcagggtagccaaagttatccgggaaaccgaggcaggaggactgcttgagcccaggagtcaagaccagcgtggggaac

SEQ ID NO: 704430 - DNA, 855 bp, Homo sapiens
acactattgcactaaaagtatggaatagtcgctctatcgactatctgaattgcaagtaggatatccaaagagaaactcccatggtgagatccggccatgtattatctcttgacatggtatccaagtagcaccccatctcaatcatataccaaaatcctctccctcactaaacgtaagccctatctcctcaactctctcaatcttagtccatcgagtagcaggcaagttgaggtggatgaagaccaaaacacgcagcatacgacaaaaaatcttaggcataacatccatcaaattagcaccacataagcgatgaaataaatagcacgcttgactaaccgataccaaacacttaaccatacaacatatcttacagtgttaaccttaatgatactactatatccgtatactaacttaaccgcaattcccttacgtacgtcagacatataagacctcacagaaaaccacaaagaccttgaggtaacgtattcattcgacaaccctggagaagcagaagcataaaccaatgacgtaaacaaaccctttaaatttccaatccgacaccatacgctcttccgagtaagggaggacctgacaaccacggataaaccggaaatttatatggccaccaagagtggtgacacagtataatcgcaaagaacatttctcaacaaaaaaaaaaacaattaggccccttcatcgattcccaccaacccaatcaattaggccaccaattcagcccccttaccatttacaccgttcttaaatacctaaccttaaggcacttaaattcttaatcacagcatccaatcaacactattcccccaatatattaccaacgttaacaaatttaaatga

SEQ ID NO: 704431 - DNA, 968 bp, Homo sapiens
gagctggtggcgtccgcggcatgggtggtaaaggtataggttgatagctgtgagaagggacagctgctgccaatcctgagggtgtaggagtggagatgaactgtaaggtcgtgatgcactctacctagcaagttgatttcatgtattcaacaggggcctttggagttcatgacaagagatggaccgtggcagagctgagaaacgggagcaacatccgtgaatggttctaaccgctgtcgccaaggtctctcactcgaacgctgagcctcccactcgagtgtgcctgcgctttcagaacgggacattagacctggcagcttcatcgaacaagtagcagtgtccatgtacatagtacctgccttcctctttgaattcttccgcgggaaagggtgactgaactgtgagtccagggagggagctgaggagcccttatccgctcccacacagtcccctcccaagatccagacgacgccgttgagggctgagatccttgctgtgggatgtgccagtgttcccaccaagagcaggaatttagacctttttcctggacccactctcttccatcctgggggctctgttacactaactttgaataaactctccctttctttgcaactttcgcacgaacaataatgatttttattgccagggcgtctctgctgcctaattcatttcccaggaagctgtgatacaggctgaaataaagtcgtgtcttagaaaccaggacctaaacccccacagtatgttgtagaaacacatgtggtccctgttcagtaaactatttttttcaacacagaaaaaccgggcttattggtggggggacaagtataaaggggagggttaatgtttccgccccattctgtcacatgcaatctcgggccaaagggacgaaatagagcagcacgatgacgtaaaggaaggagagagttcgaaccgaggaaaggaagcatcaaggaagataagaggaa

SEQ ID NO: 704432 - DNA, 216 bp, Homo sapiens
ttgtagcagcgcacactcatatatacacagctctctctctgcgcgcgcgagtagagctgtgatatcttatgtctgcggctgctctatgagagatatgagagtatcgctctctctctcgcgcgcggcgcccgcgcgcccctatcatacagataaagatgatatatcatatatcacatctcccgccacacacacagaagatacacagagaggacacaa

SEQ ID NO: 704433 - DNA, 150 bp, Homo sapiens
atacagcctacagtgcaaaatatttaatggtataatttagatcaagttaaaaactacatacaaggttgtgatcaacagcatcctaacgataaatataacaaacggatatactttgcggtgtacaggttagcgcatataaaaatattacgg

SEQ ID NO: 704434 - DNA, 202 bp, Homo sapiens
acccctgactcttgggacgctctagtttgttgaaagtaaacgctacgacccccgcgttacactcagctaacagcatggaggagacaccgagagccagggggcgcctacgggcggtggctcgcctcgcggcggaccgcccgcccgctcccaagatccaactacgagctttttaactgcagcaactagcgtccaaagcacaggt

SEQ ID NO: 704435 - DNA, 274 bp, Homo sapiens
  misc_feature (55)..(55): n is a, c, g, or t
  misc_feature (82)..(82): n is a, c, g, or t
aaattggtcttcattgtttcttctgtggagaatctgtgctaggtactgtatattngatttatattggtttgtttaattgctnaggggtatttggaaaggcccactgaatacatattgaatggggggccggcttttgtggttttgataaagacattgtaggcaaggaattgtgccgggaaatctgatttcgggacaaaagaatacttaccaaggcctaaagctaaagatacttattggaaaacatcctcaattgcaataaaaacattataacatg

SEQ ID NO: 704436 - DNA, 227 bp, Homo sapiens
  misc_feature (5)..(5): n is a, c, g, or t
  misc_feature (60)..(60): n is a, c, g, or t
  misc_feature (63)..(63): n is a, c, g, or t
tgggnaaacatgggatttccccatgttgcccaggctggtctctaactcctgggctcaagnganctgtttacctcgacctcccaaagtgctgggattttttttttgagccaccatacaccacagattgttggtaatcttggcacacagtttggtgacatagtgcaaacaaaagtccagttgagatagattcctgagaaactaaagacaagtaggggacagtgaattga

SEQ ID NO: 704437 - DNA, 414 bp, Homo sapiens
acgggcgtgatggcacgtgccatgtatcacagctactcaggaggctgaggcaggagaaccacttgaacttgggaggtggaggttgcagtgagccgagatcacaccactgcactccagcctgggcaatagagtcggactcttgtctaaaaaaaaaaagaaaagaaaagaaatgacctgctaataaagtaatagaatggaaaaaacaaaacaaaacgaaacaaaaaaaaaacaaaaaaggaagcataaagtatctagacacggggtcatctggattcctgggtactggttgaccataattagatgtcccatgatcagttacaatcaaaatctcttttggggtgatggagtttggctttagaatgctaatatcatggcatttccatattctaggttatctgtataagcagtaagatg

SEQ ID NO: 704438 - DNA, 360 bp, Homo sapiens
cgtttagagcaggctcgtgtacttgcattgcgctctctctaagcagctgataaacagctctcataaaacgcttagagtgtgattgatatggtcctcagaagcctgttctctcatgcatatcatgggaataataatagctatcccatggataggctgtgaaatacaaatgtgtataaggaaagtaaagagcagaatagagagtttgttacccaagagactcacaatacatgggaaccattgctgctactgaggctgcagaagccaccactggaaatggaaaccaccaccactcactgtagatcagcatgtccactggtctccaggctctgagtctgtattaacgggctggggtaccgagct

SEQ ID NO: 704439 - DNA, 1038 bp, Homo sapiens
gaaaacctgttcaatctggtggtgcgctctgtgtactgtcacacttaacccacaggggctggactttgttcaatacaaactggcagagcaaatatgtgaaacaaggccgaggacgcagtggcctctcaccatgaatgcagcattccccattgcagcatgtggcatccgggcatctgggagctccaccccagagtggcgggacctcattctatgctcatctacactaacaagtgtccttactctgcttcctttctatcccacatttcacggacgggacactggctttggaagactatcagcaggatgctatggttacccaagtacacggcattcccaaacgtgtgagcagccacacgacaacttcactaacaacgcatgtcagcggcatgatccgtctctacgctgctatcatccagctccggtggacactatggaaaccgaccaggagattcaccctacatggcttcacatcatggcatggcgctgcgcttggcacagatacttaaacatggcagcaccgtttcacgaatgctgaccagccacccctacctactcatgcacataaccttggaggtcgtgatgcggacatgccccacactgaaccaactaccaacgccatcagcatctaggaaccactgcctcacattcctcactccaaacgaggactactccaccccacaatcgcccccctctcacaccgcctccagggaccgacttcgactccttcatacgccctcaacgccagtcttgcgacaccatgtctgaacacccttgaacactccctatgccccaacagggcaaacatcactactctacctaatgccagcctcctgtgaatctgcacatcccatccaccccaccaatcacaagaaatggactgcaaagcacgagccagtacctaccagggacacttgcaccaacacacgctcgacattacccagcaacacctaccatcctccgcactacccgaaacgatggctcgttatgttcctctccacgcgtacaaacagcgcaaccgcgtcaagccgctcgcagaca

SEQ ID NO: 704440 - DNA, 280 bp, Homo sapiens
tttggggggggggggggggcccccgggaaaaatggcacccccccttttttttaaccccttttgggaaaaaaaaggggttgggggccggggttttttcccccaagggggttttttttcccccggggggggggggggcccccccggttttgtttttttggccaaattttttttggggaaaagggggatttttttgggggccctttttttttttgggttttttttcccccccccgttttttggtttttttaaaccccccccgggggtgggggttttcccctta

SEQ ID NO: 704441 - DNA, 799 bp, Homo sapiens
agccatgtacccctaatcgggtgcctctcagtcctcctaaggaccgtccggcctagccatgtgatattcacttccactccatgacgctcctcatactaggcctactaaccaacagactaaccatataccaaggatgggcgcgatgtaccacgaggaaagcgagcataccagggtcaccacaacaccgaccatgtccaaaaaggccttcgatacgggataatcctattgtaatatacgctcgagaagtgttgtgtgtctgtgcgcaggatttgctctggagcgcttttacgcactcgcagcctaagccgcctaccccgcacaatggtaggagggcacgtggccccgcgaacaggcatcgaccccagcgtaaatcgcccgtgagaagtccgcacgtcgctaaagcagcactcgcgtgattacgttgcgcgatcaggagtatcgaatcagcctgagctcagccgatagtcgtaagtagaaaaggaaagccgaaagcgaaataaagttcgaagcactgctgattacaatttgactgggtctctattgtgaccctcctacgagcctcagagtactgcgagtctcccttcaccatttccgacggcatctaccggctcaacatgttttggtagccacaggcttccagcggacttcacgtcattatcggctcaacgtttcctcactatctgcttcatccgccaactaatatttcactttacatccaaagcatcacttgggcttcgaagcccgccgctgatactggcatctgtagatgtggtttgactatgtctgtatgtctccatct

SEQ ID NO: 704442 - DNA, 435 bp, Homo sapiens
  misc_feature (369)..(369): n is a, c, g, or t
  misc_feature (427)..(427): n is a, c, g, or t
ggcagggatggagtctctctctctgttgcccaggctagagtacagtgacacaatatcagctcactgcaacctccacaccctgagcagtcttaactcatcccagcactttgggaggccgaggcgggcggatcacaaggtcaggagatcgagaccatcctgggacagagtgagacccttgtttcaaacaaaacaaaacaaaaacaaacaaacgaaaacagcaggaagtgataggtgctgtcaacggaaagccaaactctaaaatatttgaagagatttattctgagccgaatatgagtgaccatcgcccgtgaaacagccctcaggaggtcttgagaacatgtgcccaagggtgtccgggcaccgctggtntcatacattttagagaggtatgagacatcaatcaaatacattaaagaaatacattggntaggcccg

SEQ ID NO: 704443 - DNA, 145 bp, Homo sapiens
tttttgttgggttttttttttctttggttttagtctttgttgcttgttattgtaagctggggaagaactttatttatcaaagcggaaatcccctgaaattgtttaaaagcccctgattacccccttgatgccttttgggatattg

SEQ ID NO: 704444 - DNA, 632 bp, Homo sapiens
ttataatttaatctaagggtcgcccccgtgtccaaagtgtttgcgccccctcaactgatgccccccacgttgtgttatttagttcccccccgtacttttcaccaaaagacggtgctctttctgtcattgtatcttttactgaaccgcaccactttattttttggtcatacatgggacgaaaatctttcaagagattattttctcacccccccctcctcaccactcgttgtccacatactgtttattacaaggcgtgcaccacacggcgcttctgtttaattatggttgcgccgcggtctgtataagtctgcacctcctgtgtcgagagttttcttacaccactgtgtctagtgtcccccagctgcaggagtattcattctttatggggcttggttgttctgtaacccacccctcttcgctggcctcccctcgcactcgctgtggtcgctctctctaggtgttagcattgtggagaaatttctcttttctccccactttaacaagagctatcaacacgtacaccggtgaaatcacccccaatatttttcaaactatcttgctggactacccccaagctctctaaaaatcaattattaaaacaacaccccccacctccccacattaacaaacaa

SEQ ID NO: 704445 - DNA, 177 bp, Homo sapiens
taaatagcgacgcccatgaaaaggcacatggggtggagctggggtcgtcagcactggtcctgacggagacatagtggcgccaacgtaagagcttgacttctctgcaggttcacagaccgtgaggctcatgatacttagaaactcaggcggtggaacaggaacggtttaagaggcatc

SEQ ID NO: 704446 - DNA, 240 bp, Homo sapiens
  misc_feature (107)..(107): n is a, c, g, or t
aagctgaggtgatctcagaggatccctatacacccacacctgcagagttctcccctctctctgatccaggcggctatcggtgctgctgcttgtacattcttcccccntctggggggctctacctctccacacttccccagaaggaaaagggcaccctggattactctttggaaatcactccttggtggtatcaggctataccacccctagtcagtcatgagccatgggtcacagagggag

SEQ ID NO: 704447 - DNA, 221 bp, Homo sapiens
ggtcagcacgtgtgctcacgatgttgaccggtaacttgttgcagtgcaggcatgcagccggattggtgaatacacgtcgaccagagtccatcttaacgatatttggcgtgtcgagcagggtgctcaagtgatcgacggatcttgttccaaggaggcatgcaccgcaagtggtgaatacacgtcgaccatggaggcatgcatgcatgatcggggtactgcac

SEQ ID NO: 704448 - DNA, 1430 bp, Homo sapiens
ctgtacagccctctcccgcctatccttccccaagtgacgtcactgccttgtcaccagcgagcatgcctgtcatgcccactcccctgaggaagcatggggacccatatacaccctggttgccctgcaccagacaggccggtggtcaggcccaggccgacggctcgggttcgtgccacagctttcccacgttgcttcgctttgaacattgcgtgtgcctgctgctgtggtgctctgtggcatgtgctcgtgaaacttgtgacccattcactcacgtccaaacaagctgaggtggcccttcgaaggccaacaggttattgcagacttgacagctgtcgtctcagtagacgacggttcaccatgctatgtcaaaaccttcgagtaaccctcgttgattgctcacgttacacatttgcccagggaggttccttgaaagagacttatcgccgggaactttggccagaacggcttaacactcaccgtcggcgccatttacgaactcttggcaaccaacacttaagcgaggcacccgaggcccccatcggccagcaagccccttcgggaaccccgggaataggcgttttagccttcaagccggactactgctttattccaccgagtgaacctcattaacacagtgtctagaaagtacctatagagacgcctttacatggcctatactttattgttaccccccccaatttcatcacagcctttccccgtatcctcaccgagtaacccacaaaccaccccgcataatatacgcctaacatgtcgtccaatttaccgcgtgactacccaagtaaataaatagctcacaaacccgtaaacgagggacaacagcatttaaccgatgttttcctacagcatcacaagccatatctaacacaacaagtggcctgctcgtctccgttaccttaagtagcgacgataatctaccgcacctagaagggagtgactcccacaaagcctattctacgccgcgtaccccccacgccgactttacttgatcgtgcatacaccaacgtggttgggacccccctatatatgcggacgtaaccgccgcacaactcatcaatagacgggctcaatggcacacattgctcaccaggttgtgttacttcaaacacagcagtggcgccggtgtgcacctgggcgacaacaccacccgcgcagactacctgactggagacactcccgtgtggttcaaaaggcaaaccccatgataaattcccgtgcgtgaggggtgacccaacaattggagcacacaaccccctccaacgcacatatattactcgctggtcacgggctatcgataacaaacctcctcaacccgcggcacaatctgcggtcaccaacaccgccccatatttacgtaccgcccaagacttttgctccgcaattgttagattcgccgaccaatgacgtatccg

SEQ ID NO: 704449 - DNA, 776 bp, Homo sapiens
  misc_feature (116)..(116): n is a, c, g, or t
  misc_feature (630)..(630): n is a, c, g, or t
  misc_feature (674)..(675): n is a, c, g, or t
  misc_feature (680)..(680): n is a, c, g, or t
  misc_feature (691)..(691): n is a, c, g, or t
  misc_feature (695)..(695): n is a, c, g, or t
  misc_feature (702)..(704): n is a, c, g, or t
  misc_feature (707)..(707): n is a, c, g, or t
  misc_feature (711)..(711): n is a, c, g, or t
  misc_feature (727)..(727): n is a, c, g, or t
  misc_feature (729)..(730): n is a, c, g, or t
  misc_feature (733)..(733): n is a, c, g, or t
cacactccacataaccacacaaacatacacactcacaatcacaacgctcccaacacccccacaacactcaacaaaacccccacccaaccacacacacattaccactccacaggttntagctagtcctagtaatcgttaacgtgcacggatcccacgtttgtggtgggaggacatggtgctgcagggcggtatgctccgggctataaaaggttaggtagtggacaggctcccagtgctgacctgcgtggtcaaggacaatgaagtgcttaaaggcatggtggtatgatagctgctcggaacagtgacagagggtatgcagcctagttgattccagttggtggagcaggcaggatggggaagtaatctgggaagggttctgcacgatctcaagcctaacacagctatatcaggaatgagtggagtgccaggcgcacaacaaagcgcagtgcatttgcatctatcttaggcaaagaggcctcttaacatccgaactaaacagattcagcaaatgaggcaacaacaggggtggtgtttctatcttttcctttcccaaagcagcgtcctcccaccacaaacgtgggatccgtgcacgttaacgattactaggactatgcagaaacctttggagantacttcgccattctgtctgctccaccaactggaatcaactaggnngctancctctgttacngttncgagcannnatnatancacatgccttaagcantnnatnttccttgaccacgcaggtcaggacgggagcctgtccataacaa

SEQ ID NO: 704450 - DNA, 100 bp, Homo sapiens
ctgtgacatgtcacgcagcagatgagacagagctagaaccctggaacaggctatgtgttgagggagggagaggaagaaaccaaggaccccctggtcctgg

SEQ ID NO: 704451 - DNA, 639 bp, Homo sapiens
  misc_feature (20)..(22): n is a, c, g, or t
  misc_feature (28)..(28): n is a, c, g, or t
  misc_feature (493)..(493): n is a, c, g, or t
  misc_feature (537)..(538): n is a, c, g, or t
  misc_feature (543)..(543): n is a, c, g, or t
  misc_feature (554)..(554): n is a, c, g, or t
  misc_feature (558)..(558): n is a, c, g, or t
  misc_feature (565)..(567): n is a, c, g, or t
  misc_feature (570)..(570): n is a, c, g, or t
  misc_feature (574)..(574): n is a, c, g, or t
  misc_feature (590)..(590): n is a, c, g, or t
  misc_feature (592)..(593): n is a, c, g, or t
  misc_feature (596)..(596): n is a, c, g, or t
aggtgacgtactgtggaccnnnttgtgnggaggacatggtgctgcagggcggtatgctccgggctataaaaggttaggtagtggacaggctcccagtgctgacctgcgtggtcaaggacaatgaagtgcttaaaggcatggtggtatgatagctgctcggaacagtgacagagggtatgcagcctagttgattccagttggtggagcaggcaggatggggaagtaatctgggaagggttctgcacgatctcaagcctaacacagctatatcaggaatgagtggagtgccaggcgcacaacaaagcgcagtgcatttgcatctatcttaggcaaagaggcctcttaacatccgaactaaacagattcagcaaatgaggcaacaacaggggtggtgtttctatcttttcctttcccaaagcagcgtcctcccaccacaaacgtgggatccgtgcacgttaacgattactaggactatgcagaaacctttggagantacttcgccattctgtctgctccaccaactggaatcaactaggnngctancctctgttacngttncgagcannnatnatancacatgccttaagcantnnatnttccttgaccacgcaggtcaggacgggagcctgtccataacaa

SEQ ID NO: 704452 - DNA, 679 bp, Homo sapiens
  misc_feature (44)..(44): n is a, c, g, or t
  misc_feature (533)..(533): n is a, c, g, or t
  misc_feature (577)..(578): n is a, c, g, or t
  misc_feature (583)..(583): n is a, c, g, or t
  misc_feature (594)..(594): n is a, c, g, or t
  misc_feature (598)..(598): n is a, c, g, or t
  misc_feature (605)..(607): n is a, c, g, or t
  misc_feature (610)..(610): n is a, c, g, or t
  misc_feature (614)..(614): n is a, c, g, or t
  misc_feature (630)..(630): n is a, c, g, or t
  misc_feature (632)..(633): n is a, c, g, or t
  misc_feature (636)..(636): n is a, c, g, or t
aaaaaaaaaaaaaaaaaaaaaaaagacacatagacatacgaaanaaaaggttttctgatagtcctagtaatcgttaacgtgcacggatcccacgtttgtggtgctataaaaggttaggtagtggacaggctcccagtgctgacctgcgtggtcaaggacaatgaagtgcttaaaggcatggtggtatgatagctgctcggaacagtgacagagggtatgcagcctagttgattccagttggtggagcaggcaggatggggaagtaatctgggaagggttctgcacgatctcaagcctaacacagctatatcaggaatgagtggagtgccaggcgcacaacaaagcgcagtgcatttgcatctatcttaggcaaagaggcctcttaacatccgaactaaacagattcagcaaatgaggcaacaacaggggtggtgtttctatcttttcctttcccaaagcagcgtcctcccaccacaaacgtgggatccgtgcacgttaacgattactaggactatgcagaaacctttggagantacttcgccattctgtctgctccaccaactggaatcaactaggnngctancctctgttacngttncgagcannnatnatancacatgccttaagcantnnatnttccttgaccacgcaggtcaggacgggagcctgtccataacaa

SEQ ID NO: 704453 - DNA, 84 bp, Homo sapiens
ggggacaggcggactgccgcggggcagtcagcggggccacggggcacggaggggagtgcacgggcggaagaagggccggggccc

SEQ ID NO: 704454 - DNA, 2489 bp, Homo sapiens
cttattttcaactcccgagtggctagacaggaaaaagaaagaaatgatgtgaggaaagttgggaagctctgcacagtgatccctgagagccctggcaccactttaggagacgtggtaggtcactctgtacatgttcttcctcagcaaggggggttttcccaaaagggacacaagaagaaatcttactcagtggagtaaatggaaagaagagggagcatgtctgtctggttccttcctatttctcctttcctcagagtcaagtttcaccccacagggagttcacgcttccatgttgcctcatccagcccttcaggaagccagagtctgtgctccagtgtggcatttcagccaacctagaaatgaagggtgacttagcacagagaggttcaacaagtggggcatgcaggccactgatctctgcaagggcagcagtgccggggtgctctgggatacaggcagtgccttcggaaagaagggcaattgaagacagttgagaaggtgaacaaagtttacatctaacaaattttaaagttttattatttttatttttatattcttggggtctcactattttgcccaggctggagtgcagcagctatttgcaggctgaatcccactactgatcagtactggagttttattttatttaattaacttatttattttgagacagagtcttgctctattgctcaggctggagtgcagtgttgcgatctcggctcactgcagtctcgacctcccaggctcaatcgatcctgccacctcagcctctggagtagctgggactacctgtaggtgcgtgccaccacgcccaggtaatcttttattttttgtagataccagttatcctatgttgcccaggctggtctccaactcctgggctcaagcaatcctcccacctcagcctccctaagtgctgagattacaggtgtgagtcactgtgcccagccaacctggactattctaaattttaacagtgcctaagagaatcatgcttaattaaaaactagctggacgtggtggcttacgcctgtaatcccagcactttgggaggccgagatgggcggatcccttgattccaggagttcgagtccaacctgggcagcacgaagaaaccctcatctctaccaaaaatacaaaaattagccaggcattgtggtgtatacctgtagtcccagctgcttgggaggatgaggcaggaggattgctggagcctgggaggtggaggttgcaaaaaaataatgacttttagtgttactgcagatgcaacgcatgttcactgtagaccaatttaaaactatagataaaccaaaacaacaaactttttcttttttttaagagacggagtctcgctctgttgcccaggctggagtgcagtggtgcaatctcggctcgctgcaacctcagcctcccaggttctagcaactcctgcctcagcctcttgagtagctgggactacaggcgcacaccaccacacccatctaattttttgtattttagtagagacggggtttcaccttgttatccactgtggtctcaaactcctgagctcagacaatccgcccgcctcgcctcccaaagcgctgggattacaggggtgagccaccacacccggccaagaaactttaaatactacctagagacaatcccttttaaaactttagtgtatgtctttttataccattttctaggcttctaggctcatttgcaaaaatgagataccactgtaaatacttaatctgtaaattatctttttcaggagtctctctgagtcttctggctcagggagctgtcctataacataaataagtaaatttttttttacaatggttgttgaagatactaataaatattcagggctgggcacagtggtttatagctgtaatcccaccacttcgggaggtcaaggtgggaggattgctttagcccaggagtttgagaccagcctggggaacataatgagacccatctgtaaaaaaagaaaattaaattcacctttagtattatcttattaaaattccattgtgcatttacacaatcatttaccttatcagtcccttcagaagaacatttaagttgttatcacttacatccttgcagctaaatctttgagtacatcctaatacctgtctgtttttaatgacctatctaaggaatcctttgaaacctatacacttaaccactgtgttagctaagagcctccaaaaaggctgggtgtggcggctcatgcctgtaatcccagcactttgggagtccgaggcgagtgaatcacttgaggtcaggagttcgagaccagccgggccaacatggtgaaaccccgtctctacaaaaaatgcaaaaattagttgggcatggtggctcactcctgtagtcctggctactcaggaggataagtggaaggatggcttaagctcaggaggtagagattgcaatgagccgagattgtgccactgcactacaacctgggcaacagagccagaccctgtctc

SEQ ID NO: 704455 - DNA, 597 bp, Homo sapiens
  misc_feature (451)..(451): n is a, c, g, or t
  misc_feature (495)..(496): n is a, c, g, or t
  misc_feature (501)..(501): n is a, c, g, or t
  misc_feature (512)..(512): n is a, c, g, or t
  misc_feature (516)..(516): n is a, c, g, or t
  misc_feature (523)..(525): n is a, c, g, or t
  misc_feature (528)..(528): n is a, c, g, or t
  misc_feature (532)..(532): n is a, c, g, or t
  misc_feature (548)..(548): n is a, c, g, or t
  misc_feature (550)..(551): n is a, c, g, or t
  misc_feature (554)..(554): n is a, c, g, or t
gctctcgtctgaagcatagcccggcaataaaggcagtactagacaggatcccaccgccgacctgcgaggtccaggacaatgaagtgcttaaaggcatggtggtatgatagctgctcggaacagtgacagagggtatgcagcctagttgattccagttggtggagcaggcaggatggggaagtaatctgggaagggttctgcacgatctcaagcctaacacagctatatcaggaatgagtggagtgccaggcgcacaacaaagcgcagtgcatttgcatctatcttaggcaaagaggcctcttaacatccgaactaaacagattcagcaaatgaggcaacaacaggggtggtgtttctatcttttcctttcccaaagcagcgtcctcccaccacaaacgtgggatccgtgcacgttaacgattactaggactatgcagaaacctttggagantacttcgccattctgtctgctccaccaactggaatcaactaggnngctancctctgttacngttncgagcannnatnatancacatgccttaagcantnnatnttccttgaccacgcaggtcaggacgggagcctgtccataacaa

SEQ ID NO: 704456 - DNA, 1474 bp, Homo sapiens
  misc_feature (251)..(251): n is a, c, g, or t
  misc_feature (1474)..(1474): n is a, c, g, or t
ggtagtggtgtgatcgtcaatggtgtggcacgagatccttagctcacttgtatctgcttcggatctagctcgtaccgagttctttaaggcccagccaagagtcgtgcacagtggagctgacgaagactgcagcagtgcgggaacccgtgcgggcgcataccgtggtcaagggaggtcagaggtaccatagctgcttggtatctctacattcggatgatgggatctgaggtcctgatgtccggttctctctngtcagttacctgcacctgattcgcgaccgtgaccccatgacactctgcgcgttacgactcctcaacggtgagtctggggatgagacagaagcttaagcagtactggtacaagtattcgcgcatatccactactcattgcgctcgtgtggggcggtgtctgcgccaggccgcatttgtactaggcgatgcaaaccacagggcactccaatagcaaacgcaatgggataggattggcattgcgagtcgtagcgcgtagtgtttggaactatggggtcgtgaccgactcatcccggggggcgaataggccggtaggcgcttgtacccatttgatagaggcacagagagcctcgctagggggttcgaaacgtagttcgagtcgctagggggggtcttcaaccaaatgggagtcccacacgttttgactcaaactggcgtctccattttcaccacgggaaaactgcaaaggcgttttgcctcaagggaagaccaaatgggaaacgcccaatcttgctcggaattgtggcaacgacgactcgcttttcggggggactttcaaagttcccgaccctggtatccaaattgcattgttaccccttgtcgcccgagtccccattgacatggacatcctatccaatccggtccagcatagcgaacacgtgggtgggcggtcgtccaccaatacccaagtggtatccagaggtggacttcgcaattgcgatcctttgttgggaaccgaaccagttgggtactagcggcggtggcaaccgaaagggcccgcggcggttctatgtactcccttcgattgtgggcacttgtgcccgtggacgttcctccatatgggctagaccattttggcagccaaagagctggcgggggtctctcccttctgggtgcggaactccaccaatctcgtgtggggttgcgcggtcccctttgtccacgctgggcctaggtcgacgatggagcgaatttcgcatcccaggttgttcgtggccgtggtgcgcttccccattacctcctgtagaggcggtccatcggccacagggaatcgcgaactgtacacgttcttccagtggttcccaggcgcgggtacccgatcggcgtggttaggtctgctgcacaaggaacgcgggagatctcacgcccggccgcatagttccggcattccttctcgggtgtctgcctcgatagagcccccggcgttttttcataacttgtagtgn

SEQ ID NO: 704457 - DNA, 266 bp, Homo sapiens
agcctcgacagcatgttccccacagcatgggactaaattcagtcatcgggcggtcgggggaagcatgctgaccgggctgggtgttttttgggcatctactcgaccatctggcccaccattcccatggctccagatatgagaggacaggcaactatggtcctgagctccgcacacttctggtggggattatttctggttcctactgccggtcgggctagtcggggctcgcgaacgtgttatcccccccactgtcgggctagtcgggg

SEQ ID NO: 704458 - DNA, 240 bp, Homo sapiens
gcccccagggccctgaaggccacacaataaacccttttggccacgttgaaatttttgggaaaattttttttgggccctttgcccgaaggcctggttaatgggttggggccaaaccccggtttttgggtccggttaacccttttgccctttcccgtttggtaccgggaccaagcccccagcccctttttttaaattaaggggcgggaggggccaaaaaacccacaggggcctggggtttta

SEQ ID NO: 704459 - DNA, 1151 bp, Homo sapiens
  misc_feature (434)..(434): n is a, c, g, or t
  misc_feature (455)..(455): n is a, c, g, or t
  misc_feature (1005)..(1005): n is a, c, g, or t
  misc_feature (1049)..(1050): n is a, c, g, or t
  misc_feature (1055)..(1055): n is a, c, g, or t
  misc_feature (1066)..(1066): n is a, c, g, or t
  misc_feature (1070)..(1070): n is a, c, g, or t
  misc_feature (1077)..(1079): n is a, c, g, or t
  misc_feature (1082)..(1082): n is a, c, g, or t
  misc_feature (1086)..(1086): n is a, c, g, or t
  misc_feature (1102)..(1102): n is a, c, g, or t
  misc_feature (1104)..(1105): n is a, c, g, or t
  misc_feature (1108)..(1108): n is a, c, g, or t
agggacccagtacttaatttctgaaggttctccggaggctcagaattcagcaaacagggctgccacaaatgcaaggagggcaagatgatctgcatctgcaactactgccaatgttcggtgagtcacaggtgtcacgtgctatagttgttgaacagttaatacttacaccttcttctagcctgagtaaaatcctgcttgtgatgggagctaggcaagttattgtggtttctgccgaactcccttctaaagcaaaagcacaagtggtggggctgtagccttctaggttgctgactttggaaccagtccaagatctagttctgctggcagaagctaagattcaagaggcagagctaattgtagaagcagtggtaagcgttcaccagctgctataaatatcagaggttcggagcggtctgctggtgatgcagctgcgncagctgcagctggtcgaggtncctaagacagagaagtagagaatgcttctcgcagagaagtctagtcacgagttccagagttgttgcaggacactatgatcatttaggaggacatggtgctgcagggcggtatgctccgggctataaaaggttaggtagtggacaggctcccagtgctgacctgcgtggtcaaggacaatgaagtgcttaaaggcatggtggtatgatagctgctcggaacagtgacagagggtatgcagcctagttgattccagttggtggagcaggcaggatggggaagtaatctgggaagggttctgcacgatctcaagcctaacacagctatatcaggaatgagtggagtgccaggcgcacaacaaagcgcagtgcatttgcatctatcttaggcaaagaggcctcttaacatccgaactaaacagattcagcaaatgaggcaacaacaggggtggtgtttctatcttttcctttcccaaagcagcgtcctcccaccacaaacgtgggatccgtgcacgttaacgattactaggactatgcagaaacctttggagantacttcgccattctgtctgctccaccaactggaatcaactaggnngctancctctgttacngttncgagcannnatnatancacatgccttaagcantnnatnttccttgaccacgcaggtcaggacgggagcctgtccataacaa

SEQ ID NO: 704460 - DNA, 952 bp, Homo sapiens
  misc_feature (434)..(434): n is a, c, g, or t
  misc_feature (455)..(455): n is a, c, g, or t
agggacccagtacttaatttctgaaggttctccggaggctcagaattcagcaaacagggctgccacaaatgcaaggagggcaagatgatctgcatctgcaactactgccaatgttcggtgagtcacaggtgtcacgtgctatagttgttgaacagttaatacttacaccttcttctagcctgagtaaaatcctgcttgtgatgggagctaggcaagttattgtggtttctgccgaactcccttctaaagcaaaagcacaagtggtggggctgtagccttctaggttgctgactttggaaccagtccaagatctagttctgctggcagaagctaagattcaagaggcagagctaattgtagaagcagtggtaagcgttcaccagctgctataaatatcagaggttcggagcggtctgctggtgatgcagctgcgncagctgcagctggtcgaggtncctaagacagagaagtagagaatgcttctcgcagagaagtctagtcacgagttccagagttgttgcaggacactatgatcatttaggaggacatggtgctgcagggcggtatgctccgggctataaaaggttaggtagtggacaggctcccagtgctgacctgcgtggtcaggttacatgcatagtgcctagataatcgttgaacgtatcactggatcctcgtagggagtactatcttgtgtcaggccccgtgacatctctgggttcttgtgtaggcttgatgcatgtgtcatatactggggctcatggtaaggggttgtctcaagacagcaagatactgtggaagttctgatatagattgctccggagctctagtgagcgagatcgagcgatgactccaggacacgttcgctagtggacctgccactaattctacgtcacagcagctaggaggaccgttcataactgctcctctcgagtgggcctccccaagacgg

SEQ ID NO: 704461 - DNA, 1032 bp, Homo sapiens
tttgggataaactgggttgctgcagagttggtccacactaaccatcctaagtgaagacttagataagtctgaggatctccaggcactgcaaaagagtgaaaagctgggagtgaaagggttagtagtttaggtgttcattgtgttcgggttctctgtatcagtagggagtcgctgagtgtgggtaacctgcaaacatcgttgtaaacagtgtgaagagatcatcccattcctatccccagtaaaaataggcctctccaggcagatctactaccagttcaacttagcttctgtcttgtcttggtgcgccttgattagcagtctccatgcgtgtgatgaccacgagaaggggagcgcgatgggtcgagctgggtccgagtgtactccgctccctccggggttccccagcgtattgatccgggtctcctacaggctcccaatacaggtaagacgcgggaggatttacggaggtcagtcacgtcacacgcagtgctcccattcttcaatgcttaggattctatgtaatagctaaagggtgaggtgtaccatcgcatcgtggagactcggacgggtaatctatggccttagtaactcagggatacaggcaggcgtaagcccttccaaccgtgtcggggcattggtggctatgagaatgcacccgaggtcccctccaatcgagcaatactgctagggctgaaaaatctcggtgtaagcctgaattcttgagtgagaacccaggacaagctgtcagaccacctgttcggcccatgggggaagggcacgagaccttggcagagttgttttactggaaaaccgacatttcgccctggtgggcgtcgaaagagccacacagggccagaaagaggggcatatgggcgaaactggtcccgagaactccccggacagtgtagaccttgaaggtgtatccaggtcgaagcgtctgacgtaaaaaccaacgaatacaccatcggggaaccgttgtaaacccaagcggactagaccacaagagagccttcaaagcggaacaagtctcga

SEQ ID NO: 704462 - DNA, 1029 bp, Homo sapiens
  misc_feature (3)..(3): n is a, c, g, or t
  misc_feature (91)..(91): n is a, c, g, or t
  misc_feature (112)..(112): n is a, c, g, or t
  misc_feature (185)..(185): n is a, c, g, or t
  misc_feature (210)..(210): n is a, c, g, or t
  misc_feature (218)..(219): n is a, c, g, or t
  misc_feature (236)..(236): n is a, c, g, or t
  misc_feature (251)..(251): n is a, c, g, or t
  misc_feature (256)..(256): n is a, c, g, or t
  misc_feature (258)..(259): n is a, c, g, or t
  misc_feature (261)..(261): n is a, c, g, or t
  misc_feature (269)..(269): n is a, c, g, or t
  misc_feature (271)..(271): n is a, c, g, or t
  misc_feature (274)..(275): n is a, c, g, or t
  misc_feature (289)..(289): n is a, c, g, or t
  misc_feature (306)..(307): n is a, c, g, or t
  misc_feature (357)..(357): n is a, c, g, or t
  misc_feature (477)..(477): n is a, c, g, or t
  misc_feature (528)..(528): n is a, c, g, or t
  misc_feature (664)..(664): n is a, c, g, or t
  misc_feature (705)..(705): n is a, c, g, or t
  misc_feature (738)..(738): n is a, c, g, or t
  misc_feature (816)..(816): n is a, c, g, or t
  misc_feature (839)..(839): n is a, c, g, or t
  misc_feature (885)..(885): n is a, c, g, or t
  misc_feature (911)..(911): n is a, c, g, or t
  misc_feature (934)..(934): n is a, c, g, or t
  misc_feature (937)..(937): n is a, c, g, or t
  misc_feature (956)..(962): n is a, c, g, or t
  misc_feature (964)..(966): n is a, c, g, or t
  misc_feature (993)..(993): n is a, c, g, or t
aangcaaacagtactccccgctgcccaagaaggcggaaggagacctcggccccagctggttctgcggtttctccaacctggagtccccaantcttggagaagagagccagcnagttgcaccagcgcgacgttcttttgaccgaactgagcaactgcacggtcagactgtatggaaatcccaacancctgcggctaaccaaggcccaaagntgcaagtnntctgcggtccggtgtcnaccttgttttcctgnagaantnnantaactgcntnctnnaagtggctgcaaanagtccgcatacacagtnngaaaaacacccgcatcttcctgcaggtgaccagcagggccatcgtggagnactgcagtgggatccagttcgccccttacacctggagctacccggagatcgacaaggacttcgagagctctggtttagataggagcaaaaaataactggaacgatgttgacgattttaanctggctggcgcgcgggatatggcgctccccacactggagtattcttcctgnagaggagcgaaatatccagtgggactaagcagttgtcactctgttcttcactcctaccaaatactttccacgttggactttcccccttattgggtctcgcacacgttcactcattgtcacactgtgtatgttttcngcattttaaggctagacgattgtaatgggctcccacttgtnatttccattaaattcgttacaggtatcacactnaagcatttttgctattttcgtcatgcctttgagcactgactgctcactccgtcccccagcgcgctcgcgcgctgggancacaggcgcgcgccaccacgcgnacttgtatttttagcagaaacggggtttcgccatgttgtccgcgcngctctcgaactcctcgaccacaggtnatccacccgctccagcttcccanagngctggcataacaggcatgnnnnnnnannncatgagctttatttatttatttttacnacaatagtttgaagcagtaagggggaaggaggtgat

SEQ ID NO: 704463 - DNA, 1021 bp, Homo sapiens
  misc_feature (388)..(388): n is a, c, g, or t
  misc_feature (551)..(551): n is a, c, g, or t
ggacgcgtgggtcgacccatgcgtacgataaactgacaagctgcagcgtgaacgtggtataaccattgatatcgtccttgtgcgcacacattagagcactcgacgcgaagtcactatgtgcactagtcattcgatgcccctaggacatcgaggatggacttgtaatcaaaccataggctatgcattacagaggcactctctcgaggactgatctgtgcgtgtcctgatttgtatcgcttgctggcctgttggctgaactttgatacgctggctatcttccaatgaatgggactaccacccagagaagtcatgtcgccctgtactggactctactaccaactcgtggctagtgaatagctacatcatagaattgctcagtgcttagttnatagcgaagaaactgcgagttcacaactagtaggtcctagcaccctagcgaagtcgctagcacacgaagtagtagtcgacgtgcaccaattctgtctaagacggaaaagttgccatgccaatcttataatcgaatttgaaagcatagaatgttggcttacccntagccccgagccacaagtagacgaattatggtgggccgaatgtctcctcggctatgggaaagtggctagatcggaacaatggctgagagccgagagtgtcgtaacatggccctgtggatatcaatgggcatggcaagagtgcaccacgtaacgaatgggcaatgtgccgactggaaaccaagcgtgctttgaggggtcgtggactgcagtagctaccgaacagactccgttacccgctgacaaggcccgtggtcgcctgcgctcgtcgcgcgggttgtctgaccagatgtggtgcttattggtgcctgttcgctgtcggcccgtctggtagactcggtggtcttcaaccccggtttggttgctcactttggccctccgtcactttgcgtctggagtagttctggcgaatgcaccgggggactttgagagaaaatccttcccggggccatttgtggttacggaaattgtcg

SEQ ID NO: 704464 - DNA, 308 bp, Homo sapiens
atatcataacctaggagatattattctcaggtaccatatataagactcacaaatactagaaagaaaatagaagaaggcaaacctatataataatacctataacatacatgcatacaaaatccattaaacaaatggcctaagtatacaatctaatactttcagggaagggatctgaaaaaggaaaagggtagccaataatgaatttatagtaagatggtggtgtgcataagggaacaggttaactttgtcaaataaaaggtgtgaataaaaaccattaggtacgattaaatatctagataattcaagca

SEQ ID NO: 704465 - DNA, 162 bp, Homo sapiens
cagctcgtatttagcgaggctggctgtaatccgaacagatcgtatcgcgtactgtagcgcccagaccgcacgccccgtagttgctctccactgactgtgtgtattccgatgccaggtagtggatgctgatgactatcacaatgattcgacgattcggacgtg

SEQ ID NO: 704466 - DNA, 533 bp, Homo sapiens
ccctcagtgccaagtatgctgtgaattcaccctttggacttgctgcccaaccctttggttgctcccctgactattgtaagaggtaaacttccttggtttgtttgagaatgcccattttcttaatgtgaaacccttctctctccccccttttattagtagggctaccatttttttccgttataaagggttgaccaatttgaatgacttaccccagtgtcattatcttccaatataaactggtaccctcccaactccccatttcatccccatatgaagtaaatgaagctagttaagcggatgctgtatcaactagtaccttcccattaaggattattttatagcatgaatttaagcctatttattcaaatgatattttactctggtatcccctttgttttagatttgtgccatgaatattccagtgctgcttaattttgttctgaattcttgtttctggcttgtaaagggcttttttagggtataaataaagccaatggccattcctgtttgtaaataaaaatgctgctagacca

SEQ ID NO: 704467 - DNA, 394 bp, Homo sapiens
  misc_feature (224)..(224): n is a, c, g, or t
acaacatggtgaaccctgtctcaacaacaacaaaaaaaatactaaaaattagaatttttgtatttttagtggagacggggtttcactgtgttgggcaggatggtctcgatctccttaccttgtgatctgcccacctcgggctcccaaagtgctgggattgcaggcatgagcactgcgcctggcccatccattcttgatatgtgatttatttggggctctgtgancaaaatctgttttgaaaacaaccttttattttaggctaatcacattttatgaaattcatggaaactcttaactatttgaactattatttcttagtcctagttaggcttctggggcatcttttttctgctcttgtgctctgtatggagttgccaccactgttctatttctt

SEQ ID NO: 704468 - DNA, 242 bp, Homo sapiens
  misc_feature (91)..(91): n is a, c, g, or t
gccggagccaaagcaagccagaagactaacagtactaactacaaatattcgcacctcgatcgcagtacccaggttctcacgtagctgaagnaatgtattactctgatagtcttcattcggatagactaaagcgtgtgctgactggagatgaggtaaagaagatatgtatgcaacgtccagtcaaaacggatggcaaggttcgagtcatgtcatataccttgctggattaatggatgtcatta

SEQ ID NO: 704469 - DNA, 177 bp, Homo sapiens
  misc_feature (7)..(7): n is a, c, g, or t
  misc_feature (44)..(44): n is a, c, g, or t
  misc_feature (75)..(75): n is a, c, g, or t
tcctcanagacgcagctcaggaggtaaggtggacatcactgagntggtacaggtcttacatgcaagacagaagcngtgttctggagatttgctgctcttctttggtgttaagcctcttgctttattaaacaactaagtcatgatgaaccattggaaggagctgcgtctgctgaggag

SEQ ID NO: 704470 - DNA, 811 bp, Homo sapiens
  misc_feature (526)..(526): n is a, c, g, or t
ggcgcgcaccaaggctgcgatggggctggagacggacgaaggcggacgtacagctcttcatggacgacgactcctacagccaccacagcggctcgagtacgccgacccgagaagttcgcggactcgcgacaggaccgggatccccacggtcaatcgcatctcaagctgggccttcgaggatgtgatcgcagagccggtgactacgcactcctttgacaaagtgtggatctgcagcgcatgcctctttgaaatcagcaaatacgtaaatgtacaatgttcctgacggtgtcctggcccattcccctggccttcatcggcgggaatcctcttgcgccaccctcagctgtctgcacaatctggatttcaatgccttttgtaaagacctgcctaatggttctgccttcagtgcaagacacatatggaagcaagtgtgaccagatgtcatcattgctccatttgtgtacgacgcgtaggacgatgctctcttctgtcagcctgcgactgagccaggattgatattggaccncaggtctggagatgggatactgtgatacttcttgtgtgatttataacattaagagcaccagtgtccttgtgcatttcctagtgttctaattacgaaacttattaggatgaggagccacttttagaaatgtgtatggacggtgcttccaactaatgttttctaattaattgacaagattcatatctacgttggaccagactatacggaggttgaccattagattcacggcgcaacgttgcgtcggaacggttacttttaggggacttacagtaggggctttcacac

SEQ ID NO: 704471 - DNA, 92 bp, Homo sapiens
gcgagactggtccccgccatgtctgcggccatgagggagaggtcgaccggctacctgcacgagaagaactgcatgactacctctggccaagc

SEQ ID NO: 704472 - DNA, 150 bp, Homo sapiens
agtactgacatatattaaatgagatgcaaagagctatgcagcattcatgggcctgtattggtgaaagctgtgcctcaatacttactccttgcattctttttataggcatcactccagaatctacttgaagtggatgacactgacttccat

SEQ ID NO: 704473 - DNA, 421 bp, Homo sapiens
  misc_feature (243)..(243): n is a, c, g, or t
  misc_feature (399)..(399): n is a, c, g, or t
aaattcaaccctgtgcctaatatggaatgacttcctaaaattagtatgtgaaaaaaaataccccgggtatatgcatgtatttttggaaagacagacacacacacacaccccctataagcacggaaaaactcaccctggaataaagcataagaaattggtaactgccgggcacagtgctcatgccctataatccccagcactttgggaggccgaggcgggtggatcacaaggtgaggagttcanagccagcctggccaaaacggtgaaaccccgtctctactagatatacaaaaattagccaggtgtggtggcgggcacctgtaatcccagctactcaggaggctgaggcaggagaatcgcttgaacccaggaggcggaggttgtggtgagccgatattngccactgcactccagcctgggt

SEQ ID NO: 704474 - DNA, 355 bp, Homo sapiens
ggtttccttctagtattttcttctatgaaaacaaacataaaattggatgggggccgggtgcagtggctcacacctgtaatcctagcacttttggaggctgaggtgggtggatcacctgaggtcaggacttcgagaccagcctggccaacatggcaaaatcccatctctagtaaaaatacaaaaattagctgggtgtggtggcgcgtgcctgtaatcccagctgcttgggaggctgaggaaggaattccttgaaggaggttcaaggaattgcttgaacccgggaggcagaagatgcagtgagccaagattgcaccactacactccagcctgggagacagagcgagactccatctca

SEQ ID NO: 704475 - DNA, 186 bp, Homo sapiens
gaccgcagttgctccatcaggacacatggagctttgcatgaccgctccaggtctccgcgtttccttaagtgccttatcttggtgtttccctactgttttgttagactgatgggaggaagaaatccatttcaaatctgctgaaacctgttaccaagcaacagcagtgattaaaagcaacctgatggg

SEQ ID NO: 704476 - DNA, 818 bp, Homo sapiens
gagacgtgaagcactgaataaatagatcagaatgactgatacaaatgccccagagccacatgtggaggaggatgacgattatgagctgcgacagctaagctcaaattataagcctccaccacagaatgctccctgaaagcagctgcgatgaagatggcacaagaagatgactgagcacgctctaacttagagtacacagaaatagcgctgctgaggagcatggtccctggtgtgttgactaggatcctgcaaatgacttcccactagagtgtccgttgctctaccgcgggctcagccctggtttttgtgacgagatgccccggtgtaccagatcagccattggaaccctttcaccgtaggaacggactctggaaggcccgctcaatacacaggaataccacttgctcgttcacacacggaacgtgttcctcgtagattagtacgtagggtcaaaaactgtcatctgtgcataacgtgtacacctagcggaatagttgcttgtcatggtcctgcacaaataccgctttcaagcacagccatacgaggcaccttgaggagatgcaaaagctggtataaaagtcgaatcagtttactagcggttgcgcatgctagtggtacctcgcgaactgcagcgagctattgaggttcctcgaatccagcttgaggaggctcccaagggcaactgtcctggcgcgaggctagcgtaccataactagttccttcttcaccgacgatgaccagcaagaccatctcagctggggcagctggaacctgtcggattaaaacggagtgaccgacctgatgcattcacccttttc

SEQ ID NO: 704477 - DNA, 637 bp, Homo sapiens
  misc_feature (556)..(556): n is a, c, g, or t
atctccccgttatgcggcaagaatgattggagtgactctctacagcgtatctatgtagaagtcacctctatgctaaccagaatgattcccgcccacaccatcttatactgaccttatgattgctaagcacagtatgtagagtgacgtctcttgcacagctctgtctgatcaagcaaaatgctgaccatgcatcaggcattgtgagtgtagtgcgctctatgctaccaatatacgaattgtgtgtccacccctccagacagcgaaccatatcttaacacactgttctgacacctaccataatctcagaagcacctgccgttgtacttaccctgctaccctgaaacttctcggaccacgccttctgacgacctggccctacaaacgatatactaacggtgagttgcactaacaggttctctcttttatagttacaacgctctctctgtctcataacattttacttgatgaaacagacacttgacatggatgacaacaatcgtcttggaattacgggcacactattgtgcttaccagggttagatcagagaagtctggntccaggacacatatggtgtatacacactctctctatgactctgaatataatcattacattggcgatcatgacctatacttt

SEQ ID NO: 704478 - DNA, 1092 bp, Homo sapiens
cctgtcgtgattccgaccagccgagaggaccgcagtgagtcatagttctatatactctctcgcgagactatatttattacctaacttgcgtgatcgtcacccgatggaggcatccgaagtgaacaatgcctgtgaggcacgcctgaggagcctcccagaaatttaatacaatccccctaggtagtggatacctaaatccgccgctagatacaattcgaataaataaattttaacaggtgcagggaataatcgctaggagctctagattgcaccccatgtcatatctataaccagaatccgcgaactggcacaagggaaagctagtgcaggactcgggtgagagcgctaggcacactatagtttagttgagcataggggcgttacaacgaataagctatagagtagtccagatacctcttttcacggcaaccttttgaatagatgtcctcgtaaagcccattggttgataccccctctgagtgggctgggtcattatacgatacattgaacgggagctaaatcggtgagaacgtagtggggtgcaatggtcataagtacggctcttcaaggatcaagtactcaagcaccctgagaaggaaagaatagggaacccgattgcactgggtgacgagtcgcctaatggtgaccataatctttaagaatagtcttcgaaactgcggtactgaccacatgggaggtgaaaagtcggctatcgcatgactctaacgttacagtcaggatgaggcctcgtgattgatcgaggatgtctcattcaaaaaggcctcgtgagtggcttcaccggggccgtcattgctccatgattcgtcccaaggagtagactacctcacttgcacttgtgggccatgcaaatgagataacgagcgaatcaaggcagatgaaatcctacttggaggggttcaaatctaattccaactaggttggaggacgtaattccaaggcggagaagagtttcacacttaagcattggggggctcttgtgaaccggtccggaaaagctcttcaagggaacaagtagtatatctcgtatacacaagggtgtcccgcagaaaaatcaataagaagcggtgttcc

SEQ ID NO: 704479 - DNA, 485 bp, Homo sapiens
cgtgactattgtggctgctgcgtatttgttgcataggctagactaccattccatttggccaaatgcacttcccccagtaaacttaaaacaacaacgagaacaacaagaacaagaaactccctgtcctttcatttactaggaaagaggatgggctactgaaccagttcattgcatgacacatgaagacaacatactgtggcatgagtggtgtcggtatagaattggttgtgctgtgactaaagtactgagggctgcagtgaaaacattccaattgctcccttccttccatcttactttagtggattgattctcaagatttggcacagaaaactctttgcgggctagaacagcagtgatggcatcgcactgttttcaagactacaggtctcaaaagcaaatcattaaataaaatacagtccctgatttgagttagatccagggcccagaaagtagcactatactttacggttacgtggtcaacaaat

SEQ ID NO: 704480 - DNA, 394 bp, Homo sapiens
aaaattaaggtgtagagtttttattcatttttttcttggcttgcttgtttttggaatcagggttcagctatcagcctaaaatagtgggttatgttatttgcaagcctcatggaaacttcaaataaaaaaacgccccaacagatacgcaccctcacagaaaagaatgtaaaacataccgccagagaaaatcatcttcataaaaaggaaaacaagaaggcaagacggaaggaagagcacaccaccaaacaaccagaaaacaccaaaacggcaggagtaagtccttacttatcaataacaccattgaacgtaaccagactaatctctccattcacaagacagagcggctgaatggccaaagaaaaacaggacccagcaatctgttgcctacaagaca

SEQ ID NO: 704481 - DNA, 119 bp, Homo sapiens
cgtgttcaccaccacgtattccacctgacgcggagaatttaatagagcaatagatgcatttaatgctgccttaactgttcggccagaggtaagtgtacgatggtcgtcaacacactgcg

SEQ ID NO: 704482 - DNA, 314 bp, Homo sapiens
ggaaaaaaccccccccccccccaaaaggcccttttggggggggggggggggggttttttttttggttttggggggttttccccccccccccctttttggaccccccttttgttttggggggggggcccccccccaaaggggccccgcccccccattgccctttttatttggggcccccccccccaacccccccgccttggggtttttttgggggcccccccccccttggggggccctatttttcggttttgccccgggggttttttaaaaatttttttttttttttttttaaatttaccccccccccggggcca

SEQ ID NO: 704483 - DNA, 423 bp, Homo sapiens
aaggtgggattgctcaaaccccgagaagtagacactacctgccctgcacccccttcccaggcatgttaggatattgccaatctccaggcttcctttagcaacacctagaaaagtcactgaatggctgggtgtggtggctcatgcctgtaatcccaacactttgggaggctgaggcaggaggatgatttaaggcccaggagtttgaaaccagcctgggaaatatagtgagaccccatctttaccaaataaataaataaataaataaatagctgggcatggtggcacatgcctgttgttctgaatactcaggaggctaaggtgggaggatcacttgagcccaggaattcaaggctgcggtgagctgattgcactactgcactctggcctgggcaacagagtgagtccctgtctcaaagcaaaaca

SEQ ID NO: 704484 - DNA, 213 bp, Homo sapiens
gacatatctaaacataaccggtccggagcacgtctgactggaatgtgggaacttaaccagcaggtattacttgcttgacaacttctgacctttagcgtgatactaaacgtatcggacaatcaacgaagaactcttgcggtagacccatttatctgtgaatacaatgctaccagagttccccctctctatgatcgcggcaacttataccgctag

SEQ ID NO: 704485 - DNA, 601 bp, Homo sapiens
agatagatcgcggtcatgaacgacaccgtacctactccgcactagagagtacatgagcaaccgactatttcagaggaaacacatggtcatagctgtgctctcacacaggaagccgagagcgcttagacgaaatcgggaaaactagcctaaatgtcaagagcaccggatgtcatcttgataggatcgaatcattggaggtggcaagacaagtggctttggcctgatttatgattccctggatgtatgcatagaacaatgaaccaaacatagacttacaagacatggcctgtatgagaagaaaaagacctcaagaaagcaacgaaaggaacgcaagaacagactgacagaccagtcagggggactgcaaaggccaatgttggtgctggcaacaccaaggtatagttcacttacggacacaatatagaaacgtcattaattgtaggtctttagtttctaggaaagaagggatcttattaatttttaaaataacttttcttaatgtttcttcttttccctcttcttctggattaccgacggtaacatgttttaagaaactatgtagcatagtgtcttaacacctcagtaaagtaagctggccacc

SEQ ID NO: 704486 - DNA, 1231 bp, Homo sapiens
aactatacaaacagaaacttacttgcttttagaaaaacattatatatatatattaacattttgacaaccttgcatttcttcctcatcaggcaactgtaaacgaatgtaggcttctgattgtcctaaccactcttgaacttggtattttctaactaatctctaacttgaactagttccttgcaaccatttgccacctagatactcatctgacttagcaactatctttgactactttaacttctcactctttttattataccttgagctagacgaatgcaagtgcgacacatgatagctcaacgtgtcacacttagatctattacacaaccacgactctggcgcgaacttataatttcgtatcctccacaatgtgcgccattaggtccttctctcgtataagccactccacgctctttgcacacgcctctctctgcttcataggaacatttagcgccttgaaccatatgttggggcaacgcctgtgcacgccaaaccggcataccaaacaccacacttaaactccacattggcttctactaacaactttgagcccaacccaactaatacgttgggctcataagcccctctcaccacacctctaaaatacttaaccatcttcctttgcacccaactgctcccaatatgcgacccaatttaaccccttaattggcgcgcactttctctcacccatcgcaagtctcgaatcacaaggcccctttacacatcacttgtccttaattgcttccttccctaacttccccaacttccaccgcaccacacttaccgcttctcctttactttctccataactatttctcaacaagcgtggccaaggcccactctccaatctcgaacgaccatcgactccaaaaaaaccaatcttatatatccccttggaacgcggcccgattcattcctacagctcccatctgttcattacttaactttccccatccccccacttagcggcgcccacgggaaactaagcggctggttattgcccattttacactaggcctaccacctttcctactactctaaacgaaacaacaacagaccccttgtgaataaagccttcttggaacctatctttcaaccaggcagttggtcgatcttgcgcagacggggcataccggagctttggccgccacatataccttaacttatcccccgtcggctggtactccttgcgaccaccgtaactttcactaaacgtctgaggcatatacct

SEQ ID NO: 704487 - DNA, 175 bp, Homo sapiens
  misc_feature (25)..(25): n is a, c, g, or t
  misc_feature (36)..(36): n is a, c, g, or t
  misc_feature (78)..(78): n is a, c, g, or t
  misc_feature (173)..(173): n is a, c, g, or t
ggtaagtaaaatgtaaagaagagtnactggttcccntcagtaagtgaagtatttccccatagtgccagctttatttanccccaggatgtttttgtggctgtatttgattgatatgtgcttcttctgattcttgctaatttccaaccatattgaataaatgtgatcaagtccangg

SEQ ID NO: 704488 - DNA, 144 bp, Homo sapiens
atgctaatacacctagtctgtcccgtcttcacatgaattcaatgaacaggggaataagacagtacacgagactgaggcgtcgcagcataaaggtcaatgttggcgctgatggacagctacagaaggatgacgcagatgctgaca

SEQ ID NO: 704489 - DNA, 187 bp, Homo sapiens
cagagtcttgtcatagacctcagaaacatcaggccactcatggttggaatacagcatatgcattgactagcaccatattcccgtctacatgtcaggatcacttgtgttgcccactttagagcagaagcacaactatcaataaaggaagaaccatcatcataaccattgggtacattagaacgtctgt

SEQ ID NO: 704490 - DNA, 928 bp, Homo sapiens
ccaacttctacactcttcaaaacttgaaaagaaattgacttgcaccttagaaagtggcagtgttgtctcttaggctaatattttatgggagtaagcagattgcagctacaagttatgttattatagactgttatactcctgttcagggagcaaaaaatctgctagggattaagcagaattgggttcacatctttgctttttcctgctctcgttctacaacaagtaattattatttctctcgtctgttccggatcttcgctttccagctgcttgttgccttttaactccatggagagaccgaactggagctgagcccagcacgggcatgctgggcaagagaggtcccccgagtcccaaataagcaatctcaactcagtataacaacgaggcagcgaacccacacgtggaagtctgcataccgcatgcaacaagggaaccgcaatagcatgctcctcccctcatggtcaaggcactgtgcgttcccactcgcgcaccttgcaacatacaccaaagcccgcaaagctacaccaacctgacccatccgcgcggcagctgccacaacggaactaattcgacgcactcattccagaccacagggcgaaaccactggctctttcagctctttctccccagattccaacagtcagtgtaaccagcattcccacctttcttcacctccctgcaaacgacgttcgagctcactcaccccagatgcggcactgaggagccctctgctccaggtgcgcgagacagatgccccccacatgcacatcctggacgtccatcgaacgcagatactcggggctccactcgacacaggaaggggcacggaaagccacctcaagggcataccgagcgagccccctgcctcacagtagctcgcaagaccctgccataaagccaatccctggagcactgcgccacttag

SEQ ID NO: 704491 - DNA, 447 bp, Homo sapiens
tttttttttcagacagactgctactctgtcatctaggttggagtgcagtggtgtgatcttgtgtcactgcaacctctgcttcccaggttcaagcgattctccagccttagcctcccgagtagctgggattagtgtatatttagtagagacagggtttcatcatgccggtcaggcagttctccaactcctggcctcaagtgatcagcccgcctcggcctcccaaagtgctgggattacaggcgtgacgagaaaatgtttttaaatgttaaaaatgttagctggaactttttctagctgtgacaaactctttctaaagtgattacgggaaagttagtcattgaaaagataagtcaatttcaaaaaaggaggttaaaaggggaataataggccaggtgtggtggctcacacctgtaatcccagcaccctgggaggccgagacaggcggat

SEQ ID NO: 704492 - DNA, 167 bp, Homo sapiens
ggttccccccttagttttagaaggttttcagttagctttagataaaaaaaacaactttgggccggtttgtttgccggtgtccctgggggttcacccttttatccccggcattcgggggggtgggggcagggggttggttggcccccggggttgggagcccggggttc

SEQ ID NO: 704493 - DNA, 393 bp, Homo sapiens
ccccaagtaataatgttgaaggtagatctcatcattcccatacacagtaaagcacataaacactttgtatcgtatacttattatctatcacaagccaatattaacttgcagaataataaagccactggtttatatgtttcctcaagatatgtttcatgtgtaagctagtatccgtgtgtgtacgtagaaatgattcaatacctgcagctggtgaattaggaattgtatttgttgccctttttatattagatgaggtgcaaaaattttaatgctagtcagtatgcaccaccacaggaaagttagatcccattagcacttgaaactacagttttggaaacttaggctaagttaatttggatttgttacttgattcacctactgaccttttctttt

SEQ ID NO: 704494 - DNA, 704 bp, Homo sapiens
aggaaggatgggtcagggtcaggcctgaagaggtgccctggctgcagcctgccacagccagtgtgttgcactttaggggacacatcttgagactaagccctccagcctccctggctttagcaggggaaagtgcagccaggagctgtagagatggatgctgtccttcccctgcccagggggcttagcatgttagttgccagacccagtgctggctgctgctcctcccccagggagttcaaagggcttagacagcatacagccgcagcattggtgccggtttccccttccgctgggagttcagtaggctccagctgagaggctgttgagaatctgcacagctccagggttgggatgctaggccctggtggcgtgggttcgcaagtggaatctgatccatgagttgcacaattccgtggtaacagcacggtttccttggctgggtagcatgctcactcgctgccttccttggctcgggagagggggctcccctgcccatgtggctctcagacaggcttccgcaccacactgttcttcctctctatggatcgcaccagccttctagtcagttctgatgagagaacctggataccttgcttgccagggagggattcacatgcttattatggtacttttttgagaaatttaaactttatcaattttgtctctttatatgaaaattgggaactgctatctgcaatacaatg

SEQ ID NO: 704495 - DNA, 249 bp, Homo sapiens
cttggatggttgctatacaaggcatgctgcagctgtggtcattgataaagaacacgggttcgttaatcgtcacaaatatctgcaggctgtacagtgaagcaagggcatcgtagcatgtgctcagttctggtgagggttgtagtcgctgcatcaaggacatgggcggaggaacgtcaggaaaagtgtctgtgtccatgccacgagaaatcacacccgaggtgagtcctggtctttacaaacaaccaagat

SEQ ID NO: 704496 - DNA, 873 bp, Homo sapiens
gcaaagggacaccaggactccaaaatgcgtcagttgtaccagtgaaggacaagaaacttctgaggtcaaactgggggagctgccaagctgatctgatgcgggactcagtccctagtgccattcggagcgtccaaagaggttactaccgtactacaacaagtaccatcaatgtgaagaaggggagcatctgcgcggataccatgtgctgcaatgcaacgtgctctttaagctactccttttcctacaagcatctcaagcacgagggttccggaaaataccattgaagaggacacatttctgaaccccccaaccaaagattgtggccgaggccctcggtgaggacacacaatctcacttcggttggtggaaattctttttacattaattccttaattaggaaattaaccttcccaaaattaaaacattgcttggtttcaccaacacacgaaacacacccaagaagaaaactcttttttggggcgcccggccaagaaaagttttaaagacaccacttcgttgggggggcggggcccaatatatgtatgacacatgtgcaaaaggtgtccaaagagaagaacctctgggcacagacaagggtgtgggttccccccaaaaaaaacgcggggggacaccgcgggttttgacaaaccaagggtgggctggggcaaactggcccatcaggggccacagaggcagaaaatcacgccggggggaggcgaacaacaagagagatgagagacaagtaagaaaagaaagacaagaagacaaagaacagagacacgcaaagaagaccgacagaaaagagcgacaaggacagaaacagagcacagagacacagagagggaagaagacagaacagagcagcaacagcct

SEQ ID NO: 704497 - DNA, 348 bp, Homo sapiens
  misc_feature (32)..(32): n is a, c, g, or t
  misc_feature (44)..(44): n is a, c, g, or t
  misc_feature (141)..(141): n is a, c, g, or t
  misc_feature (181)..(181): n is a, c, g, or t
  misc_feature (314)..(314): n is a, c, g, or t
ggtcctggttttcggcgccatgtgtatgaganaaagaaataaanagaaaggaagaggactggtcccaggaggaaaaccaaatagccttagaactcatggaatttgtcccaccggttagcacaaccacatcaagaggcaganccccgactgtcctgaggacttcttgctgttgtggagtttngctctgctcaccgtcttcaagatcaccacatccctcttggtccgtgagttgcatgaaaactccaaaaaggctgccagccctcactggacatgtatcattggtatcaagaatagtgattgctctttttcaagtnttgcagctggagcagattactgtttcaaccacca

SEQ ID NO: 704498 - DNA, 1660 bp, Homo sapiens
  misc_feature (444)..(444): n is a, c, g, or t
  misc_feature (473)..(473): n is a, c, g, or t
  misc_feature (488)..(488): n is a, c, g, or t
taatggggcttgggggagggaggtagggggtagtgggggtttaatattttaagtggggtggatggaggaatagtggtgaagggagtatggggggtgaatttatgggggggcctagccctaactaagtcctcaatctcccaacactattatgggcctaaactaacgtactataacctaaacctaactcccaaggcgtcaaacactatatactcggtgccccaacaatattatattattacactacacccacgtgggactatggacttctccaagaaaacaccactataatattgtggatatccacaccacaacacaccacccacacagagcctcaatattatattaaaggtatctctactccccctcttcactttatatgttttttaacacccacagtaatctaaacaaaacaacacctatatattaaccgtgtgtgtgtctccncacaaacacctatatctcctctcgcgagnaccccactcttaaanacaacacccccgcctctctcgtatatatttacatataactatagcgcgtgagaactctcctaatatcccccctctctacaagatctcgagtggggcgagagctcccacagcgcccaactttatatctcgcgacggtgggaacccccagctatatatctagcgaaaagaaaataaaactctctatacgctgctcatctcttatatatactataatatttctctcctcttctaaagcaaagaatctcctcctcttataatacttctataaagcctatttgcccaacggagagccccagcgaggaaaaattctacaaagtcacgaatatattattgacaatatatcatctctctgctgtctagccggagaaaagccccacaacatctttattattccgcgccacaactctgtgtggggggtataatttctataaacagcgcgcgggatgtgttgaggtgcgaacaccacagagggccgcgaagaaagagagccgcctgtagaaaaaacagaccgaggggggccacaacatataaatcattgtcccttaaattatgcactataacacacccccccctaaaggtgttgaggtggtgctcccccccatatacacccccttaaaatctcaattcgcggcccactgcgtggtatttttaaccactcttcccacacagaagaacccccccttaaggggggtctccacttaaaaaaacaactgtctcctatgataaaatcatgcaaacgttcccttcaaaggtgggccccccaagggaaacagcttatttctgaaaaagtctcccgcgtggtagcgcccaaacaacaaacctttctaaatggttgtgtgcacgatagggcattaatcaccaccagagaaagagccgttgttaaacatagaggcagacgaaaggagaggaagcaccgccgttatgagggggagagaccaccacagtagtagtgaagagtcgcccttaaaaaggcccccgtgtgtgttgataagggcccccccacagtggcgtgggggcgcacacaataaggaatatcggggcccggaagaaacaaccctaaacacaagtggcgggcagatgggagaaaaaaacgacgcgccaaaatagtgattttcaataccccccgtggatagaaaagagagatgcagcaccccgcgccgtgtgagataacc

SEQ ID NO: 704499 - DNA, 115 bp, Homo sapiens
gagctcggtcacccatcccccttcgtgtgtccatccccgtgcgtgtgtccatgtcaacatttttattaaccatacattttgtgcataaagtgtaagtcctaagggggatggacgc

SEQ ID NO: 704500 - DNA, 743 bp, Homo sapiens
gcactcagggaccggacgagtcctcaactcacatctgtcagctgccgctgctgtgttagcagacgcacagatcgctccatcatgtccttcagagctgaccagatagctgtaatttactaggggaggtcactttctacgtcgcctgtttgggcagaacaggtgagtgtccagaggatcacactttgaagccaggttcgcgtgatgtccttcgagctctgggacacgatatcccaccagtgcagagcgtcaaggagagttctggtgaaaccccaggaaatgatacagctgaagtgcgcctacgaatagttgaggtttatgacacgagatgtaacttggcctatagatggccatcggcctagttgtccaaacaactagatggacccatggcgcgacctttatggaaagactgtgctgtgagaagggggtctaagctggtagttcattgcttgactacatgcggaaaggcaatttggaggctaccattggacaatagagtgattgtctgggacaccatcgcggccctatgttttcatatgacccaaaacacattgggagatgtgctcatccatggaaccatgtacggcaagttgatgttggccacagatccctttgtactgtgacgaagtgcttccagtaaccaggacccatcacactttggggcatgccattcaaattgtaacggaaagacgtaattagtccaaggcagcggtcagtgctctgaatcttgaaaatgggttaactta

SEQ ID NO: 704501 - DNA, 1306 bp, Homo sapiens
  misc_feature (916)..(916): n is a, c, g, or t
  misc_feature (1254)..(1254): n is a, c, g, or t
  misc_feature (1266)..(1266): n is a, c, g, or t
  misc_feature (1270)..(1270): n is a, c, g, or t
  misc_feature (1275)..(1275): n is a, c, g, or t
tctgtgtcattggcgtaccagtgctacacgggttagcctggactaaaggcatccttgtcttgtgagctatacacctcagtagaaagaggatctaagggaatgatcactgtagtttagttctgttgacctgtgccaccttacccctttgtgaattgtctgcttggtatttactaattccacagggtcatcagatgcctgcttgataactatatacaacaataacataacatactttcacttcttcctattgtaatcgttgtgccatggatctgatctgtaccatgaccctacataaggctggatgtgcaccatcacgtgctgagtggccccatatgtactgtgtggctgtgggtgtgggtgggagtgtgtctgctagagtcacacggcaacacgattttcaagattctaaagctcaattcaagtgacacattaatgataaactcagatctgatcaagagtccggatttctaacagtccttgcttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttttggggttaaaagatggttggtagcatttaaaagggaaaattttctcctgggttggctagtatctggggggtatcctcgtggtaagtgtagcctcaaataggtcatcatgaagggttaaaaaagcgaggtgggccagtgtnagtgcgggggggtaaaggccagggcctctccaaccacgggtgccactgacttgctgtgtgacccgtgggcaagtcacttaacctataagggtgcctcagtttcccttcgtgttaaaaggggggataataatacgtgacctacctcaaagggcagtttggaggcatgactaaggcttttaagaaagcattgtggggatccttcagcacaggaattctcaagacctgagtatttttataataggaatgtcccccatgaacttgatacgtccgtgtgtcccagatgctgtcattagtcttttggtcctccagaactgatgatccctgggacgggggtactngccgacattggntctnacagntgcggctcggggccttggggggttcccttgg

SEQ ID NO: 704502 - DNA, 350 bp, Homo sapiens
aaatttttaaaaaaattttttgggggccgggggcagggggccccccccccccccaagttttggggggtttggggtgggggttggcccccccccccccctgttgggccccgggggggccccccccccccaaaaaaaaaaaaaggggcctttttgttatccgggggtttgggggggggtttttccccccgggtttttagggggggggggggggatttccagggatttccttttttagtttaaaggggggggggagggggggttttttttttttttcccccccccgtttcctggggggatttttttttttttttttttttttttccccaaaaaaaatggggggttttttccca

SEQ ID NO: 704503 - DNA, 104 bp, Homo sapiens
tcgggccctgtcgttcaggctagtagcaaagttcaggcagtccaacaggtatgggcgccagggtacagggcagagggagctgaggctcccaggacccgagagta

SEQ ID NO: 704504 - DNA, 1307 bp, Homo sapiens
gtggcaacaacagatttcctggctcaggtatgcaccccagctgctggttcagactgaagtgctgagacactatttagaaaaagcgctttaaaaagcatctagagattatcatgaaaataatgtggagacaaagtcactaggctgcttgtgtgacgaggcagcatacccagttggctctaaacccgttcacaaaaaaacaagtgttacgagaccttacggacttccaggtttggaaaactcttaatatatccgacttcactcggtaactttacattaccaaaaaaagcacttttaaaatagtcctcccttcaacatggctatcttttttcaagcttatatgcatagctctctcagccacttgcactggacacacactggtcacagcattctgggagtggtaatactttctagacattggcagatctaatctcaaggtgactaggaacccagagctacagtactctgtgacggcaatctctgcagaacggttgaactttacctagttgggttctatgacactttgtacgcactgccttgaattacgccattgtcacccaggtactataccgggtttggggccttgtgtgcagcggagtgtcctgaccatgttttggccacccctcttttaataaggaggagcactgctttggaacgtattcccaacaatgattggtccgcggctacgtgcgccacatcatcatggtggaaagtaataactgaacacataaggcacttgagatttaccgctatacaacggcacagtacattttgtaccaaatgttgcagacctcacactaaagtcggctatatagaactcggagttcttcatctgcctctcattctttccaaaagaaatactagggggggggagggagataggaggtggagcgggcatgggaggaggcggaagcaggagggaggaggggagagatgcgcgaaggaatgaaagagcggagagggagaggagatgagtggtggactggcgggagggagacggcagctaaggcggggagggagagatcggcggaggaggaggggagagatgacgggaagaggagacaaaacaaagcagcaggaccggaagaagaagacgccagagggaaaagaagagaaaggagagaagcgagcggagaacaagggaagagcaggagggagggaggaacaacgggagagggggcaggagaacaaaggagagcagaaggacaggaagaaaaagaagagcgaagaagagacaagacgagaagaagccgcaagcaggggtgccaagagacaagaaagaaacgaggagaggcaagccacgcagacag

SEQ ID NO: 704505 - DNA, 176 bp, Homo sapiens
aaagacccaggttattatttttttatgaaccacagaggaattttctctatgtaataacactgtttcagtatttcagtagactactgtggatgataatacaagccacgggaagacttgaacttaccactcattgaggatgaagtgtcagatatttaagtaataattaaattaagaca

SEQ ID NO: 704506 - DNA, 1051 bp, Homo sapiens
  misc_feature (37)..(37): n is a, c, g, or t
  misc_feature (58)..(58): n is a, c, g, or t
  misc_feature (83)..(83): n is a, c, g, or t
  misc_feature (111)..(112): n is a, c, g, or t
  misc_feature (189)..(189): n is a, c, g, or t
  misc_feature (219)..(219): n is a, c, g, or t
  misc_feature (262)..(262): n is a, c, g, or t
  misc_feature (272)..(272): n is a, c, g, or t
  misc_feature (336)..(336): n is a, c, g, or t
  misc_feature (347)..(348): n is a, c, g, or t
  misc_feature (355)..(355): n is a, c, g, or t
  misc_feature (385)..(385): n is a, c, g, or t
  misc_feature (440)..(441): n is a, c, g, or t
  misc_feature (491)..(491): n is a, c, g, or t
  misc_feature (503)..(504): n is a, c, g, or t
  misc_feature (508)..(508): n is a, c, g, or t
  misc_feature (516)..(516): n is a, c, g, or t
  misc_feature (626)..(626): n is a, c, g, or t
  misc_feature (690)..(690): n is a, c, g, or t
  misc_feature (736)..(736): n is a, c, g, or t
  misc_feature (770)..(770): n is a, c, g, or t
  misc_feature (787)..(787): n is a, c, g, or t
  misc_feature (794)..(794): n is a, c, g, or t
  misc_feature (812)..(812): n is a, c, g, or t
  misc_feature (820)..(820): n is a, c, g, or t
  misc_feature (887)..(887): n is a, c, g, or t
  misc_feature (1025)..(1025): n is a, c, g, or t
tggcgcgtttgcggcggagtcgcgcgtgaggggtagnagtggcctgggaggggccgcngtcatggcagccgtgcgcagcgatnagttcaccatggggaaagcatgtgttcnnagccattctgatggtcctagtggcccttatcctcctcgcacgtgcagcgattggcccagtcccgtcgaggctttgcnccaccaggccaacagaagagagaggccccngttgatgtcttgaccgcgagataggtcgatctgtgcgaggganactggatgcntggattgggccagagaccatgcacctggtgtgcagagtcttcgtgcgcgcgagtgttgtggggnatctcatcagnnatttgcngtggccttctttgctctgtctgggatcgcngcgcggctgctgaatgccttgggactagctggtgattacctcgcccagggcctgnngctcagccctggccaggtccagaccttcctgctgtgtgggagcaggggcncgtggtcgtctnntggntagctgtntctgctcctcggcttggtgcttggccttgctggggcggatcctgtggggcctgaagcttgtcatcttcctggccggcttcgtggcactgatgaggtcggtgcgcgcgacncttccacccgggccctgctactcctggccttgctgatcctctacgccctgctgagccggctcantggctcccgagcctctggggccaactcgaggccaaggtgcgagggntggaacgccaggtgggaggagtagcgtaggcgcnagaggggagcggacaanggggccngcagtgtggaggaggagngagccggntgccccacacaccgccagtgtcataccaaagagctgagctgcttcggggccatgcagccctcctgcnagccccctgcccttttcttgccctgtctctgaaccttcagaacattgatcttgccgcagcccactagccaagagaacagagaagacattcccctgccctccttgcggcctgtcttctgaggtctctgtctgggttggnctttaaccttctctgctccagctgct

SEQ ID NO: 704507 - DNA, 608 bp, Homo sapiens
tggaacttgcctccgcggtttcaagcgattcttgtgcctcagcctcccgagtagctagaattatcggcgcccaccaccatgcccggctagtttttgtatttaatgtagagacgggggtttcagcatggtgggcaggctggtctcaaactcctgagctcaggtgatccatccgcctcggcctgccaaagtgctgggcttacaggcatgagccagcatgcctgagctctctttaaacgactttttgcttacacactgctttaggaatgaaaagcaacaaggagcattcagtcatatcctccgggcatttgcactgctcaaggcagctgcgtacaccatttctgcacatcttcccatgtttcatcaatcaagcagcactaattctcactcacttgtagggttacaggttgcagtacgatcagcatggaagactttgtccagcacctagtaggctgtcagcgcctgttacctttcctttccccaatgctccctaaagctaagttcattggcccatcatgtagagtactgggtccacaggcggtgaattacttgtgatgctcttccaaggactgcatgaggagcgacctttcactcaaagcaccagcaaagta

SEQ ID NO: 704508 - DNA, 1199 bp, Homo sapiens
gaggctacctatgtctagaacctgttgccagcctgatgtcgcgatgctgtgacaggcattgtgctcttcgctcgtgtccgtcatgagtcatatatgctgggatccgagcaacaatcgatggactgagttggcctgggttgtaaccactgttttgtaatgaacattcaatataacgagcaggatgagggtgcttatacgactggtggattgaagcgtgtgtcggtgattgttcgaagacactgtgcgatactaccataaactatcgtgaggatagagtaagagaagcgtaattatacaatggttgtgtcggcagtaaataacaccgtaaggtactcatcggctatgtatgcgtcgatttgtctcctggtagaacacggcgtcaaatccgtggcattcgaaattgtgccatcctacgtaataatcgtataacgcccacaagtgacccatgtggcatgctattagggtagtgtcgaggacctttgcagcgtctgaattgactcgtggaacacctggcgtgacttcttacctccacgagggctagggctcccgtaggagaatgcaaaaaaaaaccccacacgtttggtagtagccgatagcggtcgtaaggcatacgcattcgtggtggtacagcgttcatgagcgcaaagacggacgggtatagggtcttgccctggtggaggaaaccgccaaagcagtgcatccgtttgcaacgtttatgctagccgatggggcacccgttgcggagtgaccgtaatcgtgttaccgcaatgtacccagcacggaagcgaccatgtccttgtatttgcctgcggtgttgaaggaattggccttgggaaccgtcttcgtaaatcaactgtggtgaaaacgttgggcactcagggaatgggctcgtcgcggccatattgaaacctttgtgaggccctgggtaatgtttacaccgtatttctttactccacaaaattcctatcggaattaggcgggaaaatatcaaactccgagggcgctgtgaataagtcgcgattgtgacccccataattaattaccgctcgaatcagccgatgtgggaggaggtgtggacctcaaggtccaagttggtttactcccagtattatcaccgagtgcgataatcccttttctagcagcatacttcctggatggtgtaacgccctaatgtccaatacaaagttggaggccaccgt

SEQ ID NO: 704509 - DNA, 158 bp, Homo sapiens
cacatgcccagcacacgatggggagaatgccgcacggtgatgtgtggtttacatggaatgacttctctggaacatggctcccagtcttggaggaggcagaatgggtgactaactggggggctggcttcaccaacttcttcacagactcataattgcac

SEQ ID NO: 704510 - DNA, 109 bp, Homo sapiens
ataactatagtgcttgactgaccctgcccctgctactacgtttgcccatttggagtgctaccactgtaccgtcgcgtgccattgctgagctgggcatctatccagctgt

SEQ ID NO: 704511 - DNA, 680 bp, Homo sapiens
ccttatccctgacaaggtctaatatccagagcctcaggaacttaacaaatatacaaagaaaaaataaacaaccccattaaaaagtgggcaaaagacatgaacagatacttctcaaaagaagatattcatgcgaccaacaaacatatgaaaaaagctcaacgtcgctgatcattagagaaatgcaaatcaaaaccacaatgagataccatctcataccagtcagaatggcaattactaaaaagtcaagaaacaacagatgctggcaaggttgcagagaaaaaggaacacttttacactgttggtgggaatgcaaattagttcaccattgtggaagacactgtggtgattcctcaaagatccagaagcagaaataccatttgacccagcaatctcattactgggtatacacccaaaggaatataaaccattctattataaagataaatgcacatgtatgttcactgcagcactattcacaatagcagagacatggaatcaacccaaatgcccatcaatgaaagactgcataaagaaaatgtggtatatatataccatggaatactatgcacccatgaaaaggaacgagatcatgtcctttgcagggacatgaatagagtgggaagctgttatcctcagcaaattcacggcaagaatggcaaaccaaacagtgcatgttctca

SEQ ID NO: 704512 - DNA, 400 bp, Homo sapiens
atacccatctgtcgatttcaccaaaagggcctacagaccatcgtaaacaagctctgctcatgcagtcttcttagaccaacacactctccatataacacccctatcctccctgttaaacagtctgatggctcataccgactcgttcacaacctccgagccatcagtcaagctgtcctccctattcatcccatagtccataacccctatccacttctctctctcgtcgctaccaacaccaccctccacactgcaattgacctgaaggatgccttcttaaccatttccctacaccctgattcccaaaacctatttgctttcacctggactgaccctgacaccctccagtcacaacaactcacatggactgtcctctccatcccatccatccatccttcctcat

SEQ ID NO: 704513 - DNA, 315 bp, Homo sapiens
  misc_feature (166)..(166): n is a, c, g, or t
  misc_feature (203)..(203): n is a, c, g, or t
  misc_feature (232)..(232): n is a, c, g, or t
  misc_feature (262)..(262): n is a, c, g, or t
  misc_feature (285)..(285): n is a, c, g, or t
  misc_feature (298)..(298): n is a, c, g, or t
  misc_feature (311)..(311): n is a, c, g, or t
ttatgtagtattctgtattttaaactattagctgaaactgtgaagataaagatacagaggggagaaacatttacagcatatatcaaaacccttaatatatgtagtatttaaagatcttctaagtgtgaaaaggaaactcaaaaatgggaaaatggaccagaaaatncaagtggttcagaacaattatagtttggaaagaaatncatgaaaaaaatacatcaatatgtaatcnagaaatacaatttatggtgaatgacaaaanttgtttttggtctgaatcacccnggttgttatgggnttggacataggantttg

SEQ ID NO: 704514 - DNA, 397 bp, Homo sapiens
attagaggcataagccaccatgcctggcccaggatggtgagggggatggttgctaggtgattcaagtgcattacatttattgtgcactttatttctatcattacattgtaatctacaatgaaataattttatacaactcaccataatgtagaatcagtgggagcccagagcttgttttcctgagactagacggtcccatctgggagtgatgggagacagtgacagatcatcaggcattagttagagtttcataaggagcatacatcctatatccctccaatgcagttcacaacagggttcaagctcctatgagaagctaatgccaccgctgatctgataggaggcggagctcaggcagtaatgctagcaatggtgtgcggctgttatactgatgaag

SEQ ID NO: 704515 - DNA, 166 bp, Homo sapiens
cacacaaggcatgtcgcaaagctggccaccctcaaagctgcatatcaaggcctgaataggtgatgaaaattaagaagttgtgaatatgttggattggaaagaaaggtatctcaagtaagacctgctcaatggggctgtcacctctgccacataaactttacaagaa

SEQ ID NO: 704516 - DNA, 146 bp, Homo sapiens
atgcgttgtcagtgaaatcggtttccagatggttagtctcttcatgccccgtccatttttcggttttctccagtgtacagaattcagatgattacttctggaatgttcgttattccattcaatgttactactctgtgacttaaata

SEQ ID NO: 704517 - DNA, 240 bp, Homo sapiens
ttgctgtcggctgttatcggcgagggatggggagagagatgccggtcctgtctggccgctcgtgctgctagcccgaggtctccaatgcctggtgctgcgtgctccatcctcggctcctgggcacctgtctgcgatggctccgccgaccagagtgagaaagccgctgggcggctgaccgcctggcatcatgtcagccaaggacgagctgggccagggagatcctgaggggcttcaaactaa

SEQ ID NO: 704518 - DNA, 176 bp, Homo sapiens
ggctgctgctgtatcgatctaaggatccccacggcatgtagagaggacaagatgggcaggtcagattgctcgagtccaggagtacgagaccagcctggtgtgaacatggccaaagaccccgtctctacaaaatacacaaaaattagtaggggcaggggtggcatgcctaatagtcc

SEQ ID NO: 704519 - DNA, 115 bp, Homo sapiens
actgtgacggaagatgacgtgactgtctagaagactataggagaatgatgctgtactgctggggaagtagagcatcattctcctatatcttctagacatcactcatcttcatcgg

SEQ ID NO: 704520 - DNA, 219 bp, Homo sapiens
ccgtacctagcaaaaccacaggtcctaaactagccaaactcgcattaacatttgcggtggggtgcgacctcggagcagagcccaacctccgagccgtacatgctaatgacttcacctagtcacagcgaactactatactcaattgatccaataacttgatcaacggaacatgttaccctagggataacagcgcaatgagagatttgggtaccgagctcg

SEQ ID NO: 704521 - DNA, 192 bp, Homo sapiens
gctttacctatcacagcactttcacagagtctgccatccggcagactgccaatttacagctgctttaagtcctcccacagttttaaattcagaaggttcaaacaacttcctttgtcggcaaggtttgtatgtacctccggacttccatcaggtgccaccttacaatttaagacaacggcagtgcccgccttc

SEQ ID NO: 704522 - DNA, 522 bp, Homo sapiens
  misc_feature (381)..(381): n is a, c, g, or t
ccgtaagttatatgcaaatacaacaccatgtatatcagggactttagcatccctggatttgggtgtctgtcagggggtcctgtagccatcccccatggacaccaagggacagctgtacctcaccagtagaaaaatataaaagggaggtagaagaggatacgctgcatgaagttgccacttctttgtcacttcttctgggctaacacagaagatgtaaaaagaaacagggggtcctatgtgttcatcccaatatgagcatttcctgggtgaaatttctctaaatttaagtcgcctctcaacctgaccaacagaaagtgtgtttgtctagggagggaggaggatggctggtcatgagcactataaaatctatgggagaactgnaaatcaacaaatctggaaccatctggctttccataccaatttatatccatgttttctttttttttttttttgggaaaaggtttcttttggtccccagggtgggagcgcggggaaagacgtggtcccacggaacctcaacct

SEQ ID NO: 704523 - DNA, 103 bp, Homo sapiens
tgttactgtactgtactctctgactcttcactcaaccaatgcaatttgttacatcatcttctcacatgtatgcatttgtgccactgatcttaaacctatgatt

SEQ ID NO: 704524 - DNA, 275 bp, Homo sapiens
tcgtgatccacctgcctcagcctcccaaaatgctgggattacaggcttgagccactgctcccggctgatttttgtattagtagagacgacagggtttcaccatgttggccagggctggtctcgaactcctgaccacaggtaatcagcccgcctcggcctcccaaagtgctgggattacaggcgtgagcacttagtattttgtaaccataagagaaagtatattttaacagcattacattttcatgccaatttgacaagttttggccaatttttaa

SEQ ID NO: 704525 - DNA, 220 bp, Homo sapiens
actcagttcggctcatggataattatcttttattttctaataatatgaaagaatatagtactttcacatttacttgttaaggtgttgaataattcttcatagttggaatgaatatgatttcttcaattgtccaccctggacacccagctcctcttgacaggacctgaccctctgttgcccagcgtcatgacgtgggaacatctctgcgctcaccagcctt

SEQ ID NO: 704526 - DNA, 167 bp, Homo sapiens
accacacgcacgctcatcgtagccacaggacaaaggcagcagtgtttatgcaaatctagaaacaaaagaagctagaatccaaagctattaaaagtaacatcagcaattcaatacccagaagtgattacaggcccagtaccagcatgaaacagaaaacacccgaagtc

SEQ ID NO: 704527 - DNA, 198 bp, Homo sapiens
tactgcagcaacttccttaccttgcactacgcacagaacagaggtagatttaaactccttacactcacttctcagatcaatgaatgggccaagaaacacctctatggctctatggagggcatgcgtgagacccgtcattcgcgagtccttgaggaatgtacagaatatcgcgtgccaggtatccccatgtcctagggc

SEQ ID NO: 704528 - DNA, 110 bp, Homo sapiens
aaattaaaaaacaattaacaagtgtatatttaaattccctctctcttgctcacttcttcctttcacaggtaaacttaattcttggagggtcctgctgcagtccaaccagg

SEQ ID NO: 704529 - DNA, 265 bp, Homo sapiens
cagctctgcctttaactctgcccagaggctctgggcgggctactgtctttggtgcgacctctggggcattttgcaagttttcatggcagatgggtgggggagcagtgcaggcaggaggcactaagacaaagcacaaggggaaccggaaatgacctcgctaccttcctgtgccttccctgccgccccactccagctagctgtcactaaacccagtgcacttcactctagttgacgggtatctctcaggcctctggagtcgggggta

SEQ ID NO: 704530 - DNA, 184 bp, Homo sapiens
aagactgcaagaccaacgccttctcttcctccccatctttctccgcctctgcctactcaatgtgaagacaatgagaatgaagacttttatgttgacccacttccatttaatgaatagtaaatatattttctctttcttatgattttctaaataacattttctctagcttactttattgtaggaa

SEQ ID NO: 704531 - DNA, 893 bp, Homo sapiens
gctccgggatcttcaggacacccggcggccgccaatcgccgtcgcttggcttcttctggactcatctgctccatttgtccgcttcacactccgccgccatcatggtgaagctcgctgaaggcgaggtacataaatcaaggtgaaccccaaggatagaatggctcctccatccaagaggaagtgctagcaacgaacgataccgtggatacgatgcatggatacacttgctcaagagacgcatgagacgcacacgatcgcatacgcaagtgggcaccatagccaggtcagtggtacacgtacaggatacaccaggcggcgcaagacgctggattgcagctgtacctgctgcacgacagcgatgggctcagcattaatcccccttgattaaaacaaaatgggtattgacctggtctggcaccatcacacaccgacccgacaagacaagagaccagccttgatacaggttcccttgtgacacatagccacgcgcccactgcaacacctgacttgatcgcgtcgctttcatgcgaaactgtcaactacggacttactcccctatgcccgcaatatcacatggcttttaccccacccgaacctcttgcgcacatgaacacggcgcggacggccccccatcaaccaccaacgcgcctgaatcaaagccattctgcagctacagctataacacatcctccttgtcgcctcaaaagcaacacgacgcgttgcccatcgcgcccaattcccacctaatctccccaaatctgtgagacgacaacacacgcacaattggcgcccactcagccacactcgacgaccacagcacctccgggccctcaaccacaagctctcgactttggaactcagaacgtcgaatcgcgatgtgtcactctacacca

SEQ ID NO: 704532 - DNA, 313 bp, Homo sapiens
gaatccgctcggcatatcttctcgccgcccgtggaaatcacttcccagtcgtggagcacagcctgggacagcgcctgtaccggcctctactgcgagggcctgaaggtcgggttcatgaattcggtgaagatcaccataccgagcgtcatcgcttcgatcctcatcgcatcggtcaatggctatgccctggccaactggcgcttcaagggttcggaggtgtttttcagcatcctcctgttcggcgccttcattccctatcaggtgatgctgtatccgctcgtgatcatcacccgcaatctcggtccgtccgccc

SEQ ID NO: 704533 - DNA, 1426 bp, Homo sapiens
  misc_feature (405)..(405): n is a, c, g, or t
gatgaagatgcaccagtgcagcctgatccctggggataggctagaggccattagctgtcttagacgctctggttggagatagcccatatggttaggaatgctggctgtccagggctggtggtggcagagttggtgatctgtcgagcgaggtgcctcagtagtctgtgctttgtccatgaagggttatcgaaggcgcgtgtgtggatggtgggtagatcagcgagtcaaggaaatgccaagccgtaggcgagaatgcgtcgtcgcacttgatgcgttcatgccatgggtagggcacgtgtgtattggaatcgtgccctgggtgctaagggacgtaatgtgcggggaaacggattgaatgggacggagctccaatgactgttccctagcaagcctgggtgaatgcgntgtgagtatcagccaagtgctgctggtggttccagattgggcggggtggatggggcaaaggctcctacaatcgtgggggtgcgttgaacaagccgtttcacggttactgaggagtgagactggtcgacgtttggatatagacagcttgaccactcccgagtagaaaggcagcagcgtaggggactcagcgcaggacctcgacgggatgggcttactgacagaggatcccaagcataacacttagaaagacaatttggctcggggccatgggctatcgagcgtccaaattgtgaacgaagatgtgggaacacttcattggtgagtccaacacaggaataataggaagccatgttgggacaacattgaaccgttcctgtcccccgtggccatttcgggaagtccacatgggcagaaattgagctaaagaagtggcacaaagttcgaacggttaaccccagcgtgggccacaacgtaaggcaccaacacgagcaggggagcaaattatataggtatggtctcacaggaacagcggtaatttggaggagccctagaaccaacatggtatgagacttacccgttgaggccccattttggttcaacgacttacctccattggttacccattggttgagaagcgcccctagaactcttggggagattatgtaaagttctcccgttcgacatttgtttccaaccaacgaaattgacaccggaacttctgggggtaggggaaactacacgcgttctttaggtctggccctggcaacttcataagtccggaagcaacaaactgggaccccccggctgggagttatcctctccggagttcgagaaccaatttcaaatccatttttgtagtggagcttcgatagcggttactgccgacttcgcagcgaaagagacatggggtgcacaacaccccaatttcagacctcttcatgaagagagaaacatttcatcatgagaaatccatcgggtgagggagaaaacacgccctttcgtgggagcataactagactac

SEQ ID NO: 704534 - DNA, 470 bp, Homo sapiens
agaaggggagcgcgctgcgcgtcgcaggagtaacctacttggtctcctgctttcgcgacatggccttcaattttggggctccctcgggcacctccggtaccgctgcagccaccgcggcccccgcggttgggtttggaggatttgggacatcatctacaactgcaggttctgcgtccagcttttctgctccaactaacacaggcactactggactctttggtggcactcagaacaaagggtttgcatttggtactggtttgggtacaccaccggtacctagtactgatttaggtactgctttgggaactggactggcatttgctggatttactacacaccagcagcagcagcgatctacattaggtgctgtcttcagccagtctacgcaggctcctacccagcccaaccagctgttaaacaccgcgagtgctctttctgctccaacgcatgacgcagatgagagagcccct

SEQ ID NO: 704535 - DNA, 852 bp, Homo sapiens
ggctcaaagcgggcgccgtccgggagcggaggttgtctgtggacggagcgctgatcagtgttctagaacagtatcagatatatgtaatgatgcctgagaatacaacactaagccacgctcggacaaggcaacacggttcaacttcctggcgaagagtagtgtgtatccttattcgtatgcacaaatgagcaatacatacattggagtctgagagccaatgaacgcaacttgtcaacctgaagcgagaacatgtgaagcaaaggattattgcttcgagctatttagatgtcttcttattcaacaccgaaaatagagcttctgttgcaagcatagatcagagtgctaagagttaccttatccaggcttgattattaccgaatacggtagtggtatgctcaatccgaattaaagcatatccaaggccgtaggcttttgaggagaaccagtgaacgcgccttgcgaggtgatgcgtcgagcagacatcgagagagcggtcgtgagacatgctggaggctatgagaaaattcgccttgtgaatgaaggcttcctcactagagagaacacttgaatgttaattgtaacagcgtaattcgacatacgaaaggctcagatgctgataggtgagtctgagggatgatacctattgaaaatttgagtatacagtttagtagcgtgaggacagacatgtagacttgtgaagtccaggaatcccaagtgagaattacaaagctacttgttactgtggtcaacaggatagacactaagaagaaactttctgaagagaaaagcagacaggtgggtgaaaattaaggatgagacgcccatgggtttaaaacattatttgcaggcgaa

SEQ ID NO: 704536 - DNA, 107 bp, Homo sapiens
cccaaacccacttcaacttactaccagacaaccctagccaaaccatttaccccaataaagtataggcggtagaaattgagaccttgcgcaatagatatagtaccgca

SEQ ID NO: 704537 - DNA, 192 bp, Homo sapiens
ctgctgtcgatctagagatccccctagtttaagaatgttgcatggctgctacaataatatccatatagatatgtagctgctatagaatgtataggagagctaatggctttgaattttttaattgttttttatttttcttttagttgtaaattaaaaaaatttaaaaattttcaaaatttttcccaaattttt

SEQ ID NO: 704538 - DNA, 580 bp, Homo sapiens
  misc_feature (4)..(4): n is a, c, g, or t
tttnatttttttgctttattttattttctctttatttggacaactttttgtctttggggacaagggctttaaaaatgagacttctccacattttaggggctcaacaggcccccatggttagggtttcctttttccaaaagccccaccctccaagcctattgcaatattgaaaaaaaccactatttctctcctcttgagagtgggaacggcagggcccaaaattttccttatttttccaagaaggttttaaaacccgttggagaaaaaacctttattcattttgggggtttttttttccccttttaaaaaggacagcttaaaatccagaaatttggttaaacatcaataatggcaaaaaaaaaaaaacgggaacagttttccccgttttcggataaaccccagccacccgggggatttttaccttagagagtgttggccaagctgttggcacaagcaaaattatcagacttttgtggtttaaatgaagacaagtataaacacatttgcttttatggcggaattaatgctaaaaaaagggtttctggaaaaaaaagaaattttcatttttgtcgccatttaa

SEQ ID NO: 704539 - DNA, 570 bp, Homo sapiens
gaattccaggcctggcagcattcatcacaagctgaaggtagagcctttgggcctttttggtgccagctcagctgcagtagaaagagcactggctagattcctaagatttctgactgtagaacctggctccctgatggcatctctggacctgactggggctgcggggaacttgccaaactgaatggaaagacacaaacctggctggctctgccaacttctgattgcagaggcctaggaccttgtgtgaacaggcagtggttacccgaggccttgagcgataccaagtaccatgctggcttcaggtctgacccatcacacaagtccatgctggcttcaggtgtgacccatcacagtcccagtggtgcgggaccacagtagtgcttgtgtcacccctcatccagctccaggtggctaatcacagagggagaaagaaagagagaaagagagagagagagagagagacagagagagagacagagagagagagagagagagagagagagactctatttatttgggagaaagtaagggaagagaacaagagtccatgcctggtaatccaaagaattc

SEQ ID NO: 704540 - DNA, 326 bp, Homo sapiens
tcacagccccagggctgatcatattttatatcttcttcgaaagcacgctaatccccaccatgactgtcatcaaccgaagagggcgagccgccagaccgccttaacgccggctcatacttcctattctacatcctagtaggctcccttcccctgatcatcgcactaatttacactcacaacaccctaggctctctaaacattctactactcactctcagtgcgcaagatactatcaaactcctgagaccaacaaaccgaagtatgactagcatacgcaatagcttcgatagtaaggatacctctttacggactcctcttatcactcc

SEQ ID NO: 704541 - DNA, 1029 bp, Homo sapiens
gaccatcctctcgtagcctgatcgccgtcgtcatgggtctgggatgcatgctcccgagaaggcgtgctgtcccactcggtgtgtacctcctgatcgacgtcacacgtaccctcgactgttagctgcacagtatgacctcttgacggaccgctgcaggagcttcgagtctagcaagatctggacaagaacgggctcgttaccatccttgtgcgagcatgatcgcgcgtaggtaccctgagacgatacaccatcggtgattgctctaagatacagtggtttgtgcctatggcgtaggtgctcctttgttagagaatctctattacaagtcttcaagggacctccgctcgctgaagtcttcctggaatatgctcgaccaattttccgtgaacgaagaggctggtcgcatgttccgtaaaggacactccttgtagggagtccactatggatcaggagtgaatggactgctcatccctatcccggactgacttctagtagacgagccgtgcattcatcgttgggctcgagattagctgagcttagcgagtcgcgctcctcccaataggaatgtatgaatcagtctagcagccctcgtgccgctggtcgcactagattatgttctgtgtacctcctacgcaattagaatgatgtgtttagccaagccacaaaagtttaaattaaactggaattccatgatcgtcgtacggatgcgccacaaggccctgaatctgctcagccaggagaggccttgcacccagaggtctgagaccaggctctaagtcgatctgcagaaggatgtagaaggaaggctgtggtcgccacaaagaacagccggggaggacggggttcaaaacactctagacctttggggctcggggtggcaagcgggtgcctgtgatagacacgggcacggggggtgatggagcaagccccgggggagcaagcgaggagggacaacggggccacccaacaagagaagaacacccgggaaaaaaaaaggctcaaagcgcgaaacgagtgacacacaggcca

SEQ ID NO: 704542 - DNA, 290 bp, Homo sapiens
aagcttcgactgtggccttctcggcatgtggcggagtgctccgtgtgtggctactacttctaggatcgctacgctggtacttgctagcagccgctactcggccctagctgccgaagctctagcaggtcttgtcagtcagctccgagtcagctgttgcatatgctccagtccatcggtcatgcttgactctgctggctctctgcaagtctgtctctcgatcaggatcagtcggcgatcggtatcttgttcctgcccagccatcgatctcctggcaatacgcctcagccaag

SEQ ID NO: 704543 - DNA, 345 bp, Homo sapiens
  misc_feature (271)..(272): n is a, c, g, or t
tctagaggatcctcacactggttcgagtcaagacagcctggtaacatggtgaagccctgtttctactaaaaatacaaaaattagctaggcatggtggcatgtgctgtagtcccagctactcgggaggctgaggcaggagaatcgcttgaacccgggaggcggaagttgcagtgagccgagattgtgccactggaatccagcctaggtaacagagcaggaatcccatctcagtcaatcaatcaatcaatcaatctcagcggttgaactaccnncttgacatggttcaagctctgtatccagcacccaaatctcatgtcaaatttgtaattccccagtgttgtaggg

SEQ ID NO: 704544 - DNA, 156 bp, Homo sapiens
cgagtccaccactactggccatctgatcgatgaatgcggtgcatcgacgaaagaaccattggaaaatttgagaaggaggctactgagattggaaaggctccttcaagttacctggtctggataactgaagctgactgaactgtttccattgatttc

SEQ ID NO: 704545 - DNA, 124 bp, Homo sapiens
acacacacatatctcacatccctccccagactccagaacccctgacctgtccatcacccctccagaatctccactccgtccgcggcttggagctaaggaatccagttcatcaaagaaggtagac

SEQ ID NO: 704546 - DNA, 474 bp, Homo sapiens
gaattatttgtatgtcaatcattgaaatatttgattccatagcatatgaatttataggctatcttatacattagcatatatgtgcccaaccttttctttctttcccaaccattagaattgaacttaaaccataatgaggctctagaacttactttacaactttaaatagattcaagagtcactgtatttgcaagaaagctgagggtgtttaaaacttctccaacccttcaaaaagtttctccatggcgctggagaccccatccaactctcagtggctatattagggaatcatccggactgctcatcttattctaaaattaattcttattctgttgatatattctaataacttttatcttaatttggaatttaattgcttgtatatttatataaccctaagacatgaattcatgtattagtttatgaatacccaggatctcatggaaggtaagggaaattttagaaaaaaaaaaa

SEQ ID NO: 704547 - DNA, 404 bp, Homo sapiens
aaaaaattttttaaaatggggggcccccaaaaaattttttttttaaaaaaaaattaaaggtttttacccccccccccatttcccccctcccccccggaaaggaaaaaaaccccttggtctccgggaaccaaacccccccgcccctttggaggggggtttattttaacccggtctttaaaagggcccggggtttttaaaaaatggagggcaccctttttttttccaaaaaaattttgggggggggggaaaagggccaaagccctttcccaccccccttaaccgggggttttttaaaaccaggttttttaaaaaccccaggtttttaaaaaacaaggggttgggggttttttttggggtttttttttttttaaaccagggcccccggaaaaaggtttttaccaata

SEQ ID NO: 704548 - DNA, 699 bp, Homo sapiens
  misc_feature (699)..(699): n is a, c, g, or t
gcagacactgaccttaagggcctgggttccagggccatggggccttccaggaagttctgggttgggggaaactggaggatgaccggccggaagcagagcctggggaagctaatcggaactttgaacgcggccaaggtgccggccgacaccgagggggttggggctccccttactgcctatatcgacttggcccggcagaagctagatcccaagatggctggggttgcgcagaactgccacaaagggactaagggggctttaactggggagatcagccttggcatgaccaaggactgcgaagccacgtggttggtcctggggcactcagagagaaggcatgtctttgggaagtcagatgacctgatgggccagaaagtggtccatgctctggcaaagggactcgaagtaatcgcctgcattgggaagaagttggatgaaaggaaagctggcataactgagagggtggttttcgagcagacggtcatggaagataacgtgaaggactgaagcagggtcgtcttggcctatgagcctgtgtggcccattggtacctggcagactgaacaaccccaacaggctcaggaggtcacgagaagcttcgaggattgctgaagtccaccgttctgatgccgtggttagagcacccgaccaattatggaggctttgaactggggcacctggaaggttggccgccgcctn

SEQ ID NO: 704549 - DNA, 385 bp, Homo sapiens
  misc_feature (192)..(192): n is a, c, g, or t
  misc_feature (198)..(198): n is a, c, g, or t
  misc_feature (338)..(338): n is a, c, g, or t
  misc_feature (360)..(360): n is a, c, g, or t
  misc_feature (368)..(368): n is a, c, g, or t
gcagcgacgtgggccatggacaccgcagcccgcgccttctgattttggtgcagctcaaaatactttctggttaccgttgggttcccgacccatgggttccatggacgtgcattttaacccctgctcccccatcagccgccccgtccgattcctgccaagcagcacagggcccctgcggcagcgcctgggctnctggtnctgtgtgtccgtcctcctcgtggtcattgtttgcacggtggctctgacctgggcagccaacctctgggtccccacaacttcccagtcttttgccttctcctgttcgggacaccctaagggcagctgtgggcccccagacntagctggggatggggtgttgtngcttgttncccaccaacgttttgtt

SEQ ID NO: 704550 - DNA, 645 bp, Homo sapiens
  misc_feature (640)..(640): n is a, c, g, or t
ccggcgacgtcacgcggccgttacggcgctcaggcgtctcgacgcgcgcgatttaaaaccagctcaggagacgccaaggaaagatgggacctcccggcccagagacgcgaggacacccccacagcgcctcctctccttcagagcgagagttcccgatgcccctgcccaggaaggcgcctgtcaatatttctgggacctcagtcctcgaagactttccttagaatgactacgagaaggagcggttgcagcggaggcgctcgagggtctttgatctgtagttcagcactgactcacctggctcattggcctccagctccagcaggagtattgacatttcagctactattcccaagtttacaaacacgcagtttacggaacattactgcacctgtatgaaactgtccactggtacatcactaccaagaatgctttcggatagcacttgcatgacatgatgtcagagactcattaacagaaagacaccgagccaaccaactgtgtggctgcggctactatggatgccagctatcagatctatgctgcgcgcgtggatgcacgccatgccgatgaatacagagtcctagacgggcttgtcagagctgcacccgtatttgtaaggagtctggctcatgttgctgantgccc

SEQ ID NO: 704551 - DNA, 823 bp, Homo sapiens
tagacatattctctacaatagacagaaagacattggaacactatagcctattattcggacgcatgagctggagctccgtaggcacagctctaagcctccttattcgagccgagctgggccagctgaggcaaccttctaggtaacgtaccacgatctacaagcgttactcgtactagcgagcccagtgcgattggtgaataactcttcttgcagtagctaatacccatcagtaatcggaggctttggccaactgacgtagttcgccctaataatcggtgcccccggatatggcgatttccccgcatataactaacataagcgttcgtgactcgttaccatccactctcgtcctacgtcctgactcgcgatctgcgtatatgtggaggccggagcaggaacaggttgaacagtctaacctccgcttagcagggaactactcccagccctggagcctccgtagacctaagccatcttctccttacacctagcaggtgtctcctctagtcttgaggggccatcaattgtcagtcacaatcaattatcaagtattaaaaggcccctggccgataatgccgaatatccaaaggcccctcttcgtctgatccgtccataatcagcaggcagtccttacttctccgtatctctcccagatcctagctgctggctatcactatactacatagacagacggaatcgtcaacacaacgttcttcgaacccgaccggaggaggagaccccattctagtacaacagcatattctggatttctcggtcacctgaagttgatatgcttatcctacaaggcttcggaattaatctccat

SEQ ID NO: 704552 - DNA, 2077 bp, Homo sapiens
ggggcttattaacggtggtatctggtagagcccccataaagtaccaccgtggggaagacaatgggacccgaaaacgagagccccgtggggggggagatgtgggggagagtgtgtgtgttcagcgctagacaaaagagaccgcgatgcagcactttaaatagtcttctcgttgctagaacatgctataacatgctggcgctggtggattggatcgagcaggatttcaagagcacttggcgaaaggctcacgtttccctccgcgggttcctcgatttcgagctggggagacgaaaagaggttgccggggcttttctgggtggggataccagacctgaccccaaaaagccgcggggggggtccaaaaagaacgtggaggtgtatgatgatgacgtaggctctcaggctgcggacagccccgggaaacgcatggccccgaaagggacatttagagataaggacaaatttgaagggctgtttaagctcggggcgctggtggcaaaaaaagccttgaccccagcattttcttgttcccccaacagggggtcgcctctacacgcccattatggggatgaaatcctctacaaggttgaatccgggcccgtcaacatttgcgaggggggcaaaagaggcgtggggatccaccccccagataactacggcgatacccttgatgaaaatcttggccttccccaaaaaattgtgattaaggtgaagccccaaaccgaggaagccaacacttggttaaggcaggatctgaaaaatcataacagtgcaaaggaggccgggggctccgacgagattaaaacctttgtgacaggatgtaaaaaagatgggcatagtgggcgtaaaaatatgaccacacatgacagaaattcaaaaaagtggcaacgggtaaacttgtcccttatggcctccctccagctagattctaggggcggacgcgcggggccccggcgcggagcgcggcgcctgtgcctggtgtgtgaggactatgccagctgttcaaacacctgtgtctggtcctgtgaagcctacaaggtcttctttcgccgaagtcaaagtttcacagatccagcctgtttcacaaacgattgcaacatctctaagaataggtctaagtcttgcccagcttgcctcctccgttgcctgcaccctagcattaatgagatccgaaaagacaagcgagcagcgctgaaagtgcgagacaacgttggtgaagaggtggatatgaccggtcctagctggacctgcctgaagctacttttttcagatggggaaaaagtgatacccagattgggccatgaactcccagggatcaaggggggccggcaggcaaaacagcagtcccaccgaggaagccccatccccaaaaacaggaaaggttggccccccggacatgtcctgtcaaatgacggcggagctggtggcagggtatggaaaaaaaaatcctgtaaaccaattcgccgagaaggccccaagtggtgggatcggctgaatgaatctacacctttgttttgggggtctcgagccaacaagagtttagggaagggaggcaccagggggaggattttcatcaagcacccacacctctttaagtttgcagcagatcctcaggacaagcactggctggctgagcagcatcatatgcgggcaacaggaggaaagatggcgtaccttctcattgaggaagacatcgggcagcatcatggccaggggttcccagttatgcttctcaagattagccatattaggcacatggttgggggagtggctcattgcttgtacgacatgaaagaaaagaagtttgttctgccatcctggaaggttgagaagttggggaaatacgtggagacactacggacagaaaaagagcatcgtgctgctgaagcaagtccccagacctgactttcccggcccggctgaggccatcatggggatgcggtctagttggctcttagcagcatcaagctgtacatgagctagtttgtagtgactcactgcagagccccccagactggcttgtggttctgtttctaaagttattggaataagaagcaattaaacaagtttgtaattt

SEQ ID NO: 704553 - DNA, 248 bp, Homo sapiens
cccttgaaaggtgctgaccaggagtaccagcgagtttaattaagaagcctctgggattgcctgaaagggcccctttgttctgacctttgaaattgaaagggggcattgttaacattcatcgtgggcacatttggtcagggaccccttcacccttgcccctttggcactactgcagctgacatctccatggatggaaggcacagcaagcccttcctttggtttacacaggcgatttccgccgggttggc

SEQ ID NO: 704554 - DNA, 220 bp, Homo sapiens
ccgtaccaacaggatgagtaggtaaacaccagattaaaagacttaccaagcagtccatgattctagcatactcatctatactgctggatatgtgatgtgatttgattaaagagacaggccaggcacggtgactcacgcctgtaaatcccagcactttgggaggccgaggcaggtggatcacgaggtcaagagatcgagaccatcctgttggctggcgaca

SEQ ID NO: 704555 - DNA, 704 bp, Homo sapiens
  misc_feature (295)..(295): n is a, c, g, or t
atatcatgctatgatttaccgtctcagttctattgatagtctgagatatatcgcatcagatgctcaatgaattcttccctaggtatgtcctgagaagcgtaagtgagatgacgtatcgacttgtctgcagtgtagtaggcgtaacgtcgtccgaatgagaacaccattcacaccatgcacatctcctgtcgggagtccaattatatgtcgcctaatggccattacatagtcttttcgaccgtgctgcagagatcctagtgctgggatggagccttagcgcggtaacataagttcntcgaatcatcgccaacagggtcatgggcataatacttaccgttacgagtagagccttgataaccattacgtcacgagatagcataggacccatcacatcgtccctatacgatttatgtttgcttaagccaatggaccgactgacttgtgtgcccaaccacaacaagcaagcagataggtctctggagaaattcaagggcatgcgagacccaagcgcgcaatctatggccctgaaaggtgtcactttcaacggcccttctatttcgcgcatgcttaacgatgactcctctgttgcaaaaggcccgacataggttctaaacgaacagcgcaagccacttgaatcgataaccgtctgggataaccggcgccttataccgcgtttattatcgcacgtgactcaagaaggaccg

SEQ ID NO: 704556 - DNA, 315 bp, Homo sapiens
  misc_feature (41)..(41): n is a, c, g, or t
  misc_feature (60)..(60): n is a, c, g, or t
  misc_feature (158)..(158): n is a, c, g, or t
  misc_feature (271)..(271): n is a, c, g, or t
  misc_feature (304)..(304): n is a, c, g, or t
tgcctgtggcagtcaatggctccagggctggcaaacctccncctagccagtcagcacggncctgttccttatcaggaaccacaaaggtactacatcttccccagccatcagcacgttgccacaacttaactttttaacatagtccgtctgtttactgnggcactggcgagtcccagggctgatacagaaccttccctagagggaataccagagttagctgggtatagaggtggctcaaaggaagtgtccgtgggcagggggtaggaatgancaaaatggcgctggtttctttgggcttcagacnccttagaatgg

SEQ ID NO: 704557 - DNA, 812 bp, Homo sapiens
aaggctaggtataggacccgtgttaataggccgaggcgcaggcccagtgtgttccgggctcctgacccgcacgacgcggcgggacttgggagccccgaaccctccaggtgacgctgacctcgtgaggagcgctgttcgcgccactcggcctggtggactgtgatgctgctggaaacggggctcgagcgcgacgagcgagtgccctggggacctgcctgcctgtctgcaccttgtgtgctgtgtgactcgtggagatccctgctgtgcgctgtgctgtgaccagcctacatcctgtgacctgctatcatcctcaatgtgctctgtgacctgccactggcacagcaatgtgtctcaatgtgcagctgacttgccatcacgccactggccgagctgctgcttcagccgaggggagagcgtttacttgcaaggacgactatatatatcaaagtggtgctgcctgcgcccaggacttacgtgtaccacctgcacttgctttgcctgcggatcgtgtgcaagctggcaagctggccacgggacgaaagaagttctacctcatggaggacagcctggcctcgttgtgcaatggctggactacgaaacctgccaagcagatgacgaggccgagtcctactggccaagcgagcgtgcacgaccatcaccgccaagcaactggagacgctgaagagcgctaacaacacctcgccaagccgggcgcacgtgcgcaacagctctcgtccgagacggctgaatcgcgtgtgcagttggtaccagacgcgggccagcgaaggctgaacgaccgcgaagatgggaga

SEQ ID NO: 704558 - DNA, 745 bp, Homo sapiens
  misc_feature (319)..(319): n is a, c, g, or t
  misc_feature (365)..(365): n is a, c, g, or t
  misc_feature (575)..(575): n is a, c, g, or t
  misc_feature (620)..(620): n is a, c, g, or t
gggagctgaagtgtagaggactcctttaggacagcagaaagggaatagccgttgagcaagttcccttcgaaactccagctgcctcctctccaagttcaagactccacgtcccttctccaaaagttaaaacggaaatgccagagtttgcacctagcggcgtccgcgctgttctctacgtcaataagatactgtcgttctagctccgcacgactcggtgaagaacagaaatacacaaaacgtaagcttccgttcccagagtacttagaggacttaggaagatagctcgtcatgggtccgcctgacaagtgtctggaaattntgtacgtcctcacggggatactcatagaactagttgaagtggaggncatgcttactccttgtgatttgcacttcttgtacaagatagtaccgcaaacgaaaccttcaattccgtatcgctggtgctgacgggccgtggttcgtaatccagggcaatttggtcgtaaggtgttcatactggaacattgcgttgcaggtagtcctattcgctcggtgttggcagaactatctccgtaagaacagacgtagcgtcaagncatcatctaggcggacaattgacgagggcatggtttgattgcctnggggcatggagtagctgtggataagtatggagccgtattgtgctcatagctaagaaacatactcgcatacgcatatccagaacgccaggtggaaccttcaacctggggaaagatgggctacttgc

SEQ ID NO: 704559 - DNA, 484 bp, Homo sapiens
ctgtaagggtggacacagtatgcaggagggacaaatcttcctcaccggacaggtggggatccctgcggtgcactaggggaatgcacacagggggcactatgacctggcggcccacggggcacggggacgcaccaggtagccttgggatctgcaagtccctcccggaccctggggagtgccatgacggcttccagcagcagtcactgtcctgggcgcgtcccgcgctctagcccaggtgggtcccacaacggtgtgaccaaggacgtcctatgaccaccccttgtcaggtaaggaaactgaggcaggagaggcgaagcaactcgcccaaggaatgggctgtgccggtagcttctccaaggcctggtgcgccctggcctgtgcgcgtgatcccgggcggggtctcagtgcgaacaggggcttcgcgatgtggccagcgcgggcttatctccgtgccgtgacgacaaggtcgaggcctgggcggccg

SEQ ID NO: 704560 - DNA, 1274 bp, Homo sapiens
tgggagatgagctgactgagacctggagcctacagacgatggaagaattctcctgcttgtggtaggaatgtggcttctgtcctctggacaattctgctgacctcatccgccatgtctacttccactgtctaccacaccaagctgtaagacaggtagagcggagtcttgcagggccattattcaacagccacggctcgagcctatgtggccactccctgactagtccatgcgactatccaaacagcctgtgaacgtacacttacctcgttagattatccgctagaactcaatctatcctgtgttctgtaggagcactgtgagacttccttcgtacaattcctgtagtggtttgtatctagcatagatgcgagagcagcacctaagctctgctgcatgatgacctactaaatcgcaagtccgagcaatagagacaatccaccggatgagattgcgttgtggttggccttgtggatacatggcataggttaccttagacacccctatcaaaaagtggagccgactacgtaaagatctcttcagcatgagccagctcgtgccggcaagcctcgattaactcgcgacgggaatgcatatacgcttgcgctcaacgttcctagaatccccgagccctttgactcacgtagtgggcctactcgtgttggcgccatactaggagtacccacagtgtctcctatggaaatcaacgagttccgttacggccccataagcgcctctattttagagcaatcccaatttgcgagcgtgcaacaacctttgggtggcgctttccatggaaggaacaggggttctacaaaatgttgcccgtctctgtgaacccctttccgcacagagaagttccgaccaagcgacgcctttaacacggggctaacgggctaccctttctcccccatagtatggggtcgccattccacgccatatggtcacccaccaacgtggaaggggacttttgagccccgatcgcggacgaaaggcccgcggcttcgatacccagcccgtggggtaacgccgtagccttctaggccgggtcctcactgctctactttgtgtgcgaccataaccagtgttggcattcaccatggttttgcgccctcttccctaggtcggttgcgtacccctctggaaccccgtatggcccacctgggctgtagggcgctatacaccggtgtcctgctctaccccgggctatagggccacagcgatttgggcccggcttctcggcggtacacctccctagtactgttgtagtcccgccg

SEQ ID NO: 704561 - DNA, 859 bp, Homo sapiens
  misc_feature (601)..(601): n is a, c, g, or t
ctgatcgcagtccggaggttgaggcggaactctgagtcaggtggtccattatggctgacaattgacagagatctggtagaaagattggagaggggagagggccgcctggaggcgagtatctcatagctttgacatgcatcgcgggtatgcagatgagtccttcaaatagcaggaggcggtctcctatgatgtgtcaaggcgattatgatgtgcgcatggcttgtatggctcacatgtgagtcatgagctacatgggaagatcaagtaaaggtagattagggggtaagacgtgcaagataatatgcgtgaagatggttccagaggagtgtttgaaggttaggtatgctgatgcatctgctgggattactaggattcattcagtgtactagaggaagcggcagctagaagaaatagaagcgtattcctgatcttggtgtgggcacctctagtctctagtagccacgactcattaggaagctgattaactcattgtcggagaggatcgaaacacgaagagacaaagctaagggttgtggtacattcaacgcgtgatcagtaatggtcatgcgaaaagttattcgcaagggccccgtggcgtcgnagttgagcttaattggcatcctggaagccattggccctcgttactgttgaaccagacaaatgagagtgatttgcgcagcacgatggtgttttgatagcaaagagcctgatgttcctttctaaaaaggagataccacaatgagtggtaggcactacaatgggaacgcaatagtagggagatgggagtcaataatgcgtttagttataatggtatttattggacgtagagtcgtgccaggtgtataatattaaggaggga

SEQ ID NO: 704562 - DNA, 166 bp, Homo sapiens
  misc_feature (166)..(166): n is a, c, g, or t
cccagctgacacagaggtggtggaagactccttgaggcagcgtaaaagtcagcatgctgacaagggactttagatttaatgatgcgttttcaaggatacacacccaaacaatatgtcagcttcctttggcgtcaggtttttcccaatccttaaatttttcctgatn

SEQ ID NO: 704563 - DNA, 112 bp, Homo sapiens
ggatcctccccccttacctctcccggtcaagcagctatcatttccaggtggaagctgaccgcacagtgcacctcaacccttgtccatactgtcttgtcgtcacttccatgtg

SEQ ID NO: 704564 - DNA, 362 bp, Homo sapiens
cccttccaaattttagaaataattaacgtttgtcacgttaataaatatcaagtgtcacggaagggtctggaaggtggaatccaaggacgacgtttttcgtggtccattcgtgttggattctgtatatatttatttataagttatgtattacaaccaggacactccaaaaaacaccaacacataagtttcctgtatatatttatttataaagttatgtaattacaccagggacactccaaaacccaccctagtttccgttagacgatgacgagggttttacataaaacataaatacgatgtagaatcaccttcagacatcacattcgtgagcaaatgtgaaagagcccattacaaaaataaat

SEQ ID NO: 704565 - DNA, 898 bp, Homo sapiens
gagttctcgggtgccgccctgtcgagccggggcgagcgcccacggggggacgccgcgcacccggggtcggggctaagttctgtcccccgggtgtggggcgtggtcccccggacgccgcaggtggtgggcggaccgtagtggccgtgagttttttgggggtaaccgcccgtgagtgggtacccgcggaggagtgtctgttgccaggggcgtattcttcgcccccagttgacgataccgagtgcgcctctgtgtagcttgttgcggcatgggcggcgtggtgacggggacatagcccccgcagcttggtgctctttccccgactcttgggggaaaagtggtgctgagctctcatgcgctccctccgcccttgtgccgctcatgtcgagagagcccgagggcccccctggtggtgaaagccgggcggcccctcttcgcggcccgcaggccgaggtagtgtgggccccgtccccaggctgtgtcctctggtatgccgggctgcctagcaattggggtgtgtgtgtgtgctgtgtgtgcgtgtgtgtgtgtgcggtgtttaatttttataaaagtttttacttgagataccagtccataccctcgagctctcaccctttctacaagggtaccattcagtggtgtgaggaatattcagtaagagttatacgtggtgtctattcataagacttatatcccgcatattcatatactagagccctatcacagagcattcatcataatattccagacattttcatcaccctaaaaggaaaccctgaacccattagcagtcattccccattcctcccaccccttatctccctagatccctaggaaccacccatcctgctgtgtaattcatctattgcccacatttcatataaatggcatcataccacta

SEQ ID NO: 704566 - DNA, 458 bp, Homo sapiens
  misc_feature (385)..(385): n is a, c, g, or t
acacgcgatgacggactagggcggctgtagagatccggctgatgccacttgggcgtcagccgtggtccgatgcgactggtccgtgagctgccgagcacctcctagattgagcgggcatcgcttgcttcgaggtatcaatcgaatttctgatgcacgcgggtttcaagccggcctgtcagccacagtcaggggcccattgatggtccaccgtgatgtcgaaaggggtggatggttttatagggacgacgatcgtatcgggagctatcgctgaaagttggtgacggcgggaatcgggaaggcggcatatcgtgggggtgtttgacgcctccacttctccaccgaaggagcgatatgccgtgtccaaagataacatcatcaagctgantcagccaggaaacgtcgacgatcaactcaccgaaatcttgcgcaatggagcgcgtgctctgttggcccaggcg

SEQ ID NO: 704567 - DNA, 2481 bp, Homo sapiens
tccataaaggggttgcgggggccgcgctctcttctgggagggcagcggccaccggcgaggaacacggcgcgatgcaggttcagtgccagcagagcccagtgctggcaggcagcgccactttggtcgcccttggggcactggccttgtacgtcgcgaagccctccggctacgggaagcacacggagagcctgaagccggcggctacccgcctgccagcccgcgccgcctggttcctgcaggagctgccttccttcgcggtgcccgcggggatcctcgcccggcagcccctctccctcttcgggccacctgggacggtacttctgggcctcttctgcgtacattacttccacaggacatttgtgtactcactgctcaatcgagggaggccttatccagctatactcattctcagaggcactgccttctgcactggaaatggagtccttcaaggctactatctgatttactgtgctgaataccctgatgggtggtacacagacatacggtttagcttgggtgtcttcttatttattttgggaatgggaataaacattcatagtgactatatattgcgccagctcaggaagcctggagaaatcagctacaggattccacaaggtggcttgtttacgtatgtttctggagccaatttcctcggtgagatcattgaatggatcggctatgccctggccacttggtccctcccagcacttgcatttgcatttttctcactttgtttccttgggctgcgagcttttcaccaccataggttctacctcaagatgtttgaggactaccccaaatctcggaaagcccttattccattcatcttttaaaggaaccaaattaaaaaggagcagagctcccacaatgctgatgaaaactgtcaagctgctgaaactgtaattttcatgatataatagtcatatatatatatatatatatatatatatatatatatatgtatatatgtaatagtaggtctcctggcgttctgccagctggcctggggattctgagtggtgtctgcttagagtttactcctacccttccagggacccctatcctgatccccaactgaagcttcaaaaagccacttttccaaatggcgacagttgcttcttagctattgctctgagaaagtacaaacttctcctatgtctttcaccgggcaatccaagtacatgtggcttcatacccactccctgtcaatgcaggacaactctgtaatcaagaattttttgacttgaaggcagtacttatagaccttattaaaggtatgcattttatacatgtaacagagtagcagaaatttaaactctgaagccacaaagacccagagcaaacccactcccaaatgaaaaccccagtcatggcttcctttttcttggttaattaggaaagatgagaaattattaggtagaccttgaatacaggagccctctcctcatagtgctgaaaagatactgatgcattgacctcatttcaaatttgtgcagtgtcttagttgatgagtgcctctgttttccagaagatttcacaatccccggaaaactggtatggctattcttgaaggccaggttttaataaccacaaacaaaaaggcatgaacctgggtggcttatgagagagtagagaacaacatgaccctggatggctactaagaggatagagaacagttttacaatagacattgcaaactctcatgtttttggaaactggtggcaatatccaaataatgagtagtgtaaaacaaagagaattaatgatgaggttacatgctgcttgcctccaccagatgtccacaacaatatgaagtacagcagaagccccaagcaactttcctttcctggagcttcttccttgtagttctcaggacctgttcaagaaggtgtctcctaggggcagcctgaatgcctccctcaaaggacctgcaggcagagactgaaaattgcagacagaggggcacgtctgggcagaaaacctgttttgtttggctcagacatatagtttttttttttttacaaagtttcaaaaacttaaaaatcaggagattccttcataaaactctagcattctagtttcatttaaaaagttggaggatctgaacatacagagcccacatttccacaccagaactggaactacgtagctagtaagcatttgagtttgcaaactcttgtgaaggggtcaccccagcatgagtgctgagatatggactctctaaggaaggggccgaacgcttgtaattggaatacatggaaatatttgtcttctcaggcctatgtttgcggaatgcattgtcaatatttagcaaactgttttgacaaatgagcaccagtggtactaagcacagaaactcactatataagtcacataggaaacttgaaaggtctgaggatgatgtagattactgaaaaatacaaattgcaatcatataaataagtgtttttgttgttcattaaatacctttaaatcatg

SEQ ID NO: 704568 - DNA, 398 bp, Homo sapiens
ggtcgactcgctccatagccatttctccataactcccaacatggggcttaacgccaacactagtcgagttgccggggattttgaggtgctggaaatcgaaggcaaaacgcgctgcggctgcgcaggaaaaatcactgctggcggcgacggtgagtaaacgttggggatcaacctgcggtgcgaaaagaggccgtatttttcttcaaccagaagcgaaggataagactcgacccgctgcaagaaccacccggcaagcagacctttcttccatcacctggcgactctttcaaagcggccccattgcggggcacctctgttcaggacgcgggtttctcgccataccaacgtggcgtatacacccattcgccgcccccggcccgtgggaatacacgtcgacg

SEQ ID NO: 704569 - DNA, 218 bp, Homo sapiens
  misc_feature (33)..(33): n is a, c, g, or t
taaagggggaaaaaaaaaaggggacccctttgntttcccggggccccttccaaaaccttccccccccaaatttgggggttggggttccggggtggggggtttcccagggtaagggaaaccaaacggggcccccccccttaagagggaggggattttttttccccctggggggcccccccggcgccttttattttccctttttgggggggattttttta

SEQ ID NO: 704570 - DNA, 120 bp, Homo sapiens
atagattcctagttttcctaaacttcctcatagtcaacaatgatcaaaccaaactgacagcggtagcacgagtgcgggcagcagcagccccgtgggctcggagatagacaaatgcatgga

SEQ ID NO: 704571 - DNA, 334 bp, Homo sapiens
atctcctgtatcttcaaaataggaaactacgttccccagaacgacattatttatgcctccctaataaggatattctacttatgacagatgaaaaggaaccagcgagtatatgcgaatactctgactttcttagtctgtgaccaggaatgtagaaatatcatctagagtggaataggcacttacatgtactcatagtgctgaacctacttctcaatgcctcttgtaaaggtaagtgggtctagagatcagcatattaaacagtcacaaaatgtcactgattcctacagtgtatacagaggtcttcctggtgacatcgttaagttaacatggcaac

SEQ ID NO: 704572 - DNA, 1696 bp, Homo sapiens
  misc_feature (38)..(38): n is a, c, g, or t
  misc_feature (670)..(670): n is a, c, g, or t
tctccttctttgcgttgccttcgttggtgtttcgttgncgttctccactacgcaggggagggcgttggtcttttcacagcaccgtacactgttggttggtaggtagtgtgtgtcgatcccaccagccttgtgcttcgtgtggggccagctctgccgctacggagtctttatcaattcgtcccgcttgtctgctgtgctcctctgggggactgactccggtcggcagatgtggtgatctctcccgttgtgggcccccccctgtttgtttgttcggtacgtacttctcgcggcgttttgtttttttgtgtattgcttgtcgagccaaacaacatgtatggtgtgttaacacaagtttcgggcgtctttcgccccccgcgctccccccctcggtagtgtgccgccgggttcttgctcttttgatcccctcggtctgttcgagccacccaacggggcttcgtgggataagtttattatatagttggcgcacaaatattgatttctttccgcgggtatttcacgtcaggacagaatatattctgtattgcgcccccttcccccccgggggtgtttctacaaaagcgctctgtgtcgcaccaaggcggtgtgggaagttgctcgtgtgagaagactgtctctctcgagaccctctttccgctgcttgaagttgatngtataactgcgcccaccacctcctttcggggcccccttgtccccccacaataagtgttggcccttgggggggagctataacacacacggcggcgtgtatgtagacccacccaacccggttggaccccccaaacacctcttataacacgtcttgccgtctttgtttaatatcccctctatacaagactttctcccttccactgctcctccccacagatgtagagagacccttgtgtccaccacacatgatacactccccccccccatatttctccccccttagccagcttctgtctcccatcatttggaccccctctaatagcccccaacacatgtggcgtcgcccacatgtctcacacctgttctcccacaggtgttacgagaaacattttcactggcgcacataacaacatgtgtccacacacaaaagggttacacacacaaggtcacagccgttatacacataccccgtgtgtttctcttgtttatatacacgcccccacatatattcattttatcccccgctgtctaatgtgtctcctatcaagagaagacacaatttttctctcttctagaagaaattgtctcacaatattgtagactgagtagtctctgtgtatataacaaacaaatctcttgtggtgtgtgtatacacttgcctctccgcatctcttttttcatctgtggtcgagggacacaccctcacgcgagattgacccctctcttgtgtgtctaatgagatgttcgctcgttcgaccacacctcttttctctgaatatgggcctaagtaccacaattcttgggagacacacggggttatccgtgataacactcgaaaggttctgaccacgtaggcttcttagagctcgccctcaattcttaaggtagtcacatgctgtgcacattttttttttcacttggtgtacctgtgatttgaacttgtctcaaataatttggaagtttttctgaaaaatggagccagtcaatgcagcatcaacctattaaaatacattttaagccctcttta

SEQ ID NO: 704573 - DNA, 782 bp, Homo sapiens
gtcatagagcagttcgtgtggcgcgcgttcccaacgcactttccgtgcacatgatcatagcgtgtctctgtagtgcgatcctgtaacctgagtagtgcttgatgctcatgaataatgagaccgcctgggagagaatcgaagaggtttctgaagtagaagtccacgagtcgagtactgaggggtcagtcatctggagtctagtcaagcaaagagtccacagcggaggctcggcagtatcgaaagatagtcgccccgcgcttgaagaggggaagccctgcatcaagtgtaggcgccagcacaatccgggtggaataatgtcaatcactgggcggaactccacaaggtcacacactatacaattcacctctttctggaaaaccaggaagtgagtgctttctggtgacgcaggtgaacggtgattatctggatgactaggacagtgctctgtaatggaccctactgggtgacagagcatggtgagggtgccggtacaaacactcttccactggaggtactgcatgtctgtcacaggacgaacactatggtcgacctaatcaagttgggccaaaaagaggtgcaatggcaatggcccaacgcaaggtcagaacaactacttggaaaagcacatggaacggcatctatcatggaacgcccaagatgagttgtagaaaggcaagaagcccacaatgcagagactgatacaatcttagaaggctctgtgccactgttaaacgcacaatgttcacagaacatctgtatgcatggctcaccttgaggaatcc

SEQ ID NO: 704574 - DNA, 158 bp, Homo sapiens
gggactataacttccactttacaaatgcggcaacggacgctcagagggccccagatcacaggcaagaggcacacgatcagtagatggctaactcatctactatgtcaatgacgacacaccaagctgaacggacctagaacctttggggcctgacacga

SEQ ID NO: 704575 - DNA, 128 bp, Homo sapiens
tgtactgggagcctggatcttgcctccagtattagccaggtggacagacccccagataatcacgtctgactcagagttcccgctacagtggaaactggatccctggccctgaggccggacagcctgca

SEQ ID NO: 704576 - DNA, 186 bp, Homo sapiens
ctctcgtgctgctatcaaaacatacttctagtgcagagtctgagagaagttataaaaagtcaaaaaagcatagaggaacagtaagaagaggagacataaagtctgactctccagaatccgatgctgagcgagagaaggatagacaagaaaaagatcgggaaagtgaaaatgacagaactagacaaa

SEQ ID NO: 704577 - DNA, 784 bp, Homo sapiens
agtctagctttgtaccaggctgcagtgcagtagtgccatctcagctcactgcaacctctgcctcccgggttcaagcgattgtcctgcctcagcctcccgagtagctgggattacagccacatgccaccacacccagctaatgtttgtatttttagtagatacggggtttcatcatgttgcccaggatgctcttaatttcctgacctcgtgatccgcccatctcggcctcccaaaatgctgggattacaggcatgagccaccagaaccggacatgctttgcttaaaagctaaatattttaggcttgagtgccattaggctctgtaacaactacttaattctgcttttgtaattctataacacccattgataatacataaacacatgagcatgaatgagtctcagcaaaaatttatccacataaacaggctatccacccatgaagctatagctggctgacccctagattaaacaatccattgcattcaatcagaagtaataggatcttatatatgtaaaccatttcgatcccattttcctgagtttgatattcttttattgtcatcccgattttctgtttaccttattatactgatgactgaaacactcatatctaacgctgtttttggggatgagatactgttgtttaataatatacacgcgcccaatttcctgatcataaaacccattacacataatcgtatataagatagtattggatcgtagtcacgcaatattcaatgccttgttattatatacccgccccacatacgtaattctttttca

SEQ ID NO: 704578 - DNA, 242 bp, Homo sapiens
  misc_feature (20)..(20): n is a, c, g, or t
  misc_feature (158)..(158): n is a, c, g, or t
  misc_feature (172)..(172): n is a, c, g, or t
  misc_feature (197)..(197): n is a, c, g, or t
  misc_feature (206)..(206): n is a, c, g, or t
  misc_feature (236)..(236): n is a, c, g, or t
gcaagccggtgggcaagatncggcgcccagtgaaggtgtaccctaacggcgccgaggacgagtcggccgaggccttcccctggagttcaagagggagctgactggcagcgactccgggagggagatggcccgacggcctgctgatgacggcgcagggnccaggccgacctgnagcacaagctgtggtggcggccganaaaatgacnagggccctacaggatggagactttcgtggnagccgc

SEQ ID NO: 704579 - DNA, 223 bp, Homo sapiens
aagggagatgagccggtacctcataggtcgcaggcacactagatgataatatactcttttactaccccatgtttcctttctatctcaaacccatctcaagtcaacaattagttatagagcatctactaaagagcaggtgcagctgagaccattcagttttcactccctgaccccaggaccctggctccatccccctatctcgttttcccctgcgaacctatga

SEQ ID NO: 704580 - DNA, 1129 bp, Homo sapiens
tccaaactcgtttaagtatttaaacatctgagccaaagcagatagaagttattgtataattgttaatcactttgcaaatcaggggctatcaaattacctcatattggcattgctaggattcatacaactctatatctgtaatatcaaagtgtataagcagtataccatttagggctgtatatgatccagtcagtttgcattttgagcaacagctctatgagctcgtaaagtaactgcatggttattatagttatacatcgtacatataggagaaccttcacattaccacaaggaatatattccaaaaccattataacgtcgcaatatctaagtttgtgaaactactagggcatgactacacgtcaaggtgtaattaacaggaaatttacgaacatgtaaaatgtgcctctaaccagagtactcatggcaaatacctgggtactcaacgtaggcaagcatgcaaaaacacaaaactgaggttcacagctgttcagcccattcatcattcctcaagataaacttggccttacactatcagggaccgctccaccaactttcgtggaaagttttccaaaactatacgtgccattcggaaacaatggtagaacgtctaataaattgcgggtcagtgcaggcaacatcagcagcaactagacatattgaaaaaaacacgatagacacctattcaaaacatgcacgagaaatgcaccagggagatcaggcctaaaagacaaacgcccgacagaggcagacgcagacgagcaaccaagacaagcccacccggcagatgaaacccgggagaagtcccaccgacacacaagacaatagactcacggaaaaacaacagcacacaaatcaaaaaaaacgacaggcccaaaaataagtcaaaaaagcagcagcaaaacacaagaacgaggacagaacccaataacgaccacagacgagggaacgccaacgaggacgagaacacgacaaaaacaaaccaagggcaacaaccaccccagcacaaagaccccagaagagcaaaaaagacaaatagtaaagaaacacatcaaagagcgcccacaacgaatgatacaaacgccgacacacaaaacgcagacatcaagcgcaatcagaagacagccca

SEQ ID NO: 704581 - DNA, 459 bp, Homo sapiens
aaggcccaggagaacccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtcccccccccccccttttttttgagagggagttttgttctttttgcccaggctagcgtgcgatggcatgatctcagctcaccacaacctccgctccctggcttcaaacaattctactgcctcactctccagagtagttgggagtacaggcatggtggcagatgcctgtaatcccagctactcaggaggctgaggcaggagaattgcttgaacccgggaagcggaggttgcagtgagccgagattgcatcactgcatgccaggctgggcaacggagctagactccaaatgacaaaaa

SEQ ID NO: 704582 - DNA, 351 bp, Homo sapiens
  misc_feature (90)..(90): n is a, c, g, or t
  misc_feature (103)..(103): n is a, c, g, or t
  misc_feature (211)..(211): n is a, c, g, or t
  misc_feature (283)..(283): n is a, c, g, or t
tcggggcgggggcgtggtcaagcaccacattgccaatgccaacctcaaggccgggagtttgatggccctgacccaggggcccgaccagangaggctgtctctnggggcaagatccgggtggaggcacagcccgtcaaggtctatgctgacgcctccctggtcttacccccggcttgtggctgaaacctttgcccagaagatggatgccctnacgaataaaaagaacgaggactgaaaaaaagcggtcccaggaaggtcttacccccttttcaatttattaatnggcagacccagcccctccccgactttttgggcagcaacgtctctagaataacatggaatctgaagtca

SEQ ID NO: 704583 - DNA, 155 bp, Homo sapiens
gcgctctcagtcatgctctgcctatgggtcatttcttcgggaatcactgtgatcatgatatcttcattaccctgcggaccaccatgttcagtgtgctttcccttttaatgacgtcgctgacatcattggctggagaccacggactgtccattgat

SEQ ID NO: 704584 - DNA, 727 bp, Homo sapiens
ataggtatggcccccccttccccctcccagtactagttaatttgagtaatgtatgtcagaaaagtgatagacgtattttttattggttgtttcaacaaaaaaattttggtgtgtgtgtacattatattcatacgtatctatattttatgtgggtgtgtgaaaaaacgaaagggactagtattggtggcaaggcacatgggaaaacaagcaataaatgtggagaaaatgtgtgaacacgcggtgaccccgtgggtcacacaataggacagaagtcattgggggaacacacctaagggtagagtttaggaaggaaaaccgacctcacacactttttataggggggaggcaaaggcatggacgcaggggcagcggacaacacaggcagtggtaaaaagagatcacaacagaaacaaacgggggaacgaccaccataggaggagacgcaggaaagggaatgggcgaccaccacgcccaaacgaaccagaagatacagcttaagaacacacaaattacggcccacaacagcggggctcacaagacaaacggacagactaaaaacacacagagcccatcatattaacaacaagcacccacccacataggagcaaacgttatgccatagtccacacacacagctggagcaagacaacacaaatcaggtaccaacaccaaaaacgacggtggcggccacgcagcggccaccctcgtgacgagcaagcccactgtg

SEQ ID NO: 704585 - DNA, 456 bp, Homo sapiens
gcacgaggctgcggcggcgcacacaatgagctaattttttcttttttttcctttgtagagacagggtttgccgtgttgctcaggctgatctcaagcgcctaggctcaagcaatcctcctgcctcagtctcccaaagtgctgggattacaggcattatccaccacactagaacaagaaattagagtagggactctgccagggatcgtagctcatgcctgtaatcctagcactttgggaagccaaagcagaaggataacttcaggccgggagtttgagaccagtctgggcaacatagcaaaaccccatctctacaaaaaatttaaaaatcagctgggcatgatggtacatgcctattgtcctagctactcaggagactgaagtgggacgaccgcttgggcccaggaggttgaggctgcagtgagctgtgatcgcacaatttcactccagcctgggcaa

SEQ ID NO: 704586 - DNA, 456 bp, Homo sapiens
cctgcgctttgatagttcccgcctgctacatcccttgactttggcttcagctgtcgcgtgccggacattcgcctgagctcgtcatgtactagaacaaccctggcgacatggtgacaccctgtctccactaaaatacaaaaaattagccaggtgtggcggtgtgcgcctgtaagacccggctactcaggaggctgaggcgggagaattgcttgaacccgggaggcggaggttgcagttagctgagattgcgccactggacgacagagcgagactcagtctcaaaaaaactatagaactttaacaaaataaaacgaatccaaccccggcagggcgtggaggctcacacctgatatccagcacttagggaggccacggctggaggattgcttgagatcaggagttcaagaccagactgggccacatagttagaccttgtctctctcattaaaaatataa

SEQ ID NO: 704587 - DNA, 682 bp, Homo sapiens
  misc_feature (108)..(108): n is a, c, g, or t
  misc_feature (125)..(125): n is a, c, g, or t
  misc_feature (179)..(179): n is a, c, g, or t
  misc_feature (209)..(209): n is a, c, g, or t
  misc_feature (256)..(256): n is a, c, g, or t
  misc_feature (273)..(273): n is a, c, g, or t
  misc_feature (276)..(276): n is a, c, g, or t
  misc_feature (283)..(283): n is a, c, g, or t
  misc_feature (286)..(286): n is a, c, g, or t
  misc_feature (294)..(294): n is a, c, g, or t
  misc_feature (297)..(297): n is a, c, g, or t
  misc_feature (361)..(361): n is a, c, g, or t
  misc_feature (378)..(378): n is a, c, g, or t
  misc_feature (413)..(413): n is a, c, g, or t
  misc_feature (416)..(416): n is a, c, g, or t
  misc_feature (465)..(465): n is a, c, g, or t
  misc_feature (495)..(495): n is a, c, g, or t
  misc_feature (501)..(501): n is a, c, g, or t
  misc_feature (523)..(523): n is a, c, g, or t
  misc_feature (528)..(528): n is a, c, g, or t
  misc_feature (558)..(558): n is a, c, g, or t
  misc_feature (592)..(592): n is a, c, g, or t
  misc_feature (613)..(613): n is a, c, g, or t
  misc_feature (652)..(652): n is a, c, g, or t
tcacggtttcaatggacacttttattgtttacttaatggatcatcaattttgtctcactacctacaaatggaatttcatcttgtttccatgcggagtagtgaaaagtnacaaagctaatcataanaacctacatcaaaagagaactaagccaacactgcccactttctttttaacaggnaaaatataaatatatgccctctagaatgcncaatggtttagtcactaaaaaattcaaatggggtcttgaagaatgtntgccaatccagggggcngtnaagaggngcngggaggcngtnccactgtttaagggttcctggcactgcatctcttggccactagctgaatcttgacatggaaggntttagctaatgccaagnggggaggcagaaaatgctaagttgacttaggggcngtncacaggaactaaaaggcagggaagttctaaatattgctgagagcatccnccccaggaaggactttaccttccaggagcnccaaantggcaccacccccagtgctcanatggntgaatttatcctccgtgttccatttggcanagcaagtggcagtttctccaccacctatgatggngatgcagcccctagaagtggntttcaccacctcatccatgagagctttggttccccgggnaaaagcttcccatttaaatacccccacagg

SEQ ID NO: 704588 - DNA, 140 bp, Homo sapiens
tacgcctgtagtcccagccctttgggaggccaaggtggggggatctcttcaggttaggcattcaagccaaggttgggcaaaatagcaagacccaatatgcaccactccagtgtgggtgatagtacaagagcgtgtctcaa

SEQ ID NO: 704589 - DNA, 116 bp, Homo sapiens
tatattttattttattattttttagagatggagtcttgctgcgacacccaggctggcagtgcaatggcgcaatctcggctctccagtcctgggtgacacagtgagaccctgccacc

SEQ ID NO: 704590 - DNA, 296 bp, Homo sapiens
cctaagatcacactatctccactttctcatccctgttgaagattatcgtccgtgtattacaatgtgattggagctgtgacactctggaagctgagacgataaccatgctgacatcagcacagactatcctcgtaacattcccatgaatcccatgtgcatttaacggttcgcggataagaaggcacatgatcatgagggctcagatctgaagatccctgttgcctccaaccgtcgtttctgtctgggcacggccaatttccgatctgctaccagtctctatcaggctgggagattac

SEQ ID NO: 704591 - DNA, 128 bp, Homo sapiens
attgatagggtgatagctcggccatagggtgtgaggagtcagttatatgtttgggatttttaggtagtgggtgttgagcttgaacgctttcttaattggtggctgcttttaggcctatcaaaagacga

SEQ ID NO: 704592 - DNA, 400 bp, Homo sapiens
gaccagcccagagacacgagacactgtggcagactgcacggacctctgaccacgccaggctatgcatgacggaacagatatcctatgattctccttactggttaataaaccttaatcaagtcttcagcctgacaaggatcactatcagctccagtggcaaggagacaagtccttcatgaatgctctgccttcactccctgaggcagagctagagtggctgccatgcttctgagctcagccagcatccatagagagagtgtgatacaggctccatttattgcagcacccacttctaaactctatgacagtattcttggcactctgctatgcggatcctgagatgacaatgtcacatagactcccctgtaagccttatccccacatacatgctatcatggat

SEQ ID NO: 704593 - DNA, 127 bp, Homo sapiens
ctttgcaagcgaaaacccacctgattggctgttgtagcagtatcaatagtgattctgaacctatcccctcgacccggggtgctgccactgatactcaggctacgggcaagtttgccgctccagccca

SEQ ID NO: 704594 - DNA, 902 bp, Homo sapiens
gccaacaagggctccgccagggggctctccctaagccctgtgggaagcccaacctctggcacatagagaaactgttaatcacagacgttctctagacaccggagaacacggggttaggcaagccgcgtgtaagacgcggggggccccgaccccacaatttcggcagcaaacctcctccaggtgggaccacaaaagacggggcacgcacccgccccgtgggtacagtgtccggggacctcagactacgcgatcacatctctctgggaccacaaataggcagaactgcctcagtgaccggcgggcggcagttacatctacctccctggagtcccgctaatttttggagaaagcggccgcgagcaattgcccgcccgggtactatgccacacaacttcgcgggcatttctataggttcgcgagtgaagaagaacaccagggaggcctcgcacataaaacaatgggcgtccaccaacagcacacacgcctactggtgcccacaataggacatcgtttttatgtgggggcatacacagtatgtcgcgaaaaaaagcttcggtagttagcgcactgcccccgggttttgctgttgttacataaacaatctagggcgaactccgccaccctgctggttctcctccagcgccaggggagacgcaacttggctcgtccacaggggccctcgatagcgccactatccccagcattgcacgcctgttcccacgggatcttggcccccggaggagacacatttaccctccccctgggggcaacaacgacttgtaatgagcgcaccacaccgcaaatcatcgagagggggacagaaccagcgacctagttcttacctttgccgccgactcgatgaattttaaaccggaaaaaaaagttttccccccacaaaaaca

SEQ ID NO: 704595 - DNA, 123 bp, Homo sapiens
cctcgataataacagcgttctcatcccagatgacgttcctcaatcccaggtgacgttccatcatcccagtgacgttcctcatcccagtgacgttcctcatcccaggtaacggttccatcaccc

SEQ ID NO: 704596 - DNA, 220 bp, Homo sapiens
  misc_feature (13)..(13): n is a, c, g, or t
tataggcgctagngttatattgcaatacgtgccattttatatcaggaacttgagcatctgcagatatggtatcggagggcggtcctggaaccaagcatccacggatactgaggggtgtcatttcatgaagtgtagatcatggtattcagagatggtaaatgaaaaaaatatagaaactatttagtttgggtagattttttttctgacaatgtgaccaggt

SEQ ID NO: 704597 - DNA, 474 bp, Homo sapiens
ctagaggatcattactgggtgatgcatgtgggtggagaggtcctctgaaattacaccatcagaactcagaaagggacttctttggaagtagggtctttgtggatggaattaagggcaggtctactggagcagtggtggcctaaatcctatgactgattgtctcatgaaaaaaaggagaggccgggcgcggtggctcgtgcctgtaatcccagcactttgggaggctgagacggggggatcatgaggtcaggagatcgagaccatcctggctaacacggtgaaaccccgtctctactaaacaaaatacaaaaattagccgggcgtggtggcctgcgcctgtaatcccagctacccaggaggctgaggcaggagaatcgctggaacccgggaggtagaggctgcagtgagccgagatcgcgccactgcactccagcctgggcgacagagcgagagttcgtctgaacaccacacacc

SEQ ID NO: 704598 - DNA, 1199 bp, Homo sapiens
  misc_feature (1199)..(1199): n is a, c, g, or t
gccgctgtccctggcgtgtgccaacctgaagctgccccgcctgctcctgtgtcctgacatgctgcgcctgcgctctgctgtgcctggcctgtggcctgccctgtgtgctgctgcctgactgcccccgatggacggatggaccactgtcctggtgcttgagtgaaaatgcaacttctgctgtgagtgcgctgtgctgggccacaaatgccccttgtgttgtgtgccaccttgcagagggtctcttggccccgctgacgtattgccaaatgcctgctggtgaaggcttgaagggtgcagacatgtgttcctgaggatcatgtgtttggccaacgtgtggactgccatcggagggacgtcttgaccttggcccaagcaggtactgtgcagtgctgctggctagtccgcaccaatcagacgttcttcatgtgaactgcgatggacagcgtgtcttccgcccaaagggcaatatagcatgcttggcatgacgatggcttgagtgacattcggtgaacttggcttgaatgaatggcgcactgtggcccctgtgctgccaccaaccctgccctgaactggctgcagcctggcagaagtccttggttggatgtccacgcgcaggttggcatggtcatcgggacttcttcacaggaccgtggagctcggacctctgaccaaggcagatttcttgcagtgcagccaggaggcccatcggattgagcataccaatttgcggatcactttcccagacaggttgaccgtgttctccaaaataccaggctcgacaaagatgggggttggtcctctttcaagaagtttgatcgaagggcggaacaacttttgcaaggggcagggtcaccaatggagaacctgctggaggtttatcagaaaaaacctgttggcccctttgtcagttgccgtccaaccgagggagacaagtccctgaagcattccgcgcgctgacatccaggacttcccattccttggcaggcctcttgcccccacagatgtgttctcttgagctcattcaaccggccactttggaccacctctcacagagcagaggccgggaagttccagtgggcagcagcctgggccacttaactcagcggggcgccctctggagcacaccgggactccccagtttgcccggaacaagagatgtccggagggccaacacccgggagcgggcgacgacaaccagn

SEQ ID NO: 704599 - DNA, 162 bp, Homo sapiens
gaggatccctgccgttctgttctgctgtggctgtaggagggcaggtggagctgcaggtggttctcccaagcctgtcctctgcaggtggggaagtgctccttggtgctctgctctatatggacactgacctgggaagacgtgtgaggaccctgctgatgcttg

SEQ ID NO: 704600 - DNA, 382 bp, Homo sapiens
gtgattcccatgccttaacttcttgactacctggattacaggtctgcgccactacaccgagctaatacttgtatttgtaggacggggtttcatcatgtaggccactctgatctcaaactcctgacctcaaatgattcaccagcctcggactcccaaagtgctgggattacatgtgtgaatcaccatgccatggctgtattgatgtaatttattctttatttcgaaattaatgtacacccagcctatgatagtatagggactaacagactcactacctatgcaactgtcatccagtgtgctatctagttcacgtcccttccttctctgttccttgacatgtctagtcatttccatgcatgtttctgtacctttaccacatatt

SEQ ID NO: 704601 - DNA, 136 bp, Homo sapiens
actctagagggtcaaccgctgcttacaaccactccccaagtgcttagcgcgctgcctctgcctggtctaatactccgccacacagatgcacacttaagcctgggtcacaccacttgttttcccctccaaatccagt

SEQ ID NO: 704602 - DNA, 231 bp, Homo sapiens
  misc_feature (18)..(18): n is a, c, g, or t
  misc_feature (154)..(154): n is a, c, g, or t
atattatgcaggataggntcatgtctgtatcccatgtttgataggcccaggtggtggatccttgaggccaggagtttgagaccagcctgggaaacatagtgagaccatctctacaaaaattagccatggcccggtgcggtggctcacgcctgtnatcctagcagtttgggaggccaaggtgggcagatcacaagtcaggcgtacaagaccagcctgaccagtatggcgaaa

SEQ ID NO: 704603 - DNA, 143 bp, Homo sapiens; identical to SEQ ID NO: 631885

SEQ ID NO: 704604 - DNA, 493 bp, Homo sapiens
tgtatcacaaaaaagctgcaggattgttagtgattttaaaatctgttccatttttaactttcataaactaaggagaatgttgtaaaattgaagtacattgtactcacccttctttaattggaaccagtgcaatgggttaagatgttttaagcattttaaaatatagggtcgtatctgtaagaaaacagaaatcaacatagatctaaactctgtctattctgttaaaatcaaagccaatcatatttcctcaaaagtagggtactatgttcctaactcttctccccttcaactcactgctgctatagcaaagttacagctgcaacaactgacccaagtcattttcagtggctcagtatttgctaagtaaacagttaaataatttttcctatgcttatcagtgcctggcatatgtaagtgctgttagctgcatcatcatcttcatcatcaccatcatcgtcgccctcattatgcaattttatatttactgctggcc

SEQ ID NO: 704605 - DNA, 306 bp, Homo sapiens
tcagcgttggtatgtagggcttctagaatgtcgcaggtacacctgctagggccagtcagttcagttaggtcaggcccggttgtcttccctgccgacggtctcgggtcccggcaagctcagaaggccttgatgctgtctggagtagagtcgctcgttccggtctcgagagctgagcctaagtattgttcccggttggtcagggtgggtcctgggccaaggacacaggcacagagacagcactgtctccgcgggagtgagagtgagacgagggagaatagagcgctgtgcgcacgcagtgcacctggc

SEQ ID NO: 704606 - DNA, 115 bp, Homo sapiens
agccgaagtggtgctagcataccgtatgtggatattgtgtattagattaactctatcatcttgcattgttcggtttgctgtctgtcttgtatcttttctccttatctgtctcttt

SEQ ID NO: 704607 - DNA, 203 bp, Homo sapiens
ttttggtggagatggcgtttcgccacgttggccaggatggtcttgatctcttgacgttgtgatcttgcccacctaagcctcccagagccccccccccccaggagttaacctccatgccaggacacggccatttcttttgttagatttgttcgtaaatattttattcgttttgatactattatcaataaaaatgttttccttcg

SEQ ID NO: 704608 - DNA, 88 bp, Homo sapiens
tgaagaactggtggctgaagcacataactctgcgccctgctagaaatgccatacaggacactgtgagggaacagaccagagtttcacg

SEQ ID NO: 704609 - DNA, 133 bp, Homo sapiens
agatagggcaagggcccgagcagggggatgaaggcgtcgcggatgcccttcaaattcagtgcaaaaacgtgctgaggatccgcggcgaaggatgaaccaccacaagtaccgaagctgtgaagagacgcgttcc

SEQ ID NO: 704610 - DNA, 600 bp, Homo sapiens
  misc_feature (491)..(491): n is a, c, g, or t
  misc_feature (493)..(493): n is a, c, g, or t
gctgaggtgatctagaggatcccgttgagcaagcggggaacaggcgatacctgaccaatcgtgatcctagacatgaagcagggaggggaggcgaaaaattacgaagagatggcaaaagtggagaagctcaaaccattagaggtagagctgcgacgcctagaagacctttcagaatctatggttaatgatttggcctacatgaagaagagagaagaggagatgcgtgataccaacgagtcaacaaacactcgggtcctatacttcagcatctttccaaggtttggtctcatgggactagctaccgggcaggtcttctaccggcgacgcttcttcaaggccaagaaatggatggagtaaggaaggaggcatattctcctcccacctggtacctcagccagcagaacatcgcggggacgtgccgggcctaaggcatcctaccaacagcaccatcaaggcacgtgggagctggctggccagaacggatctcttgngnggtgggaggacatggggtaccacctaaacccaacaagtcaatgagggacttctttttaatgcggtaggattgcgactggttctgcaacaataggtctattattagag

SEQ ID NO: 704611 - DNA, 1346 bp, Homo sapiens
agcggaggttctcttacatcgaccgcctaagagtctgcgctgtaagaagcaacaacactctcctcttagtctccgccatcagctcggcagtcgcgaatggctagcaaccatgtcgtgagtgcatctccatccacgttggccaggctggatgtccagcattggcaagtgcctgctgggagctctactgcctggaacacggacatccagcccgatggccatgatgccaagtgagccaagagcactgggggaggagatgattccgtgcagacagcgcttcttcacgatgacgacagggggctggctagatgcaatgtgccccgcgggcacgctgttgctgatacgacttgggagacccatgatggtcccttcgagtgacaccgttcagccactatggcgaccgtagccggccaggcctcctatgccgacccgtggaggcaatcttgatcccacagcgtgcagagcagcaagcaattggctgcccaatttaaccttaatgacgcacgaaggggctacctaaccaacacatgttggtcgaacggtaggaattcagttggaccctccgctgtttgggacgctgacactaactgccaacgccttgggcccgaaccagattggcacggggtcgtcaccccgtggcactatctatgagggacttctatcccagcgagacgtagtctgggtgcgcgcggcacacatagtgataccctgcgagttacccacacgttacgactgggcagtccatttgggacaactgatactccattcgcaatttcgcaatctcacttgctgccaacaggcaaaagcatcccacaaagcctcattggcagagcctatacatgccctacggttatcaagccgcccccggtggaggacgccgcccaacaggtaagcacccccgacccacgcgcagctgcagcgcggctccagacacgccccgcccttaagcaaacgacctgccgcaaattgcacacatgcgagcaccaaggaactaaaacagaccacgaacccccttgggacagagcacctgcgcctggacaccatggcacgcccccattcaaacaaggagagtaaggaacacacaatcggaaccgagcacgcaagaacctaactagaaaacacggacccaaggatcaacagcgacgacaaaccagccactcccggagacacaacatcagaaccaggcccggtagccagaaccgccccaacgagcactgaaacagcacccgccacaatatagcgggaagtcaaccccaacgccgttgcaccgaaccaacgggagcggctcaccacgcccacatacacgcgtaggcacaccccgccgcgcacagcaaccgcacaaaccaacc

SEQ ID NO: 704612 - DNA, 742 bp, Homo sapiens
  misc_feature (643)..(643): n is a, c, g, or t
ggcaggtctgtattgccataataagtcacatcatagacactgctggtcataatacactgctgtacataccatagggaaaaacgctgccaatcttaactaagatgctgcaactgtacagctgcttccaatcagagatgttcacgtgtgaaaaactgtgctacttacaatctatgaaagctggtgttatcccacttggcaggtaaggaaactgaggtcctgtgagtgaagtgacctcatgatcacacaacaggagatggcagggctgggattcaaacccgggagtgtgtgctgtcacataccacactctcactgtctgggtccaagtcccaggaagctcgagactgtgagttttctcccttgctcacctggagagagtacgggcacctgtgcctatgtggagggttccagccccagacaggcccctccgctgtccacacactgtgaggagaagcgggctccctttcaggctcatctgctcactgtccgcattctcctggcagagctgaggtctgagagatctggactccaacccaagggccctctcttgttattcaggaggtgtgcacagctagggagggacctggggccttgtgccacacctttctaggacccgtgatcaccacaccctaagcgggggcccggncccctgagcacccctcacgtgacccagcctcggctgtgcaggctactgccatggggtggtttctgggcacaggcagggctcaggcgagacagggacctg

SEQ ID NO: 704613 - DNA, 221 bp, Homo sapiens
tcgatagcgcggcgcctgccgatctgatctttgtcgacctctataccgatgtcggcccctccagtgcccacctggcctggcgcttcctggaaaactgccagggcaagctcaaccgcggcggctggctgatgatcaaccagtggagcgccaccgacggcaagcccctgggcgccgcactgctgcgcggcctgttccgccatcattactgggagtgcccggtg

SEQ ID NO: 704614 - DNA, 1612 bp, Homo sapiens
  misc_feature (717)..(717): n is a, c, g, or t
  misc_feature (999)..(999): n is a, c, g, or t
ccgccgttcctagcggtaccggcgattgtcttcgtgcgcgggtcagacacaatggagaggagaggagaactcgctccgacactgtgtcaatgcacgaactggttgccggcacagtgcgtgcatacagccgtggttatgctggtgggacgacacggcttgcccgtagcgccggtagatttgcgcgtatccgatgcgctgcgggccgactcctcagcaaaaacaccagggtgcgctccacttggattgtggacagtgcgtgccaggacacaggacgtctcgtaacgtggtgcgaccgtagggcccaagatgacaagtcgtgcgcgactacctgagtcgctgagaaggtagcgcgccgatatgagacaggtgggcgactcagtcaggcaatgtgggcgacggacagtggtgacgcaacgactctttggctagtcaagcgaccgtgtcgtagcgagagcggacgcgttgctgcggtgggacccctgcgacgcgaagcaacccgctatgtctagcttagaattgacccagagtggacacgcgcgcatgaaacgcgctcaaaagggcgcggatacagagccagggagagagagccatggcacttcggaggaaatttatagtattggagagcaccttttcaacaaacgccccgaagagctatgataacaggtggtcacgaatcgccagagacacagtgccatgggtcacacatcgtaacagccngttctgagtgccaagcaacacaaacagtgttacaagtttgctccactgggaacctcctggagcagagccttgcgcgggttcacgccaaaacaagctgtgcttagtaccagttctattacaagaagggggagcataacacgcgccattcgcgcgcccatacgacacaaatcccgttggcagtacttagagaacccctcggggctttggggccccgtgaagagcccttggagctcgagaaacttaacgcgttcgaatttggacacgtgcacttccctttcaganctgttggacaagccgtaacgggaccttatcaacggcatttaccaacccaagatcgggacccgggccacggaggtctgaggtggaccacatttccgtggccggcaggaacgaattccgacacgcggggacgacaaagagctagtttggtcttaccaggttctcggccccccgtgtgtgaacattttccgaatgtcgaacggggagaaattttggtgctcaaaccgtgtgctcggggaaataccatacactgtagagacgacccgtgggagggacagacaacgttataacgaagagaattagtggccccgaaagtgtggcccccaaggactctcaactccaaccacgaattggggggcaacatgtaaggcacgcggactccgagaggagtacccaccgaaaaaagccacgccgtagtatacaaaagagcaaaatcattatcaccgagcagcaatagtgacacaccccaggccaaggagacgtcacccataagaacaaggcgcgttagcaaccacacaccgacatcaaagacgagcgaggcagtgtgcgatagctctgaagaagacacagagaagcgtagtgaaaccagaccagagtggactgtgaggcgcgggaa

SEQ ID NO: 704615 - DNA, 353 bp, Homo sapiens
  misc_feature (31)..(31): n is a, c, g, or t
  misc_feature (59)..(59): n is a, c, g, or t
  misc_feature (107)..(107): n is a, c, g, or t
  misc_feature (207)..(207): n is a, c, g, or t
  misc_feature (250)..(250): n is a, c, g, or t
  misc_feature (270)..(270): n is a, c, g, or t
  misc_feature (316)..(316): n is a, c, g, or t
  misc_feature (320)..(320): n is a, c, g, or t
tgtcgggggagtgtgaaagagttctagcgancgttgaatgggaggatgacgtgagtcangaccgacgcgatgttgttcgaggactccgctctacaagcaaggggcangtcacggcgagaacgctgtgaagctgtcatccaacgagaaccctttcgaaccactgccgagtgtggtcgaggccgtcacccgcacactgccgaggttcanccgttacccattaatgagtgccgaggaagtacgctcgaccatngccggtcacttcggcgtttnacgtgagccaggtggcggtgggggctggatcgacggaggtagccantcanctcatgcatgccttggctggtgccggtgactag

SEQ ID NO: 704616 - DNA, 168 bp, Homo sapiens
gccacggtagatttgccacggtagattttctgtcctcggataaggagagcacgcttgatctgtcacgaacacatttagcacacatggaaccaccataggcctgctgacatgtttctttgttttggacaacctcataagaactttaggtcttacagcacgaacccctcg

SEQ ID NO: 704617 - DNA, 929 bp, Homo sapiens
gtacatgaaaatttgaaatggtaccatgtaaaattcttctatgtcaactttttctgatgtatgccagttcatttactgacaaatgtgttactaagtgcttattaagaagtgtaaatacgctataacaaagttaatacttttgttcagatgtaaggcaacagatcattgaatgccgtttcagatgtactgattgtatttataactttcacgttggtgggagtacctctttgaggaaactttgtggatgagaattaggtacgagatacaaacccccaaaaagtttattcttaccaaggtacaagttcttgtggtcaatggggccagggacagactctattttacccagaaatactagagacctcaaaacaaacataagaggtaacttggaggagggctataatgcttgcatctcagtatttcatttcacttcatcctttcataatacgccttgatatatggtagcagctaaactattacagcaccttccggctatggtaacatgactatgaccatattcatctcaacgtctcaaaacatctagtatgttaatatacaaattacctgactaaataggattgagtcacatacctagaaacatttatataataatttaattatgcacaatttttaggttcccaacttataacaaacatacctgagataaggtatggccgctccaatagaaggttacagattcagtgacacccacaaaaaacaaagcaagggcaaacaacagcgtggactggcaaacaagccacaaaggtcactaaggcccacagagcaagacgaatacatgctgcgccaaggagacgcatagggcaagagacacacacaaacaacaccagaaaaatggcaataaacggcagacaacaaaaagacagaaaataaagagaaataaaagaaaacggagacaaaaacgcacacaaaaa

SEQ ID NO: 704618 - DNA, 390 bp, Homo sapiens
acccaatatcacacatactctagtctgcagttggtcctgcagaaccctgaatatgacaaattggccctgcaaatatgtgggtttcacatcccaccaatactgtgtttttgttgcacctttggttgaacaaaaaatctgcttctaagcagacctgctcaactcagacccatgttgttcaagggccgatggcatgtatgtgtggtttccccagtagactttgtgtccatggatcagagtgggataccacaggaacctctgcatttccagtgcctgctacaggggctgacatggagcaggctgtcattaaacgttggatgagggaacaggaaagcaaatgacatgacctctaaagaattgctctgctcttccagtgtgtcttcctgttgatca

SEQ ID NO: 704619 - DNA, 427 bp, Homo sapiens
cggtcgctctgaggccccctgcgtagtgaatgatgagaagagaagagaagagaagagaaaagaaaagaaaagaaaagaaaagaaaagaaaagaaaagattgtttccatgcctgctaacacaacatccattcttcagacccatgtagtcaacggagtaattttaactcttcaagatcttattatttcaaaaaatatatttctataagactatatgctgccataaactaatgacttctctgcatggatctagggcaaagtaaatcaaacaatcttctaggaaaagattcaccataactagaatgccatataaaaacatttagtgacccatacggaggcaagtcaaaaatatttaacatttaacacagagtattggaagcaggctgattccaagtcctacacagaatgattgctgacggaattcatagac

SEQ ID NO: 704620 - DNA, 889 bp, Homo sapiens
ggagagaactagtctcggtttttggttgtttttttctggggggaaataagaggattaatggattctatgtccttggaaaaattcatccccttgtaaaatttggcctttggatttgaaattttatcccccttaacacatactttctggatgggggggcacacaatgttggtccatgctcaacggggaccttccacggtggtaccggctcacagaactgtgggcatgtactagtcactgaacaaacgtgaacatccaccagcgcagcccacaaagatcgtgcgccttttcgtgccacctgtaaaactcctcaagatggcaccacccctcaccccaggaattctcgaaaactgcactcggcgtggggagctcaattaaattataagccagagcaggtgttcgggcggtcaccaacgtgactgcctttacgaaatctaaaaccctccttttccaagaagcctacagtgctcggtgtcatagcaaacttccccaaagttaaaaatatcgaggggctacaccagcgggggtcgcattcccaagaatccccttagtgatccagcagagttcacaagcccatgtgtttgggggctctcacatggaaactctcacaaccacttggctggcggaacccggctccacggactcaattggtaccctgtgccccagttgggaaaaaacccccgatggtcccactacgtgcgcccgggtccccacactcgccgcaccgcgctcaacaccaccttcccgtctctgcgatcccccccgggacgtcgggcccccccaaaaactcccccgaaacccggcccgacacagctcgcccaccgcctatcccccgacacgcaatcgggctcacccccgctcctcaccccccgcccgggtccagaccacaccc

SEQ ID NO: 704621 - DNA, 204 bp, Homo sapiens
gctggtgagccggagcacggagaaacggagccccaaggctcggctactgaaagtgagcccccagcagcctggaccttcaggatcagccccacagccacccaagaccaagctacccttcctgtgtgccaagaggattcatcctgggagagggggcatggtggaatgcagataactcacatgtaaaaggaacttgcggcgctcgtg

SEQ ID NO: 704622 - DNA, 454 bp, Homo sapiens
gtggccatgcctgtcatgccctcccccacacatgaaaccacgtacaaacagaaggtgcgtcttatcctcttcctctgggttacgtcctcttattacagcacacctacttcaagaatttccatcaggaggacaggctgtacatacgaacctcccccaggcttctcaactggcaactggttttgcacacttggaatagagtccccagagcagccaggtgccccgtgagctccgttacactttgatgttttttgtataatcctcctttgaaattggcaacatgtttcctgtacactccaggtgtgtgtttcagtgtaaggcatttctgaacctgtccctgcaagcaagcataagcagtgtgcagtcatgaaattctcatctttgcgtggacaccttgggtgaattgtgctctcagtggtgagtgggtgtggcaagggatgaccaggcaccatccaag

SEQ ID NO: 704623 - DNA, 950 bp, Homo sapiens
gtgcatgcggcggtgggccctggggtgccctgtgtggccctgggatggggaacctgcggtggcttcctgcggagtgtttcggcagtggcatcctggggcctggggtctgcggccgtggacggggcctggggccgaggccgcggagctcgcggaggcaaggccgaggataaggagtaggatgcccgtcaccaagttgggccgctatggtcaaggacatgaagatcaagtccctggaggagatctatctcttctccctgccccacttaaggaactcacacgatcacttgatttcttcctgcgcgggcctctctcacggcatgaggcactcgaagcattatgccagtgcagaagcagacccgatgccggccacgcgcaccagcgctccaacggcatattcgtaagctatacggcggactacaatgcgccacgtcggaactagcgcgtagttcaagtgctccaacgcagcgtggccaccgccatccgctgcggcccctcatcctggccaagctctccatcgtccccgtgcgccgcacgctactgggcggacacccgatcggccagccccacactgctcccttgcaaggctgacggccgctgcggctctgctgctgctacgcctcatccctagcaccaggcgccctggcatcgtctccgcccctgctgcctaccaagctgctcctcatggctggtatcgccgacctgcctacaccctcagcccacagcatcacctcccacactcatcaacctaccgccaagcaccacccaccaccctctcccccacaccatctactccctacacccaacctctggcacgaaacctctctacccagctctcccaactcaaaactcactacaccactcccacaaccaaccagacacaccacacacactagaccacctatgccaaccccggtctcacaaccccacctctcccacccctccgctccccc

SEQ ID NO: 704624 - DNA, 140 bp, Homo sapiens
cggctcgccgagcatgatacggaaagggttaatgagagaggcaggaagtggttattggggtaaaggggtcgaggtgccggatctcagcgagaaagtagcaggaggggactctggttgaagggggcaagaaaaggtgatcg

SEQ ID NO: 704625 - DNA, 138 bp, Homo sapiens
cagagtgtcttgaatgcagactagtagttaattgcagacgtgggtcacgaagccatctcaatgaaatcgattattaagaccactagtagaagtcaggtactaacaccaagaaggccctccaggcagtgtacagcatga

SEQ ID NO: 704626 - DNA, 187 bp, Homo sapiens
ccccccccccaagggggttttttgggaatttacccccccccccccccgggggtgggttgggggggggaaaaccctttccccgtttttttttcccaaagggggggggggcccccctaaaaaaggggtttaaaattttagggggtttgggttggccccctttttttttaaaacccccggcccctttcta

SEQ ID NO: 704627 - DNA, 485 bp, Homo sapiens
  misc_feature (222)..(222): n is a, c, g, or t
  misc_feature (233)..(233): n is a, c, g, or t
  misc_feature (417)..(417): n is a, c, g, or t
  misc_feature (422)..(422): n is a, c, g, or t
  misc_feature (424)..(424): n is a, c, g, or t
  misc_feature (452)..(452): n is a, c, g, or t
gtgaattttacttgtaacttggcctttagggtttaaactgtctttggcttgaagatgggatttcactgggtacctgcccctgttttaggatttctctgcctcctccctctatcatttccccctctgaagaggtacatgtaactgccgttagaacagggatgatgactgatcttagctgcttcctgctgacaggggcattgttttaggggcaatgacaatcanatttctctcanaggcctatctaagggtcctcagtaaaagggagccattgtctgaggctctggttgcgtgactggagtttgttggcctgtaggcaagaagaaacaaattttacaaggctaactatgcatggatcaaatatgggtattatacaaagaggagttaaagggaacgaatctagtgtcaaagataacatanatganangtgaaatatactaatcattctgaaaatnatattgtccccgatgaaagaaattaaatattgt

SEQ ID NO: 704628 - DNA, 448 bp, Homo sapiens
gcgtggtcgcggccgaggtacggaatagaatggaatggaaagaattggaatggaatggaatcgaatggaatgatatggaatggaatggaatggaatggaatcaacccgagtgcaggcgaatgtaatggaatggaatgcaatggaatggaatcatccggaatgggatggaatggaatggaatggaatggagtggaatcaacccgagtgcaatgcaatggagtggaatggaatggaatggaatggaacagcacgaatggaatggaatgtaatggagagtaagggagttgaatagaatcaacccgaatgtaatggaatggaatggaacggaatggaatggaatggaatgcaatggaatggaatcaacccgagtacaatggaatggaatggaatggaatggaatggaatgtaatgtaatggaatcaacccgagtgcaatcgaatggaatcga

SEQ ID NO: 704629 - DNA, 1478 bp, Homo sapiens
  misc_feature (8)..(8): n is a, c, g, or t
  misc_feature (10)..(11): n is a, c, g, or t
  misc_feature (641)..(641): n is a, c, g, or t
ggttttcncnngagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggtgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcaagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagnctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccactggagctccaaccgcggtggcgcgctctagaacctagtggatcccggcctgcaggaattcgcacgaggagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggttttgggaccttgtcctccccagttggcctactgttacacattaaaacgatttgccccagcttctttcggggtcttcttcttgcttctgccttttctttgggcacagccttcttacgcttgctgctggaaacttggaagtttgcttctagcccagattctgccatgtgaccttaggccacatccttggcccttcttctgggcctcagtttctcatta

SEQ ID NO: 704630 - DNA, 821 bp, Homo sapiens
  misc_feature (8)..(8): n is a, c, g, or t
  misc_feature (10)..(11): n is a, c, g, or t
ggttttcncnngagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggtgtgcaggagcttgtgaacaccttcttcagcttccttcgacgcaaaacagactttttcattggaggagaagaagggatggcagagaagcttatcacacagactttcagccaccacaatcagctggcacagaagacccgtgctggggacgaatgatgatggccctggcatgtgatgtgcctgatgctggccgtgtgatgaatggctgggatgctgggctgtgccatgacttgtgccaatggaagccacatgtcatggacgacctcagtgtgcccccatgagtcaatgtggatgctaacttgattgaatgatggcatgacgatgtggcttgcatgcttatgcaggattttggacccacgcaaaactgggattgccagaagacatccatgaagggccccatgtcctccaaagaaactgggtgcagtcttttgacatccccccctatgagagagcaatgccagagaaataccctatgagtgatgtgaacgacattaacgtactgggaccgcactgaagacggggaccaactgtagtaaaaccttgacgcccccaagcctaatgcaaccgtgcggcaggaccttgtccaagataacccgtgtgacccagaacccttgtccggagctggtacctggtcggtccctttctggtgttac

SEQ ID NO: 704631 - DNA, 1058 bp, Homo sapiens
cggacgcgtggtgtcgcggacgcgtgggtcgagccacgcgtccggagacaagccggggcctggtcggcaagactgggccagccatggagatccacgctgggcagcgggcatcgtgatagcctgaggcgctacagaaccagctagacctggctggagaactgtgtggctctggatcaccttatctggtgcgatcccaatgatcctcttatctgttctacttcccctgcggcctactacgcctcccgccgtgtgggacatcgcggatgctctggatcagcactcatacaccgagtggctcaacctcatcttcaagtggtaactttaataggagacagagcacctataggtgggtccatagagtctggtatactacagcacaggctaccaagcccaggtatcaccagtatcccctcttactatagtagagacttggtaccaggcagcccttctggaacaactgcaattgatcacaggagcagccctctggaccataatgacggccctgtcttacgcaggtggccactcgggaccgcagccgctgggtaagggtgatgcctagcctggcttatagcaccaaccttataggcagcgataggcattgtcaggacatctgcatacttcgccacatttccactcaaccaggtgctggctggacataataactggagcggactgggctggatgatgactccacgagtgcacacatggaaccgacgagcacacccccaacgggaacgaacagacaggaaccaacaatgctaagcaccagcccccacaaagccacccccaaagcaccgagccagaaccaaccgagcccccagccaagccacgagggaacgagagggcacacgggcaaccggggcaaaggggcgcaagcccccagcgacacgaacacgggcacccagggccagggacaaccacgcgacccgggacggcaccaccacagccaacagtcacacgcacaaccaccgcgagagccaacgacaccgcacacaaggaaggcagccccaagcacgcacgaacccggcccacaagtgaccagcaacccacaacaagaa

SEQ ID NO: 704632 - DNA, 198 bp, Homo sapiens
  misc_feature (20)..(20): n is a, c, g, or t
tttttggaaaaaaaaaattncccccaattttccttttaatttcccccaaaatcccggttggatccccccttttgtttccccaaggtccctgtttccccccttaaaaaaaaaagattgccccccccccgtttcccccccggttgttgtggttgttaaaaccaaacctttttgaaatttttttaggtttttaaaggggga

SEQ ID NO: 704633 - DNA, 1309 bp, Homo sapiens
  misc_feature (8)..(8): n is a, c, g, or t
  misc_feature (10)..(11): n is a, c, g, or t
  misc_feature (641)..(641): n is a, c, g, or t
ggttttcncnngagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggtgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcaagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagnctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggttttgggaccttgtcctccccagttggcctactgttacacattaaaacgatttgcccc

SEQ ID NO: 704634 - DNA, 1468 bp, Homo sapiens
  misc_feature (8)..(8): n is a, c, g, or t
  misc_feature (10)..(11): n is a, c, g, or t
  misc_feature (641)..(641): n is a, c, g, or t
ggttttcncnngagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggtgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcaagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagnctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggttttgggaccttgtcctccccagttggcctactgttacacattaaaacgatttgccccagcttctttcggggtcttcttcttgcttctgccttttctttgggcacagccttcttacgcttgctgctggaaacttggaagtttgcttctagcccagattctgccatgtgaccttaggccacatccttggcccttcttctgggcctcagtttctcatta

SEQ ID NO: 704635 - DNA, 311 bp, Homo sapiens
gggacttgcaggtgacgcagtctcggctcactgcaagcgttccacctcccggacttcacgcaattctcctgcctcagcctcccaagtagctgggattgtaggcgcccaccactgtgcccggctcatttttgtaaatttagtaggactggggttcaccatgttgaccaggctggctcttgaactcctgacctcaccatccacctgacttgcgcctcccaaagtgctgcgattacaggcgtgatctactgtgccccgccaaagattttaacggaagatggaagattcacgtgggcacacacttatgcaggggc

SEQ ID NO: 704636 - DNA, 130 bp, Homo sapiens
  misc_feature (118)..(118): n is a, c, g, or t
  misc_feature (130)..(130): n is a, c, g, or t
gttggactctagaggagtcccccaagcagtgtaaaacagactcatcaggtgtcacacagtgttgtgtctccgtccaggccttgtggctgaacacctaataaaggttcaattccccagnttctggtccccn

SEQ ID NO: 704637 - DNA, 731 bp, Homo sapiens
  misc_feature (229)..(229): n is a, c, g, or t
  misc_feature (239)..(240): n is a, c, g, or t
  misc_feature (246)..(246): n is a, c, g, or t
  misc_feature (350)..(350): n is a, c, g, or t
  misc_feature (725)..(725): n is a, c, g, or t
gaacagtccttaatccagaaacctgaaatgaaggaagaggagactctgcgcagagcactttgggtccggagggcgagactccggcggaagcattcccgggcgggtgacccagcatggtccctcttggaattggattcgccattttatttttcttgctgctaaatcaccgagcccggagtagaattagtgagagctatcttatttgtcttgagggatgtcgctggttagnacgacaactnnccacgncacatacataccattatatatatatatattatatatatataaaaatacatatctctattttatatatataaaagatatatatgctttttttaaaattaacaggngcctaatgttattttgggggggccttcacctggggagggtttttttgacctggcttgttggaaccctcgagtttgggaagggggaaggttccccctttaaaacttcccacggggaaaagggggggaaataaaaaaaaacccttgggcggggactctttttttttttggcccccactttttttggggggcccaagagagccctttcccctttcccacaaaatatttaaagagcccccctttattggggggatatattcaccccctttttttgggaacaccccccaacacccccccccggggggggggggttttttttccccccccctctcccaaccgggggggggggcacccccaccctcttgtttgtgggggggntccccc

SEQ ID NO: 704638 - DNA, 315 bp, Homo sapiens
gccgccgctactactactaaattaaagggccgtcgaccaaaaacaacatggtactgtcataacgaccagcatataaagcaatgaaaagaatagagtacctagaaacaaattcatacatttacagtgaaatcattttttacaaagatgccaagcacatacattggggagagaacagtctcttcaataaatgatgctgggataatggagatccacgtgaagaagaacgaaactagacccctatctctagctacatataaaataaaattcctaggaattaaccaaagaaatgaaagatctctacaatgaaagtcgacg

SEQ ID NO: 704639 - DNA, 407 bp, Homo sapiens
ccgggcccgtgcgtgatcatcgacccccagaatcgatctcaccttccttcgatttcgctccagcaaaacatgaaattatggttgcgccggatatagactatttcctgattgtgattcagaatccacccgaagtcgccaagggaaggcctgaggagagggatgtgttagaaagatgaggccaggcgcggtggctcactcctgtaaccccagcactttgtgcaggccaaggcaggctagatcacgtgagatcagaagtttgagaccaggctgaccaacgtggtgaaaccccatcactactaaaaatacacacacacacacacacacacacagctggatttggtggcgcatgcctgtagtaccagctactcaggaggctgaggcacgagaatcgcttgaacttaggaggt

SEQ ID NO: 704640 - DNA, 214 bp, Homo sapiens
tgacgtgcagtgttttataaaaaataaaacaaaaacccaccatcacaaaaaaaaaaatttggcagcgaagagaaatgaagaaaaacggaagaaaaaaaaaaaaacgggaaaaaaggacccatacaaatttttcccaccacacataccggaggggggcattggccacgctgggttttgtgcgcacaattcaaaacaaagagcttaaaaacattac

SEQ ID NO: 704641 - DNA, 333 bp, Homo sapiens
atgcaaaggtaaataagtccttgattggcagcacacctaatgcttacactggtccgggcgcggtgattcatgcctgtgatcctagcagtttgggagtccgaggtgggcggatcccttgaggccaggagttcgagattaacctgggcaacatggtgaaaccccatctctactaaaaatacaaaaattagccaggcatgatggcaggcggctgtaatcccagctacttgggaggctgaggaaggagaattgcttgaacctgggaggcagaggttgcggtgagccgagatttagccactgcactccagcctgggcaacagagcaagactccgtctc

SEQ ID NO: 704642 - DNA, 905 bp, Homo sapiens
gagaactagtctcgagttttggttccagcggatgtaccttaatggagtaagggaaaaggggaatccagccgcttgatacagaggtcccagtggaccaaagggcgcaaacacccttccggtcggcgtgatgggaaccgcccagcacagcggggcacgcggaacccacggccgtagggagagggttcccactctcacgcacattgagcagctccgggctcagtcccaagaggcaagggcagagggcaggggggctctcacagagcctacttacaatctaaagcggttgtgctctcctcaggagtctctctacaacactttaaaaaactgaacagaaaatagggccaggggccaaggtggcagtgccatgaggcacatggaatgtccgggtcgggggactcgtggagggtgccaggagcagcatgatcaggcatggtatgacgaggatgaccagggtggccacccagggcctgcccagtggcggtgtggattaacactgcccttggttgggccaaagagtcataggtgatgacgccccgaagtataacccgctgagcctggatgaggcatgcttgaaagcatccatgtcgtggtcccgcatagaaggacgagggccagcgggtaccacgggctctgggaactcgccaagcagtgaacccacagtggtagtggccggcgcaggagtctgtgagtttacaagagtgcgtaacagaatcgcccaatagaacggtctggaagccgggttagacaacaaatgtaccagatttcccagaaatgactcgattgatggacgcctttccataggggagagcccaatattagatcgcaacgaggagctgctaaagaataagcggcagaaagtcgaagtatgctcaataccagaagaataaccaagggccggcaccgtg

SEQ ID NO: 704643 - DNA, 432 bp, Homo sapiens
cgccctggatgcgacctattgtggcagagaatcctgaatacttctctgagatctccctgaagccaggcgctgtgttgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaactcgaacattagagggaaagactgaaagagaaagataggaggaaccacaatgtttcttcatttctctgcatgggttggtcaggagaatgaaacagctagagagggaccagaaaatgtaaggcaatgctgcctactatcaaactagctgtcacttttttt

SEQ ID NO: 704644 - DNA, 161 bp, Homo sapiens
ccaccaagtatcactaagctcgcttttttgctgtcaccaaattttattaaaggtgtcccttgttccctaagtcccaaatacttaaactgggggatattatgtaagggccttgagcatttggattttgtccctaatataaaaacaatttattttccttccca

SEQ ID NO: 704645 - DNA, 5288 bp, Homo sapiens
  misc_feature (97)..(97): n is a, c, g, or t
  misc_feature (99)..(99): n is a, c, g, or t
  misc_feature (102)..(102): n is a, c, g, or t
  misc_feature (104)..(104): n is a, c, g, or t
  misc_feature (106)..(106): n is a, c, g, or t
  misc_feature (126)..(126): n is a, c, g, or t
  misc_feature (4140)..(4140): n is a, c, g, or t
  misc_feature (5134)..(5134): n is a, c, g, or t
tcgccactccgggcccctgctgggcgggaaggcggcgccccggccgaggtggcggcggctcctcaggacggaagctcctgctctcttgtcagccgcnanctnangnccattcgcagcttctccagnccacctgcattccttgtctcagagcctccctcctgcatcctccaagccagcagttgtgggatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggtgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgtcaggactcggggggcatgaggagggggccacaggttggcaggncatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccggtaagcaccaccccctgccccacccccacgccgcccggcagccccgcctgatgcccccacttcacagggttcctggtgctgcactcggagcccaggcagcagccgcaggtggacctggaccagctcattgcgggtgagcacccctccacggngcccctccgctgggccctgctgaccctgtaggcacccgcagggactaagtgattttcctggatttcaggactttttccctgtcactggtgacctcatcgtctctagtaattcacggaaacttcttaactgttccaaaagagcttaaaaaacact

SEQ ID NO: 704646 - DNA, 1047 bp, Homo sapiens
  misc_feature (47)..(47): n is a, c, g, or t
  misc_feature (210)..(210): n is a, c, g, or t
  misc_feature (246)..(246): n is a, c, g, or t
  misc_feature (299)..(299): n is a, c, g, or t
tcttcgacagtgtaggctggttggggcagggggagggaagagggccncagcccttcctgcctcttactctgagctttagccccagccccaccctcctccctgtctcccacctcggctaggtgaccgtggagagcgcggacctgcagggctgctgctttgctgggcctggcagccccacccgtaaggccccacccgtcggggtgtttcctngcccgggtcaggcaagggcacccatcaatggcaggnggctaggcaggcaggcctgcaggggcacagcctgtgaggagacgtatgctgcntgtccttcccaggagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccactgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcga

SEQ ID NO: 704647 - DNA, 349 bp, Homo sapiens
tctggaaacacacaaactcccatgaatgaatcaggaagaaactaaaaccttgggcaataacaagttctgaaattgaatcagtaattgtaaaaaaagaaaacctaccaaccaaaaaaagccatggaccagatagattcagagctaaattctatcagatggataaaaaagaaagagctggcaccaatctttacaattaacaacaaaaaaaaaaaaattcaggggaggagaagacccctctcccttaaattcagtgctacacaagcgccagcattaccctttgattaacaaaattctcgtgctcaaagacaccaggtgaaacaaaggaaaatctacgagggccaattactcc

SEQ ID NO: 704648 - DNA, 2038 bp, Homo sapiens
  misc_feature (97)..(97): n is a, c, g, or t
  misc_feature (99)..(99): n is a, c, g, or t
  misc_feature (102)..(102): n is a, c, g, or t
  misc_feature (104)..(104): n is a, c, g, or t
  misc_feature (106)..(106): n is a, c, g, or t
  misc_feature (126)..(126): n is a, c, g, or t
  misc_feature (1609)..(1609): n is a, c, g, or t
  misc_feature (1614)..(1614): n is a, c, g, or t
  misc_feature (1616)..(1616): n is a, c, g, or t
  misc_feature (1633)..(1633): n is a, c, g, or t
  misc_feature (1834)..(1834): n is a, c, g, or t
tcgccactccgggcccctgctgggcgggaaggcggcgccccggccgaggtggcggcggctcctcaggacggaagctcctgctctcttgtcagccgcnanctnangnccattcgcagcttctccagnccacctgcattccttgtctcagagcctccctcctgcatcctccaagccagcagttgtgggatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggtgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgtaatttcatagaatatcctgatgttggtcctgcagtgtcctgcagttggaacagagccctgctcctcaccacggcctttctgctcccaccagcaacctgggccaagctcccaccaggacctctccttggccacactcggctgcctgatgttggaggctcttccagcctggaatcatctttctgtggctcccacatagccagctctcttcctttgagtcttagcttnagggncncttttcgaatagccctnggtgttgacccccttcttccagtgcagcacccccatgaatatgtttctcagcctctcgtctgcacctctcctgatgctgccacagtgtgtggtgatcttatttactgtccagttgtctttgtgtcttttccattaggacataagctacttgagggcaagccccatctgcttataagggctagcaggagttggctccccatnaactgagagtgataaaatattgcgttagaaaaaacaaaacaaaaaaagggggggttaaaattcccgagggcaattagctaccgttttgggaagggccatggggggtaaagaagaggggggttaagggggggaaaagctggcttgggaaccctttgggaatgggaccaaaaagggaaaaaggtgggaacggcggatgtgtaaaaa

SEQ ID NO: 704649 - DNA, 652 bp, Homo sapiens
  misc_feature (1)..(1): n is a, c, g, or t
  misc_feature (69)..(69): n is a, c, g, or t
  misc_feature (71)..(72): n is a, c, g, or t
  misc_feature (85)..(85): n is a, c, g, or t
  misc_feature (92)..(92): n is a, c, g, or t
  misc_feature (109)..(110): n is a, c, g, or t
  misc_feature (114)..(114): n is a, c, g, or t
  misc_feature (121)..(121): n is a, c, g, or t
  misc_feature (131)..(131): n is a, c, g, or t
  misc_feature (145)..(145): n is a, c, g, or t
  misc_feature (147)..(147): n is a, c, g, or t
  misc_feature (158)..(159): n is a, c, g, or t
  misc_feature (194)..(194): n is a, c, g, or t
  misc_feature (235)..(235): n is a, c, g, or t
  misc_feature (239)..(239): n is a, c, g, or t
  misc_feature (243)..(243): n is a, c, g, or t
  misc_feature (262)..(262): n is a, c, g, or t
  misc_feature (267)..(267): n is a, c, g, or t
  misc_feature (273)..(273): n is a, c, g, or t
  misc_feature (282)..(282): n is a, c, g, or t
  misc_feature (298)..(298): n is a, c, g, or t
  misc_feature (300)..(300): n is a, c, g, or t
  misc_feature (307)..(307): n is a, c, g, or t
  misc_feature (375)..(375): n is a, c, g, or t
  misc_feature (385)..(385): n is a, c, g, or t
  misc_feature (417)..(419): n is a, c, g, or t
  misc_feature (421)..(421): n is a, c, g, or t
  misc_feature (435)..(435): n is a, c, g, or t
  misc_feature (469)..(470): n is a, c, g, or t
  misc_feature (482)..(482): n is a, c, g, or t
  misc_feature (506)..(506): n is a, c, g, or t
  misc_feature (512)..(512): n is a, c, g, or t
  misc_feature (522)..(522): n is a, c, g, or t
  misc_feature (525)..(525): n is a, c, g, or t
  misc_feature (533)..(533): n is a, c, g, or t
  misc_feature (536)..(536): n is a, c, g, or t
  misc_feature (542)..(543): n is a, c, g, or t
  misc_feature (555)..(555): n is a, c, g, or t
  misc_feature (577)..(577): n is a, c, g, or t
  misc_feature (650)..(650): n is a, c, g, or t
nggcccgccctcctccctccccattccaaacagagtacaaaaccgcacccaaagcagacattctgtacngnngggtggggggggnggggggnaggggggggggggggcnntgcngttgatntgtaaaagtncgggttggtgacgncnccagcagtccnnaaagggcccctggggggcgaaggaagtgggcaggngcctctagatgaaatattccttcttgtcgtcccctcctgantgcncgcnttctgcattgatgatggcngtgtncgcgtntggagaatngtcggagccttttgcntnatgtgtnaggtaggttcctttgtgccggataaagtagtggccgaggaagatgagcatgatgagcagcaggaaganaatgaaagcnacgatcccaccgatgatggcgtggtaggtgcnnnangaggagggaaacgnaatggggtaattaaaattgcagggtgtagtaggnnttgctagctganaatgcttgctgcgtgcgcatgctnaagcangctagctgcnaanatgctaanatnttgctnnagcgcaaagcgnaagcatcaggcgcaccttctcnctggcgctcattctttcaggggcgtgcgcaaaaatgccctctacctttcttccacattagcgctattgccacngg

SEQ ID NO: 704650 - DNA, 1317 bp, Homo sapiens
tagatcgcgagcagaactcgaggctaaatcggctgcgattcctctcggaacgcgcctgcagaaggggtcctggtgacagagtccctgctgttctcatccattgaatccactcgccagcccatgacgccctctgccgtctgcacccatgcacacacctgcccctctcctgtgccaggaacattgcatacgtaccagacaccatgccctaccaatatccagcacatgacccacggagcagcacgcaggagctgtctgacatcgctcaccgcaatcgtggcaccatggcaacgggcatcctggctgcagaatgagtccactgggcgccatcgccaagcggactgcagaccatagggcaaccgacgcacaccaaccgacggacagaaccggcagcctactcaccgcccagcatgcgagcatgaacagcgtgacgacccgcagataaaacccaccatgacaatcaggcggagaagatcaacacaaacattcccagatgaagacaagatcaaacccaaagacaaggccgagactgacatgaagcagctacacaaccaccgccaaagatcacgcaaagtccacacggcgcgggtgcaacggagcgacaactcacccgcgcagcaccaaacaggcgccgagggacaccccagtgagacagacgagcaaacaaatcgcacaagatataacacacgaccaaggggaacacggcaagaggccttcgaccagacagaagccagaagcccaatacaccacagacacgggacgtggaagcatgaaatattccgtacaaaagttgttaagcatggtgagtgcgtgaacacaacatagggaaaaactacaaacacacacaaacgagagccgatgcaacacatcacaatcgaaacaaaatgaggaaaagtaatcgcaatgagaacacgtctaacaagacccagccaatcatgaacaagcaaccacatggacatatgaggacacgcgaccagggaaggacccagacagccccgccgactgacaagagcagacacaggcacaggaaagcggaacacaccaaggacacgagaccccaacagaagagcgactaggcacacaggccaaccccacgctgcccgaagtgcgaaagcgaacagccgctcacgaacaaagggaacaccagcgaacacgcagacaaaggggcaccaccacaggagagagccgacgaggaaacgtgacggagagcacagagcgaccgagcggcgcacaacaccccaacacagggccggaagcgagcacccaacgaaggaagcagaagaagggagaaaaccgaagagaggacggcgcggcgagatg

SEQ ID NO: 704651 - DNA, 313 bp, Homo sapiens
acgaaaacgtcgcctgaatggtactgtaattgagcactccgggaatatggagaagtaatacagcgtacgggttgaccaacgcaagaacatatgccagttcctcgctagagattggcctggctaaggacgatcagctgaaggttcatgggtattaagtgcttgtggctcactgaagctaaagtgaggatttccttgcactgagtagaatttcccttctctcccttgtcacaggtaaaaaaacctcacagcttgtataatgtcaaccatttgcggtccgctaataacttggactagtgtaacaccttcatgcaat

SEQ ID NO: 704652 - DNA, 141 bp, Homo sapiens
  misc_feature (7)..(7): n is a, c, g, or t
  misc_feature (14)..(14): n is a, c, g, or t
  misc_feature (73)..(73): n is a, c, g, or t
tggaaancctacanaagcctgtaagccaaggaggcagggtcttcctttggcatgggatgggaataaagtaagnagagggactggaccccctggaaactgattcactatgggggcaggtgtattgaagtcctccagacaacc

SEQ ID NO: 704653 - DNA, 798 bp, Homo sapiens
taaagaccatacctttagaaatatgggtctatttggagatttcagaatagaagtatcatcacagtggttagccgtggttttctataaaatagatacaattcaattaaaaaatattggtgtgaaaaccgtgttaatctggcataatgagcttcagttcaagttagtattggcgtgatcgtgatatccgtgtaggtgtttcaatctcgaggattataattggaagggaattaatacataggtatacactcttaaataggtataaatacaataagtgcgtgattatggctgattattaggaccatgggctatcaatgaggttctttaaagagcgcgcttgcaaaaattggcatcatatcactaggcaatattataactctaagcaaaagtccctcaaagctaattggtcctggaattatccagtagatagacagccctttgtgacccagtgctgtgtgaccagaagcccataaattacaagcgatataacgtgcgtgcctcaaatatccccaggagcaactaccgcaagacgaagactaggtggcacacagccatctacagtgaggagacacacagcgggctagtcaacaactaccgtgatgcaccacaccccatgtgacacaaacaataatcagacacggggaccaaacaacaacaacaaaaatctcagcaggacagtatagggggacgaagacacagattaaatcagaacccaatccatgagggccactccgcagcaacagacacaaaccaaatcaagcgtgggcccccaactaacacgaaaggaggaaagacaataaa

SEQ ID NO: 704654 - DNA, 346 bp, Homo sapiens
ggtgattagaggatccacgtatatgtaactttctcccttcctttccttttcctttttctttgtgagacaggtctcgctctgtcgccaggctggagtgcagtggcccgtcttggtcactgcaacctctaattgatcctcccacctcagcctcctgagtggctgggactgcatgcgtgtgctgacacgcccggctaatttttgtttattttttttttggagagaggaggtctcactatgtggccgagtctagtctcaaactccggggctcaagcgcttctccggcctgggcctcccaagtgctggtgagctctcacaccggtgcatggtttccgggttccaggtttcc

SEQ ID NO: 704655 - DNA, 619 bp, Homo sapiens
agggcgtagtggtgtaacattgaagaataaccacgtttgaggtggcagatctgaagttggtttgagagattatggcccgcggatttataagggtattaataaatactggtcggaaacccgttgcgcacgcccttggtttggggacattctgcttgtaccccctaagatgtcccagctttttttcttggttgaccccaagatgtgtctcgcttggcaaagaaggtttttttcgtgttcgtaataaaagcgttccgagacgggccctaaaaatgtatgggaaatagatattgtggcccccacacaaagggtcctatttaccccaggaattttcttgcgcgtcttgagtttttgctgttgtgtgtcgaattaggtgcgtacaaacaagggatgaaaaaccatatgcagccgaagattcttatcatctgaggaccacttttttttcgaatcaatcacagatttgtacgaggccactgtctttgcttactagtgctctggctcgagaccccccttcccacataagttggcccacaaattttttccatttctatcctgtaatccccctttatccccctcggggggatttacaaaaaaattccccaaactaaacgggtaaaaaaaa

SEQ ID NO: 704656 - DNA, 1007 bp, Homo sapiens
gctgctctgcgtaatgttgccagcctgatgcgcacgggcgcggagaagcgttgtgcaagtaacgtatgtatggttgggcactcatagcgccaggtccggtcccagattggtattgttatgggtagtactaggatgcatgacggtaaaggacacagatgctacgtggaaacgctacatcggagagatgagatctaggaccattgacaagtgatggtatgccagcctccggtgtgttgcagtgctctcatcccccttacgggtcacgcagaccaaacaggaggtaatgttactctgaagattggcctggtcctgagagagaacgaaaactgggacctaacgagaaaaggtgccgggtgcgaccacgagtagatgcgctatatatttccgcgcccaaatggtgacatcatagaaggtaggaagtaagaatcgagagattaggttatgaaaggagctgatggactaaatgtgggcatacgagattctggctgcagaggtgtgttgagaagcttcacccaatgggtgtctgctggtgtgaaagaatagctggcctattaaaggaccgggatagtgaaggggtgctgatgatggtggttgccagcggctggatggatgtctgcagtagtacgaagattcagtgcaaaaaggttcatagagttatgtaaaaagccgtttcctctggagtaaggtatgcgtggctcattggcgaccgtaactttgagactttggttgcactgcatggtcagacggatcagaagttgcggtggaccagctctgctcgaaaggtattgtgcccgattgatgtgtggcaccaacagggtccggcgggcggttcaggcctggtgaatggtatttgggggccggggtaaagcgtgttgttgagaccggcggggaggtaagggggaggaggggtcccttatatataaaacggagagaggtctatctttggagaaaaaaaaatggggggggagaggaaaaaaactgggggcgcgataatatgagcgctatca

SEQ ID NO: 704657 - DNA, 522 bp, Homo sapiens
  misc_feature (128)..(128): n is a, c, g, or t
tacgacgaagcatctctgcatgatatctggatccaccaattcgctagattcggccgtgatgcgtctccggaagtataggcatgcgtccatccccggctccggccgtctgccgtaatccatgcggtaancgcgtacgagcagacggtgaaccaggagattaactttcaaaaaagctttaacaaccacgtgcgcacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtaaagcccgagggccgctggctgctcgatttgataaacattctgcagagcatagtggtgcaggagcgcagcttgagcctggctgacaaggtggccgccattaactattccatgctcagtctgggcaagttttacgcccgcaagatataccataccccttacgtt

SEQ ID NO: 704658 - DNA, 157 bp, Homo sapiens
  misc_feature (3)..(3): n is a, c, g, or t
  misc_feature (32)..(32): n is a, c, g, or t
  misc_feature (47)..(47): n is a, c, g, or t
  misc_feature (78)..(78): n is a, c, g, or t
  misc_feature (112)..(112): n is a, c, g, or t
  misc_feature (116)..(116): n is a, c, g, or t
aanctcacttacctctgagtttctgctgtaancctgtctttctctcnctttttttgaactggaatctattactttggntgatgcatgctggcgttttctaaagttttctgantgantgtgtctttaaaaaataatctgataatattttagcttcttg

SEQ ID NO: 704659 - DNA, 133 bp, Homo sapiens
agcctgagttaagctgtggggacagcatgctggccaagggtttccccacgctcagtcctggtcaaggctgccagacctttctgagtgcccccaggaggggctggggcgtctcagggtgcccactggcgaggga

SEQ ID NO: 704660 - DNA, 217 bp, Homo sapiens
  misc_feature (80)..(80): n is a, c, g, or t
gcctccatcctcaccaatcccatggatgtcatacgaacccgtgtgcagcatctgcagaagccagcccacagccaggcacnagtgcacgcctgtaatcccagcattttgggaggccgaagcgggcagatcacctgagcccaggagttcgagaccagcctggccaacatggtgaaaaccctgtctctactaaaaataaaaaattagctgggtgaaaaaa

SEQ ID NO: 704661 - DNA, 484 bp, Homo sapiens
catgcaaagatatgaacgggaagaatggagtggcaatggtgtgctcctggaaagctcacccagcagagttgccctgagctcggggccttggttacatgtccctggggatatttatatttaataaatttttatataaatacacagagaaatagaaaatataaaatctgaggggttggggaagaaacgtgagggactcagcatggaagccagagcttggagagtgtccattcaggccaacttgagctcctccttgaccccgtttgggttctggcttcgtcctccttggattactcctcttcgggtgacttctttcttctcctctgggtctatctctttttcaatacctctgttttgactctcttggcttcattgaagttggaagcagttctttgcggccccctctccctcctcttcagaaatcggagaatcttcctcacaggcaatacgtgtgtcagaggagcagatcgagatgcgcttgtcaagg

SEQ ID NO: 704662 - DNA, 356 bp, Homo sapiens
gcccgaggaaaactaaagttgttgttgttgttgttttaaaacggagtctcgctctgtcgcccaggctatagggcagtggtgcaatctcacctcactgcaagctccgcctcctgggttcatgccattcttttgccccagcctcccgagtagctgggactacaggcgccccccatcctggccaacatggtgtaaccccatgtctccccaaaatacaaaaaattagctgggcatggtggcgggcccctgtaatcccagctactggggaggcttaggcaggaaaatcgcctaagcctggaaggcggaggttgtagttaacttagatcatgcccctgcaacaagcgtgagaatccctctcc

SEQ ID NO: 704663 - DNA, 901 bp, Homo sapiens
  misc_feature (9)..(9): n is a, c, g, or t
  misc_feature (327)..(327): n is a, c, g, or t
  misc_feature (343)..(343): n is a, c, g, or t
  misc_feature (349)..(349): n is a, c, g, or t
  misc_feature (373)..(373): n is a, c, g, or t
  misc_feature (376)..(376): n is a, c, g, or t
  misc_feature (378)..(378): n is a, c, g, or t
  misc_feature (381)..(381): n is a, c, g, or t
  misc_feature (383)..(383): n is a, c, g, or t
  misc_feature (385)..(387): n is a, c, g, or t
  misc_feature (396)..(396): n is a, c, g, or t
  misc_feature (405)..(405): n is a, c, g, or t
  misc_feature (427)..(427): n is a, c, g, or t
  misc_feature (433)..(433): n is a, c, g, or t
  misc_feature (438)..(438): n is a, c, g, or t
  misc_feature (457)..(457): n is a, c, g, or t
  misc_feature (467)..(467): n is a, c, g, or t
  misc_feature (476)..(476): n is a, c, g, or t
  misc_feature (478)..(478): n is a, c, g, or t
  misc_feature (491)..(491): n is a, c, g, or t
  misc_feature (494)..(495): n is a, c, g, or t
  misc_feature (498)..(498): n is a, c, g, or t
  misc_feature (562)..(562): n is a, c, g, or t
  misc_feature (732)..(732): n is a, c, g, or t
  misc_feature (811)..(811): n is a, c, g, or t
  misc_feature (833)..(833): n is a, c, g, or t
  misc_feature (872)..(872): n is a, c, g, or t
aagaaaaangatatacacaattcaatgtggaaataaattactagaaatactctggaaacttttccatttccctctcaaactcacttttttttaagctcataagtctttttacttgattttaagaaacatggcaactataatactaagaaagaactacagctttgtacagaaacatagagccttgtcttgactataaggattagttggtgttttaataacaacaaaaaagcacacaagacacaaacactcttcaacaggtttactcaaacagcttcgctcaagaagaaaaaggcacagatttaaagggatgacaataatcattaagantgaggtaaatggggantcagtnaaaaaatgatacttcatgaattangtnangananannnaagtgtttnaaattatcngtgcttccttaaaatgaatttntaaatnaaatnggataaacatatgagaganaggggggacntgagggggngncggggtatatttntgnngtncaaatgctttgtatacaatttcgatgttccttatatattccctatatagcaaaccgagccaggncctcccaactgcatgcctcaagtccctgtggagcactctggcagctggatggccctacttgctttctgacaaaatagctggaaaggaggagggaccattaaatgtagtcatcttcaactggctctccattgacatcacaatagtggataaaaattgccactactcgctgnaatacacccttcttcatctgacgcatctctgaaatttcctctcctattgtttccatacagatgtctgcagacagctgtnctttccttctaggagcataganagtgctttcttcatcgtcttcaaagtcgtatcgagcgantgtttggggctctgcagctcgttaatgac

SEQ ID NO: 704664 - DNA, 333 bp, Homo sapiens
cctatttgttggcccgcttgtgtctgtacatctgcatcatcctctgtcggaacacatcgaatgtgtctttctttgtgctcctgcccgtaagcacccaacccttcccttcgagggggttccctagggagtgaaaagagagtagttgtgcacctcagccagggcctggcatgcaggaactgggcatggcacaaacagtcatgagatgcaggtgtttggacacacactgagacatcaagaagggaaaatcagacgcgactacagtagaacaggagtactacctcgaggctggctttgagggtccagagcctgtactcgatgctaccagcagactag

SEQ ID NO: 704665 - DNA, 383 bp, Homo sapiens
gtttcgtcttcccggaagcgttggaggacattccctgttgactgcgtccgatgtgtggcgactgtgtggagaaggaatatccaacggggtaatactgcctggagaatggatctttcttatgactttacaggctgtgagtgtgcagtaagcgggattttatgctgatcacaaacaaatccttgaagagaagatggagagaaatagttacctatgatcatgtgtagaatgcacatgtatagcagacatgagtatacatcagtatctggtgatttcaggagtataccatgctgtgtctgttatgcggcaaacggagatactatcagtattctccctgatgaccccgacaaatgactctcttattctaaggatccttctacagatct

SEQ ID NO: 704666 - DNA, 480 bp, Homo sapiens
gccggcctgcttcttacccagtgtggtaccgtacatgggaagtactgagtatatattttcgcgggtagcgactgtctggggctggtgttgcgtggtggtaaaaataatctaccaagacatttgaggtaaagaaaggcagatttattagagaaagtatgaaaatacattgcaagaaagctataggcaagtcagcaaaagaggagctgaatgcaagtagcaaaggcttgctggggatcttaaaggatggtgcttgtgctgtgggctgaagagagctttgtgcagtactgataacacctaggttgcaatgagctatcaggcgagggtctgatgatagctgggcacaggaagattgtgagttatttgtggaggaggactgtgtgtcctggaccatgaagaaaggtggacttctagcttatctgcttatgtatttttgctttaccctgttcccttattaggactgcacactgggttaagtaagca

SEQ ID NO: 704667 - DNA, 416 bp, Homo sapiens
gcggactgctcttcgctgggactcgctagcatcgcttctacagaacttcagatgcatgcttgataaccttactttgattgtgatcctgaacatgttgaagtcgtaactgaataccactgtttcgcaggagtttttatcgctgacttacacagatatgattgaacaggtgaagctagcctgctaataccattgatttaagagccaacaatatgcacatgccattccgcaagcattggcttgttcacctagtatttagagcatgttgactttgttagacgcggagaggttgatacgtgtatagatgactgcactgtcactttaacctgaacagacttctgacaacgaaggacgagccagtcttagagactacggtatccatcaggctggccaggaatgttcgaacttgttgtttttgg

SEQ ID NO: 704668 - DNA, 484 bp, Homo sapiens
tgaccacctagttttatttttttttttagagaataggggtctcactctgttgcccaggctgaagtacagtggctcaattacagctcactgcagcctgcaactcctggggcttaggctatcctcctgccttagcctcccaaagtgctgggattacaggcatgtgccaccgtgcccagctagtttctattagttttggaaattctgtgtattttggtggtttccccagtctgtaattttgcatatgtatgcttggtccttttacctttttttccaggtagtgacatccaggggtatttattttcctccatctttttcaagctttcaccaataagcatctataacttcttatcaaaaacctaacaaaacgacggtatggcatcatacctatttcttttagaaaccacaatgtatttatggagtgctttctgattaagcacaaagtttagtaaaggaatgctgctggtttaattaagtagataaatcc

SEQ ID NO: 704669 - DNA, 355 bp, Homo sapiens
atgcacattaatcacagctatcatggaggcatgacaagacaggaagacattgaacatgggaggcgaaataggaaaatgaagaggtatgcaactgtactccggcctgggcgacagagcgagactccatctcgaaaacaaacaaacaagcaatacctaacaagtaacatacccattcactaatacccagccgcgcctatcatgaatctctatagaggcctaaaatgaggatctatagtaactcttgatagaaacaggaataggggacgggcaatggtgactcagtgcctgtaataccacgcactaatgggataccgtgacggatcgctggggactcctcccagagtcaacctgcagg

SEQ ID NO: 704670 - DNA, 454 bp, Homo sapiens
  misc_feature (40)..(40): n is a, c, g, or t
  misc_feature (47)..(47): n is a, c, g, or t
tgcagttttgctcttgttgcccagcctggagtgcaatggngcgatcncggctcacagcaacctccacctcctgggttctagcgattctcctgcctcagcctcccaagtagctgggattataggcatgcagcaccatgcctggctagttttgtatttttagtaaagacagggtttgtccatcttggtcatgctggtctcaaactcccgacctcagatgatccgcccacagctgcctccgacattgttggaattacaggcatgatccaccgtggctggccaaacaaaggcatttctgtgctaggtcgttcttgttcctttatctgagtgagctggaggtttgtacaagtttttatccaaatgggccagaggtttttctatctctgcagccacgggcatgtctccaagcacaacaacatatgttagttcccttctgtcgtcttctcacagccgcata

SEQ ID NO: 704671 - DNA, 112 bp, Homo sapiens
  misc_feature (15)..(15): n is a, c, g, or t
  misc_feature (48)..(48): n is a, c, g, or t
gtgtcgagccttggnggactcccccgagatattccccacaatatcttntaagacgctgagtgtctggtggataatcagtttggtgtcatccagtggcatctttctctgtggg

SEQ ID NO: 704672 - DNA, 1186 bp, Homo sapiens
  misc_feature (360)..(360): n is a, c, g, or t
  misc_feature (823)..(823): n is a, c, g, or t
acgggaggatcccgggcaggtgcctagcagcgacggagagagaaaagaggcctcgggatgccaagaacactatgatcctggagatctggtaccaggtagcgggggagaccaggaggccactatgtcgatatggggcatatccactgaggacgggctgcgctccagacacagatgacctgaagcagcgggccaagggtgtggacagatacatctccaagtatgagcgggacaaagccttctccgataggaacaccctcatcatctacctggacaaggtctcacactctgaggatgactgtctagctttcaaagttcaccaatactttaatgtagagcttatccagccgtggagcagtcaangtctacgcctattacaacctgtgaggaaagctgttcccggttctaccatccggaaaaggaggatggaaagctgaacaagctctgccgtgatagaactgtgcctgcctgtgctgacgtgcacgacattgctttcattacaaatagtcggcactgacagggtcaccctggacacgaacggctggacaaggcctgtgagccacggagtggactatgtgtacaatgacccgactggtcaaggttcagcttgtccaagtgactttgtacgagttacattcaatggcccattgatgcagacctattcaagctcagtgctcgtgactgagggtgccacggttgtgatcatgcgagcgtcaccggttcactctagccccagtcacatggtgcacgcagaatgcccctgcaagtctggcaggcagacagaaagcgagcataccgttcactgtggtggtctgtctccttccgnagtatgtcatgcgggcagtgatgaacgcgcacaaggcttctagctgacattcagtcggccgaagcgcacagcttgtgccgtgcggagcgactgagctccgagggtacgtgactcgaactggccaaaggacggcacatgacgaaaccctaggaacagcaagtgtccatggcagctctcgagccggccctttcgacctgatgacgccattgggtctgatcatatatggggggtgcgcctcaaatcgttgacctagcagccccaagtttctcccgcaatttccacgagtaaaagcctttcgagtgtactattcttccaagaacagcggatcgcacaaagaccatcgacagccgaccgatggaaaca

SEQ ID NO: 704673 - DNA, 396 bp, Homo sapiens
  misc_feature (5)..(7): n is a, c, g, or t
  misc_feature (32)..(32): n is a, c, g, or t
  misc_feature (46)..(46): n is a, c, g, or t
  misc_feature (48)..(49): n is a, c, g, or t
  misc_feature (65)..(65): n is a, c, g, or t
  misc_feature (91)..(92): n is a, c, g, or t
  misc_feature (94)..(94): n is a, c, g, or t
  misc_feature (102)..(102): n is a, c, g, or t
  misc_feature (124)..(124): n is a, c, g, or t
  misc_feature (130)..(130): n is a, c, g, or t
  misc_feature (146)..(146): n is a, c, g, or t
  misc_feature (148)..(148): n is a, c, g, or t
  misc_feature (188)..(188): n is a, c, g, or t
  misc_feature (197)..(197): n is a, c, g, or t
  misc_feature (208)..(208): n is a, c, g, or t
  misc_feature (219)..(219): n is a, c, g, or t
  misc_feature (235)..(237): n is a, c, g, or t
  misc_feature (264)..(264): n is a, c, g, or t
  misc_feature (267)..(267): n is a, c, g, or t
  misc_feature (269)..(269): n is a, c, g, or t
  misc_feature (326)..(326): n is a, c, g, or t
  misc_feature (333)..(333): n is a, c, g, or t
  misc_feature (335)..(335): n is a, c, g, or t
  misc_feature (341)..(341): n is a, c, g, or t
  misc_feature (365)..(365): n is a, c, g, or t
  misc_feature (368)..(368): n is a, c, g, or t
  misc_feature (371)..(371): n is a, c, g, or t
  misc_feature (379)..(380): n is a, c, g, or t
  misc_feature (389)..(389): n is a, c, g, or t
gtatnnntatatagcctacagtcctggagtcnggatgcagaccacntnngcacgctctcttgcancgatcgaatcgtggatcttccggccnncntcatcccnccgccgggctgccgcgctcccngccgcngaaatctgcatctgcncngggtatttgtaggtggggttctcatagccgtggttctgcntcttgttcnggtgacgctcntctggggtgancattggatcaacctcnnngatcccgtggctgatggtgccatactnccncntcctcagcatcaccgggctgatgacgatgaccgtggcaatggccgctgcgatgaccngcaggcngntgagancactgctactcagactgaagtccnccngcngtgggccnncggattccngctcttc

SEQ ID NO: 704674 - DNA, 149 bp, Homo sapiens
tgcccccccccttttcaattgctattttttgaaaggcccccgtatgtgttttaaattgatttccccgtttcaggggaatcccggcccgtagtttccgttttgatggtataagcccaaccaataaaacgtttataaaagttgtttcttga

SEQ ID NO: 704675 - DNA, 1170 bp, Homo sapiens
attctagaggccgaaggcggccactatgttagtcatgtttctctgcttaattataattctcgatgatggaacgtgctgacattagaccaaggtgtcacgacgctttcttctttccaatcgttggaggctccattattaccagacaccggcgtagtacagtctgtcaccaacgtcacttaccttggcctctccaagtatccgacactccacacgatacccatcacacgaacacattccacaacacatctaacataacaaacaaaaagaacataatgcattgatctaacaacaaaaataccaatatcaacacgaaatacacaatataatagaatccaaatcacactcaccatataacacaccacagcccatctaacccatataacatctacaattaccaccacaaccaacaagcactacaccacacaaaccacacaataccatataatagcccctcacatcaaccactctaccacacctccccaaccttctataccacatacaccaatcccataccctaaccacaccccccacgtcactacacacacacctccacaaccacaaacacacactccaccactcaccttcactcccccatacaacatacacccacaccacacacacaacactcacacacaaccaccaacataaaactgttaacctccactaacaatctcaacaagcatcacaaaacacctacatccacacaccaacccaacaaacacacttttcaaccatacatcaacccacacacaactacatctactctctcacccactacatcacaagcaacccatcaatactaccagcactacctcacaaccctatatcctccaaactaactagcaacactaaatcaaccaaaaatgaaatacaaaatactaccaacaacatacataaacaacaacaatcggcctgagagcgaccacaagcacatgtagtctcacgacaaactcaacgagtagccactcaaacgtcaagaaccgcaccgccataataacaacaccacgaacgagcgccgaccactcccacactgcagagaaacgagagaacgcccagctcccccacacagtactcaacaccactataagagaccgacgaacacaagacgagaccaaacgcagaagcactcagaccgccacaaacatacctaaaagtgcagcacgacccacg

SEQ ID NO: 704676 - DNA, 260 bp, Homo sapiens
gggagccacagacagtcatgctcactctggctctgaagggacaatatgcttctgggcttctgccgctcagtcccttggaataccagtatattctaaaccttccgtcatttatcatctcaaggtgtcgtacccttgcttgtcatcccacatagccctgtgcggtgaatgtgaatccggagtctatttatctaaatagaatcggaaaaaacaaagagaaaacaaatatgaaaatgaatacatagacatagacaaaagcgggc

SEQ ID NO: 704677 - DNA, 643 bp, Homo sapiens
aactaaagaggaaatatggagaactggaacatgttggtcggaagccaagctaccaattacggggaagatctcacaaaaaatcatgatgagcttggatagacactcaccagaatatggcagcatgtcataggcattctgttatggtctgggatggtggctacaatggtctaatttacagcagtgtgtgatcccacaaaaagcaagtttatacctcagatgggggtataaaaatggttttcgctcagtatttactggaaaatggacatcactagtctttcagtaagatttctctcaaaacacgtgaaaaccttgggtaaatggcaattctttctggggatatatgggtacaacatgacgttaaaacttttttttttctattaaaactttaaaggggaacaaaattgtgaaaaaagccctgttcttcagaagggtgagtgggtggagggaggcagtaatatgaaagggactgctggggtattttaattacccagatttttatatattgtggccactgtgttaaattagtgggaaaggggaaattctgattaagcgacaggggtataatcctaaggtaagcttatttcagaccaagtctaatatttcagattctttcttttgcgactttaataactctggggttatt

SEQ ID NO: 704678 - DNA, 225 bp, Homo sapiens
gggcaaagccttcatgccaaaagtgggaaaagaaattgtgccgaaagccaaaattgagaaatgggatctaatcaaactaaaaagcttttgcccagcaaaagaaactatcatcagggtggacaggcaatctccagaataggagaaaatttttgcaatctacccatctgacaaagatttaatatttagaatctccaaggaacttaaacatatttccaagaaaaacca

SEQ ID NO: 704679 - DNA, 115 bp, Homo sapiens
tccgggaggaggagagaagtgaatacattcacagttaatgagtttccagtattttctgtcgcattttatgtgtaatggaaaagactgggaactgaactcacatggccactcaata

SEQ ID NO: 704680 - DNA, 416 bp, Homo sapiens
gaatcatcagagcagaatatccatccaggacaaaagccagtctcttgagtgttggaaggagatgaccaacagcttgagcagaattgggtcaaagcatctgcagcctgggctttgcgttggggcaggctgacttctgaaccaccctccccagggtgcagaaggtaaaagcagcagacacaagtaccctctgccatccccagcaccccagaatgctctccagcctgagcggcactcctcccattcctccttgcactgtagtcatttacttacggcttatgcctgctagtagccaggtcagagtcatctttgtgtgtctccctgcccaccccctgcccacatactgtcttagatgcctacacatttcaaacatcacacgttaaaagaattaaccaatcaattaagtaatgtaactttta

SEQ ID NO: 704681 - DNA, 112 bp, Homo sapiens
gttatccagctactggaggtgagtggaggacactgaccaggagtcagctgcagtgagcatatcaaccactgcactcaagctggcacagagtgagacctgtctcaaaaaaaac

SEQ ID NO: 704682 - DNA, 304 bp, Homo sapiens
acctgctgagccatgctgagggctattgggcacctccctgtggttagagaagagcgccccaatcagacttcaaacacagctgcctaatcagccagtggtgagcagccaggtggcctgggccagccataagattagtcttctcctcccagcctggtttggcccagcctccatgtatactatctttggatggaggtagagttgtcaatcagaaaactcctctcccttgacaaagactgccccagaggaagtccttttgtctcttgcctagcttctgccacaccttcctaatagatctttctgtttt

SEQ ID NO: 704683 - DNA, 421 bp, Homo sapiens
cgacactcttggttgaatattgattagttactttgtacagtgactctcaatttgggattctctgattttctgtttttcagaatttgactgaggctgtgcagttttggcaagaatatcacagaaatgatgctgtgtgctcagtagatcacagtggagctcgtgaggtcattgtgtctttttttttttctttttttttggagacagagtctcaatactgtcacccaggctggagtgctgtagcgccatcttggctcactgctgcctctgcctcccaggctcaagcaatgcacctcagcttcctgagtagctgagattataggcacacactgccacatgcggctaattttggtatttttagtacagacggggttccaccatgttggccaaactggtcttgaactcctgacctcaggtgatccgc

SEQ ID NO: 704684 - DNA, 296 bp, Homo sapiens
gtactcttcgcatggactgggaagttctgttaagtcgttaaatagtaagacgaccgtctcttctattagaattacagtacatgttcgagaccagtgagagcaagcctttacgccggttgagagtttccaacatcagttgattgagcttcaggctttgcaacgtttatccctgtagagatcatctttacagttccgcgggaaaatgtgaatggggtgcgtgttgttgtctttactgtatgaggacgaggaaaataaaagagagaattgagaaaatacagctcagtagaaaaaaaaaa

SEQ ID NO: 704685 - DNA, 323 bp, Homo sapiens
atcgtacggggctgggattacagacacccaccacaccccactcatttttgtatttttagtagagatgggattttaccatgttggccatgctggtcacgaactcctgacctcaggtgatccacttgcctcagcttcccaaagtgctgggattacaggcgcgagccactacacccaactacttgtatttatttactgctcctccctgcctcctacaaacagaccccaggtctgttttcttgaatgctaaactacatgaatgcttacaatgctaatctgctaaggtcctccagcctcagtgttccttatcagaaacatggggctaa

SEQ ID NO: 704686 - DNA, 767 bp, Homo sapiens
gcttcaacgtggtgtccacacgcggcagcctgcgtacccaggatatgcgtgccacccctgcacaggcaggtcctggtgatcttgtcccagctagagggcaacgccgagcttctcataatcactccaccgcctggcacatcgcaaaggcagtccaagccttcctcagtgacttggacaggcctccaatggggaccctacagcccccctgatcactgccagaggtcgcctggtcttgcatgggccccgaccgctgtgaccactcagtgacctgtgggcagtgggtctgtgacacagactggatccctgcagcactctgcgcgtcaacgcagcattcactgacgggaggagcccgtagtcgaacgtactcttgagtccagaatctcagtgtaccccggtcacgcgggagtcttggctcgacgactcctaagtggatctcaatagaatttcgactatctgggggctcgctatgacgttgcgtttgtagaaaattgccggagagttgatgcgtaatagagcttaggctgcaccaaggaacgcgtccgggcgctcgactcgaaggggacaccaatacaaaggaaccaaagcgagaccagtgatacgtcgtgtgagaactacttcgctggaaagcaactgggaaggacatcacaagggcacccttggaggatggccagcgggggaaaccatggtacggagacctccatgacaagactaggcgacaggctggagcggtatcgggaggtcagcaatcccagactccggatgcatcc

SEQ ID NO: 704687 - DNA, 619 bp, Homo sapiens
gggggaggcccctgccttttttggtttaaaaaactttacaggggcagggtctgttctgccaaaaaagggccccaagggtttcaaaccgtttaaaatttagggtgggggtgaggaattggcccctaaatcctttcaggaaagctgttctctgcccccagggaactggcaggggaaaaagggcggggggggctttctctatcgaacacccaaaaaaaagttgaaatggttgggggaaaaaactcccaaaaaaccccggggtccctggggggggaatcccacaatatcaattttttcttttgagggggacagggggggggtccctactgggttgtaaacttttgataggggttggggattgaaaccctcccaaaaggcttacaagggggcggtcccccactttctagggtttccaagaaaccccgggcttttttggcttgcccccccaaggttttttaccccttcccgggagaggtctttattttttttttccccaaaaactggcaaggacaacataggcctttgaaaaacccctttcctcccttttttcgcccagggttttcacattccccacgggggtccccacttggtttttcccccaggggtttttcccaaaaatttc

SEQ ID NO: 704688 - DNA, 113 bp, Homo sapiens
  misc_feature (91)..(91): n is a, c, g, or t
gctccaaacaggcatcgaggtgcctttggaaagccccagtgcactgtggccaggttcacattggccaagttatcatgtccatccgcaccanagctgcagaaacaaggaagcat

SEQ ID NO: 704689 - DNA, 202 bp, Homo sapiens
  misc_feature (42)..(42): n is a, c, g, or t
  misc_feature (66)..(66): n is a, c, g, or t
  misc_feature (88)..(88): n is a, c, g, or t
actgaagaatatccaaataaaccacctacagttagatttgtntctaagatgttccatccaaatgtntatgcagatggtagtatatgtntggacatacttcagaaccgttgggagtccaacctatggatgtgtcttccattctaacattccatacaagtctctttttggatggaaccccaatccccaattagttccagcaaaa

SEQ ID NO: 704690 - DNA, 134 bp, Homo sapiens
agactcttagaggatcccccgcccccacctgacagccccatcctcaaagactgtcttacttactcattgcaggttctagagactctaaggagcattatagctgcctcttcaaggccaccacattctctgtgctc

SEQ ID NO: 704691 - DNA, 398 bp, Homo sapiens
tacgttctttgaagaagattacgaaaattaacaaaccgttatccagactaaaaagagaaaatactcaaataactaaaatcagaaatgaaggaggagacataacaactgatgccacagaaataagaaatttaaaggatcataaaagactactaggaagaattatgtgccaacaaattggataacctagaagaaatgaataaattccttgaaacatacaacctactgaaactgaatcacaagaaaaaaattaaacagacctataactagtatggagattgaattaataatgaaaaaccttccaaaaaagaaaaagaacctaccaagcctacggaggttcataggtgaattctaccaaacatttaaggaaggaattatactaatactctacaaagctataa

SEQ ID NO: 704692 - DNA, 342 bp, Homo sapiens
gagatccccttagatgcctaggtccctgtgagttcactttttactgcagtaggaatgtactggagaggtgaactgctccttcggagatgatgagtgtcacgtggtgtttcaaggggatactcacgacccttgagctccacacaatggcaacaggaagtggcatgaattattacagtagtacagtacctattacagttattcttaggcagccctgatttaatactgcacctctgcactacgtttgttaacatctctctacggcgaatgctgtcatgtatggtctgtaagcgtttgcatgtagcctcttctttttagagacagggcttgctatgttatccaggc

SEQ ID NO: 704693 - DNA, 438 bp, Homo sapiens
  misc_feature (30)..(30): n is a, c, g, or t
  misc_feature (113)..(113): n is a, c, g, or t
  misc_feature (151)..(151): n is a, c, g, or t
  misc_feature (208)..(208): n is a, c, g, or t
  misc_feature (227)..(227): n is a, c, g, or t
  misc_feature (303)..(303): n is a, c, g, or t
  misc_feature (345)..(345): n is a, c, g, or t
  misc_feature (434)..(434): n is a, c, g, or t
cgaaacgtgccggagatccctgtgtacccngcctttccagcacctcctcagtacgccttgccaacctatgaaatccccgtgaaaatgcctgaaccagaaccaccacctccttncttacctgcctgaagaaaccctgcctttgacaataaancctataccagctttttgtccgtttatgttacagaatgccgcaattcagggctcttcncacttgtttgatataaaanatgttgtcttttgtttaagcatttattttcaaacactaaggagctttttgacatctgttaaacgtctttttgtttntttgttaagtcttttacattttaatagtttttgaagacaatnctaggttaaagcaagagcaaagtggccattgtttggcctttgaattggggggtgggaaggggaaagagggtacttggccacatagtttncctt

SEQ ID NO: 704694 - DNA, 92 bp, Homo sapiens
ggatttgctggtgcagtacaacttggcttaatagggacatgtgtatatatatttagagaggagagagcctctgaatgactcattctggaaaa

SEQ ID NO: 704695 - DNA, 1098 bp, Homo sapiens
gatgatcgtaggctctattcatctataagtcacaagggggtaggtgctctagtctcccgtagtctatccgtagcatgacagtcgggagagtaacgcagttgtatgcctttctaggtctatgttggatccattgcccgtactagccaggtggcgctagactcgcgttcaacctagcatttgctcttagcaggcgttcttccaacgtttaaaggcaggctccacgaacatttggactgaggatacacgtacagcacaacaggcatgaaatgtacgcacgactgcgctattggtgctatcgaatatcctcgtagtaagaatgtgtgagctgtgagtggctgcctacctttcggcacacgatcaggctgaggagagatacggatcaagaatcagactttctgtggctcataactattgaggctgcgtgcgatgaagatctctacgttactttgcgctagctcacatgaaatctccgaagacacggcgcagctgaacaagctttcagtcgacgcatacaggggcatccatgagtcagcaagtcgatgacaaaatgaagaagccagattacgatgagtcactcagccgaggtaacctgggcagattggctggccgagggacgaagggtaatcaatgtatcgtcggacctgagctcttcctggtgatgtgccttggagacgtcgtgaaggctgcctctttgtccccactatgggaccaggtgccggaggtgcccattgtgtcgcgtcgggtggtgatgacggggctacctgatgtggtcatgtctgaattgctgggttctgggctgacagtgagcaccgaattgtctatcggaaccaagccagggacaggatggtcaacacgactcgatcgactggtccgaccaccaagcggggaacgcttgattccatttgggcaattggattgaactggaacctaaccaaccaagttgctggtggcgacttcacgcaacagtttggactcgtggaaacacgcacgcattcaggtgtgaattaccggcccagattgggaaaagtttgaaggcttatgagagggtattcgcaaaaaccaatgggcgtacattccttaccctttccgggtgatccg

SEQ ID NO: 704696 - DNA, 254 bp, Homo sapiens
ccacctcagcctcccgagtagctgggactgcaggcacccgccatcatgtccggctagtttttgtatttttggtagaaacggtgtttcaccatgttgttcaggctggtcttgaactcctgacctgaagggatccacccgcctcggcctcccaaagtgctggaattacagacatgagacacggcgcccagctgcattgtacgatattaaacggcatccctggtccccacccataaatgcaagttacaccctcccaa

SEQ ID NO: 704697 - DNA, 164 bp, Homo sapiens
gggggggggggccccccccccccccccctttgggttaagttcccttggggggggggccgaaaaaaccagggggggcccgggggcccccccccccccccggggggaaacccccggggggggggcaaatttttttaaaaaaaaaaaaaaaatttttttttttttga

SEQ ID NO: 704698 - DNA, 236 bp, Homo sapiens
cgccgtctggcttttcaccgtgccgtgtgcaagcattgtactgttggccgacatggtgaagtgaagagtgagcactgcaatcaaggagagacacaggcgttcagaggaatgggacacagatgacgggcgggttggagagagcagcagagtccgagccaggcaaggcaacaagagactgattgcagtgaaacgacggagacgaaacacacgtgacgctgaagacgacgggatgcgac

SEQ ID NO: 704699 - DNA, 395 bp, Homo sapiens
tgcagaaggaggcataaaacttgcttctagttatacaagtaaaaagatggagaaaaattttgcccccatctggatcctacccagagcctcaccaacacctgatttagacacaacttcgatgatcagatttgggacttctgagctgattaaatgttgttcttgtttttttcaagatggggtctcattctgtcacctgggttcagcctccagggttgagcaatcctcctacctccacctcctgagcagctgggactacagccatgtgccaccacacctggctaatttttttttttttttttttttggaaatgggttctggctctgtcacccgggcgggagtgcttgggtgcagtctcggcccattgaaccctctgcctctggggtccaaccaagtct

SEQ ID NO: 704700 - DNA, 252 bp, Homo sapiens
  misc_feature (158)..(158): n is a, c, g, or t
  misc_feature (192)..(192): n is a, c, g, or t
ctagaggatcttgatgtcatcccccttcgtgtggcatcctgatgccctctgtgatggcgtgtgccagttccagctcacggacctccatggccatccaccaagcaccccatcgtatcaacttggcatgtacagtggtgtggaccccttccccgctcatnggatgctcctgtgtggcctccaactgaacatgtnaggagacctgtccacccacaagcatatttggtcacaggtgtctccatttcacaatgccag

SEQ ID NO: 704701 - DNA, 533 bp, Homo sapiens
cagaacacactcaatcagaaactaaggtacttgtcccaaatttcatacctatcatctagtagggactcgtctcacacagatatacttacagagtgaatatccggcggtttatgttaaatcattctgcatcagtgtgaaaaacaataggattgttttatggaggcttgcatagattccctgagcaggatttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggc

SEQ ID NO: 704702 - DNA, 443 bp, Homo sapiens
actttgaaatcatatatgtgataaggatatataaataattccaattcaccaatagaaaacccattttaaaaataagcaaaggatttgagtggacatttctccagaaaagatatacaagtttccaataaacacatgaaaagatgctcaacagggccgggtgcggtggttcacatctgtaatcccagcactttgggaggctgaggcgggcggatcaccttaagtcaggagttggagaccagcttggccaacatggtgaaaccccatctctactaaaaatatgaaacttagctggctgtgatgtcatgcgcctgtagtctcagatactcgtgaggctgaggcagaggagaattgcttgaacttgggaggtggaggttgcagtgagctgagattgtaacattgcactccagcctgggcaaaagggcaaaactccatctcaaaaaaaa

SEQ ID NO: 704703 - DNA, 158 bp, Homo sapiens
gctcagacttggctctgtgagctggggcaagcgaggcccatcccgagctgcccttgcctcctctgcacaagcggcgtgggactagatggctggttgttccactcttgagctgcaagggtttaggcttcctgagaagcccagtggggaagctagatgta

SEQ ID NO: 704704 - DNA, 371 bp, Homo sapiens
tctagcaggatcccctttcgtcgaagaacaacggctcgtcaaatccttcagcaattctaatccactttgggttttcagctgctttttacatctatagcaatttgactagaactgaattatcttctacactgtaatatcactattgtggaattacaggaattctggggatattttggtgaaataacaaaacacaataggtcctattttatacagttgtactgtgatcagtaagttttttttgtaccctttttcttctttttggagatgcttctcctccagataagggctttttcccctatttaaggagtccgcatgtttgatagatgtggcaattggcagctgttgatctttatcttcctggtaccccatgt

SEQ ID NO: 704705 - DNA, 104 bp, Homo sapiens
aatccccccccggggggcttttttcccccattttatacagggagtggataattagggacccccccctgtttccgtccttcccgtataaaaagggggtcccttta

SEQ ID NO: 704706 - DNA, 171 bp, Homo sapiens
gacttactccacagatgagctcagccccagagagagtctgacgtacaagtagcaggccaggctcaggccccaactcgccagctctcccctctggatctgcatctaagatcgatttctgtcatggaagacagattgctctgttgcactaattcactaaactgcttgttggga

SEQ ID NO: 704707 - DNA, 163 bp, Homo sapiens
gatcctcaacccactgagcaagggcaggtatcgaacccgcaacctcctggttcctggttggatttgttaaccactgagccacggcgggaactccctagttctccttttcttatccatttttatactaatcatcaatgacataagttgctatactttcgtgatg

SEQ ID NO: 704708 - DNA, 855 bp, Homo sapiens
aggcgggttgcagtcagacgtcacctgccatgtctgacatggcagtctccaacaccatcgaaccccatatctgaggacatacagactattggatctaccccggactcttaccaccccattctaggcccctgaaacccaggggagcgagggcaacgtggtaaactggggaaagccacagtgtcagtggaaccaccacgctcacaggactgcctgcgacagattcaccagaccagagacacttgtgtgcagcagcgccaagatcaagtgcagcgtgttgccatagcataccaggagtccacaaagcagctcacatatgaagaaactgcccatcgtagcctgtaattcatctacaaactgattatgaacactcagccaaggctgcggctggaatgactcaccacgtatgtagtaccttccccctggagctggacatgacccctttcatggcctccatgcacaagaagagcaggatgaatggacagtaccacgcatgcccacggacagtctcaacaaatgacaaacacaagtattccctgtaacagctgattgcaaacccatcaaggggacttggagaagtggccactactaccaacattaatccgtgcaccccaagaccaccaggtacaaagtggtgacgaatgccaatcatcaccaggccgacatcacagaccgccaaggacagcgaaagcgaactgctgctccactcacaaaccgcacctgagatacgagtagccaaacagcagaggcagaacaacaacccgccgcatggcacgcctcacaaggacccccaggccaccacaccactcaccaacacccacccacccacacgaaaaacacacacacaccagcaccaca

SEQ ID NO: 704709 - DNA, 726 bp, Homo sapiens
ctgtcgccacagtttccgtcttccggggccccccgttggccttcccccgtctttgcaagcggcccatggattcccctcccgcggaattcgtgatttccagtgcccaaaatgctggggccacacgcatcttgccctttgttacatcccgttccctcgtttttcttctggacccccggggagacaccgccggctaccccggaaatagcttcaagggatgattcgcccccctccgggaccgcctaagcgacccatggatgggagtcccgccccagagcccccccgcgtatttctggcgcccaatcttgcaagacggccaccgactcaacactcccggacgaacatctgtgctccttgaggacagagacctgcgatgtgttttttcctgccgaaaggcctggctcctcctgccgggagttctccccctgtagaccccgagcacttgccccctccatgtggcgtcccggaccacttgggcttgggtgcaggagatccgagcgcagcctttcatcctctctgtgggccccacggagaattccggtgccgagattctcaagggccgcgacatctcccgggctctctctgtgactctcccgttcgggtgagcacggtttctccccccaccctggggctgatctgcttttaggttcctccaagcggcgccccggcccgagacccctatcggaagtggggactcgaaagacccataaatcaagttccccccaacca

SEQ ID NO: 704710 - DNA, 425 bp, Homo sapiens
aacgaggcagatcttccatcgattcggagcctccagaggcttgcttgtatgtatccctcccactcctgcttacagaatgcctcagaaaatatttgtggatttgatggcagctttaatctataagaaagaaagaacaactggaatgcctttgcaaagttatgttccacccagttcccgccctcaggaagctcagggtgacacgggaagtttgggatgggcacagtttattacaaggcagaaagggaccgttgggcgctactatcctaagatattttcagaaaatggtaggccaaggataggaatatgagaaataagtttgagcttaggggccagggtaggtgtcctggagaagtggggcctgcgggatgcatcggggaggaaatgcaggacgcccctgactccctgcacattgcgggagttgagtg

SEQ ID NO: 704711 - DNA, 412 bp, Homo sapiens
ttttggtataaagagtttatgccaaaaaaacaaaatttttgaaagacatgggcccccccaacctttgcacatggggaaggtatgtctcctttttccaagagacccactctatggaggggggcttatggaaatgggctcattttaatgccccccaaggtttaatgggaaaaaaacgaacacttttttttgtaaggaaaaaacgttggccccattctaaaagctcagcttttcaatttaaaaagggttaaagtttccacagtttgggttttccaccaagagggaattttttgagccctactaataggaaaggcccctttgtgaaagaacaagtctttttaaggataacttggtgcttaagaaaaagatgggccctctgattgggccatttgctatgacaggtatattgggggat

SEQ ID NO: 704712 - DNA, 197 bp, Homo sapiens
atcagctcgcgagcagggaggaactgtggccccgttatatggactcggggcctatatcagtcaaacttaatcttgagtggggttgatatggaggagaaggggggataggtgtatgaacatgagggtgttttctcgtgtgaactgagggtttttcttggtttttggtttttgtttcttcaaagactcggcacgtgaga

SEQ ID NO: 704713 - DNA, 492 bp, Homo sapiens
tattccacaggaatattttttatttttcctttttttggtttggaactacacacggtaaaactaaaggtatggattttatttggtttggtttttttaacagaagcttggatatcagcggcagatcactcaatactgggccgagacaaatctacttgggccggaagcagctctagatgagcctctgggctagatttagtccctccttattagtgttgggcgattcaggccaggtcatagggcctttcagacaaaagggtcctaatcccagtcaggcgggccaaaacattaacttgggatttctaacccggctacagcatcttctagaagggcagcaagatattatggtgggcagtgcacagataacatcagggtagactggactgggagaaaaccaaatcctgcgctggttccggtgtgcccccatccagcggtgcttgcacacacgggacacctttctagtatgaagaactggcatcatggtcggccctctat

SEQ ID NO: 704714 - DNA, 166 bp, Homo sapiens
gtggctacctcactgagcatttcgacctggccgaattgcgggatcaatcggcggatatgtacgtgtgcgggccgccaccaatggtcgaatccatcaaacaatggctgctggatcaggcacttgatggcgttcagctgtattacgaaaagtttaccgagagtaatat

SEQ ID NO: 704715 - DNA, 177 bp, Homo sapiens
  misc_feature (7)..(7): n is a, c, g, or t
  misc_feature (18)..(18): n is a, c, g, or t
aaaatgnaaattgtcccnattggattcttaaccttgatgcagagatacttcaggatcatcacaaacagcttatgcaaataaagcatgagctgttgggatcccaactcagagtagcctctttgcaagacatgtctttgccactacttggtgaatgctgagggacagactgtttaggga

SEQ ID NO: 704716 - DNA, 135 bp, Homo sapiens
gctcgacagccctgctgcgcttgcccggagactcgagaggcgcgcgatgctgtaatcatcgagaaaggagaagaacactgtggacatcagtttgaggcccacaaggaatgaatgagagccctaggatttaaaata

SEQ ID NO: 704717 - DNA, 351 bp, Homo sapiens
  misc_feature (226)..(226): n is a, c, g, or t
agttaaccgaagaggggggtcgaggagagccgggagtcgggggacccagggaggtttctgttgtccagcgctgccggagccggcttaagttgggaggtacaggtggtattaatcttgggcttgctgcaacttctgcttcccgggttcaaggtaattcttcctgcctagctttccaaggaagctgcattacagatggaggtcttgctcttttgcccaggccttagancaggtggtgttatctgggctcactgcaacgctccgcctccagggtaccagcacccatcagaaactcctgaggtgccagctttagtaactagcatacaaaagaacctaccattctaggatcttaga

SEQ ID NO: 704718 - DNA, 128 bp, Homo sapiens
gaccaggttacacaggcaggcatggaacgaggcagctcacaatcttttttgttcccgtctttttcatttcaatcaaagcgatgtcactttcggctaagtgcctgcattgtagttcttcatggaaaata

SEQ ID NO: 704719 - DNA, 218 bp, Homo sapiens
gtgactcgactaagagaattaaccagaactttacagactagcatggcaaagcttctctccgatctgagtgtggacagcgctcgctgcaagcctgggaatagccttacgaaatcactcttgaacattcatgattaacatctgcaacatgagccatctactgctcacacttacataatgagctatccaaattagtaagaaacatgctacagcattacaca

SEQ ID NO: 704720 - DNA, 722 bp, Homo sapiens
agtgagttaaagaaacttaagatggaggagaccctaaggagtcatgtaagttaaatgatcacccagtggagagtacacttcacagtgggaataagctctgcccattttttttcctaggtgctaattcaggaaagcatgctcactcttagtgatccttttcttcatgttgagatgaaatgtgtcttcagaattgttcttagttgttcttggttgtgcaggcaactggacagaactcagtccccctttaaatgctctccacatggtaaagacagctcttatgtatcttgttctcagtttccaaggcttgaataggttcatgtaaagtcatcaccacttcctcaaaaggaaattaacaaaaaaaaattttaattcagacgtcttgcagataacgtggcaattgtaatgagaatagcacagcagagaaaataaattttgtgactctgtttttcactgatttgtagtacctggtgatacttaagtgtcctcttttccctccccaggtggaggtatttttgttgaaaagtaaagagcctcatataatacagagctttccccctctgctgataactctcacaaacacttagcatatgtccatccatagtttcctattaaaacacactttgggggtatgtggtgtaggaatatgtgccatttttcatggtcttccctcccgtcttcacattctacagttcacagcagaattgtcttttcaagtccatctc

SEQ ID NO: 704721 - DNA, 945 bp, Homo sapiens
  misc_feature (1)..(1): n is a, c, g, or t
ncggctgcccgccgggggtggtttaatacaagacgacccgttttgtggagaccgcccgcgtgtgccttgggggcgacaccaacgaaccccctgtggtggcccccccgctaaagaacacccggggggcgctctctacacctcctcccgggcgttttttctctttgagtcccgcgcgggggggatgaaagtccattatctcccaccacggcggaacagcccgtctgtgcctcccttggccgccttttttgggggcgcacaaccatttgagagcacagcgtgttgttgcgcaacgaacagacgcacgcggctggtggttcctcgcgctcgccggtgatgtatctcgcggggagtatttgttttgccccccccagccgctccggcgtggcgctctacatcgcaccgcccgcggagtatggtgggtctcgctttgtttatggagaggaggctccgcgcccccctcctcccgcctggttgttcctccctggtgtgccgcccgcgccgccggggagaatagtgtttgtggccgccgccccccgtcggcgctcccacccgtggagcgatcttctcccggtggtgtctcgaggcgacaacacgaacgcccgcggttgttgtgtgcgccccccggggcggggcgctcgagttggtcgccctccagaggagtgtttttttcctcgtctcacccccccctctggtgagaggttgttttttgattccctctccgtcgcgggaggacccccactctggttgtctttgtttgaggggtcaccccaccgcgggtcgttgttactcccaccgcgtgtgggtgttcttcgcggcgcccgcctccttcccccccccccaaacggggggcccccccccaaaattttgggggggtttctccccccccttttttttttttttggggggggaaagaggggttccccaaaaaggttttttcccccccca

SEQ ID NO: 704722 - DNA, 726 bp, Homo sapiens
gagggctgaagaggagcgttgcgcaagcgcacccaagacggtcacaggtaactcccatctgacgagcgagggtcgccgtcgtcgcggaaattgtggtgttgtgcgccgcgggggaggcggcggccgcagcagaagcagctgagtgtctccctgatacccggatgtgaggcgatccgctggcgctagtctgaccctccgccaggcaaaaagggaacgatgggtctgtgggctatagagtttttttttaaaaagattactaaacttacagggacagtgatacaggaagtatcaattcattcagaaggcatcatttcatcaactcactctgtgaagaaacagcggtggatcatattagatttcttaaaagggtgctggggtgatgtggtaaaagagacatattagaaaggaagtgcgttggtcataatttcctccatgagttagtggtggctgagacatcgagtcatatattgggggggcaaaaactaaagggggcaccaaagaggagattctatattactgagaatattgtggtggacacaaaaggagggttagataaagaaggtgaaaccaagagaactcagcaaaccagggaaagaaagtgttagcataagaaatgtttcaaggtgattcgaagtccaatagtgtggactccagaagacaaaagtttcaaaaattttttcaaaacgaggtccattgattaaataattctccagtatagaagtaggc

SEQ ID NO: 704723 - DNA, 198 bp, Homo sapiens
tctcagagagcctgtgcgtcacggtcacagaccggctggtggcactatctactcacagtctatgcctcactacagctccgcagcgatgacatctggatgtgctgactctggtgcccagaagatgttgcaggacagtcagaaacagaggtctgcccacatccccatcactccctttcccaacttcccagcccgagccgg

SEQ ID NO: 704724 - DNA, 668 bp, Homo sapiens
tagttcagcttttggggacgctctcagttctcagcgcatggcccagctaatccttcaaaatagtctattgttcactaaatcctgtgcaagcatcatgggttggaggtgtgatcagcgtcttacaatcctccacgaagtgcatatgggtctgtaaaagcctatactagctttgatagctcgacgcgggcactgctttgcacccattgaaacagccatcaagagcgaaaggtgtggcatgagcgtcaccattgtccaagaatttatccgacccaatcgcgggtaaattgggccacgatgcacgagggcataatatgccatcacagcctaacccaggaagaaagtggacgcagacaaagatgtgcaaccgtttgcattcaattcgcccttggacagtcctaggccttaatcattgtgccaagcccgtgtcagacacggctagcagtgattcggggccctcattgaaagaactacccctggctcacgattaatggaccggcgttcttggcagctaaaaagtcttcccagttgacaggggggcgtgttgaaaccccgaacgaagggacgtcctctgccatttgagaattcaagtcatgctcacaagaaaaccaaaccatgtgcggctgcatgcgcacaatttacacaagagtgatacctacgtgaacttggtc

SEQ ID NO: 704725 - DNA, 150 bp, Homo sapiens
aggatcccccccgaagatgctgactcttgagaatcagcaaacacccagaacaggccttaatgacctcataggcactctatccaaaaagacaacagtaactggactagagaggcctgggtctagtctccatgccttagcagagccatatca

SEQ ID NO: 704726 - DNA, 128 bp, Homo sapiens
ttccgacagcattatctgagagcggctacattacccttctgctatggaaactcagcacattgaactgggttgattcagtattaacagatctgactacactaattctttatattatagaaccaacggaa

SEQ ID NO: 704727 - DNA, 1021 bp, Homo sapiens
  misc_feature (427)..(427): n is a, c, g, or t
  misc_feature (429)..(429): n is a, c, g, or t
  misc_feature (519)..(519): n is a, c, g, or t
  misc_feature (539)..(540): n is a, c, g, or t
  misc_feature (550)..(550): n is a, c, g, or t
  misc_feature (557)..(558): n is a, c, g, or t
  misc_feature (577)..(577): n is a, c, g, or t
  misc_feature (598)..(598): n is a, c, g, or t
  misc_feature (604)..(604): n is a, c, g, or t
  misc_feature (615)..(616): n is a, c, g, or t
  misc_feature (663)..(663): n is a, c, g, or t
  misc_feature (678)..(679): n is a, c, g, or t
ggggatatattgtgcccggaagtgcggtctgtcaatatgcgggacatgttgttgttgtcatgagcgcgcgaattttgtgtcgacccgtggtggactctgcgtgtaatatttctctgggcgggtttgttggagcccgagggttcgccccccgccttgggccttgagcaagcgcaaatgatgtctcaaggaagtcggtaagttttgttcccggatatgggcatcttgcaaactggtactgtgatggtgttcttactcgggaactggctgaaaatggctaactctggaactgagggtcgagttactcccttaccagggccaggaatccttatgcgtagccaccaggacatcaggatgttcttggtgagaaggccgcggattcgggaactgactctgtagttcagaagaggtttggctttcccgagggcantntagagctttatgctgaaaaggtggcccctagaggtctgtgtgcccttgccccggcagagtctctgcgttaccaactcctaggagggcttnctgttgcggagggcctgctnntggtgtgctncggttcnntcatggagagtggggcccnaggctgcgaggttgtggtgtntggganaactccgaggnncacgagggcttaatccctgaagtttgtggatggcctgatgatccccngcggaggaccctgtnnactactacgttgacactgctgtggcgccaccgtgttgctcagaacacgggtgtgctgggcatcaaggtgaagatcatgctgccctgggagcccaactggtaagattggccctaagaagcccctgcctgaccacgtgagcattgtgggacccaaagatgagatactgccccccacccccatttcagaacagaagggtgggaagccagagccgcctgccatgccccagccagtccccacagcataacagggtctccttggcagctgtattctggagtctggatgttgctctctaaagacctttaataaaattttgtacaaagaccaaaaaataaaatgacaaaa

SEQ ID NO: 704728 - DNA, 391 bp, Homo sapiens
gttattattattttgagacagggtcacactctgtcacttaggctggagtgcagtggcgtcatcttggctcactgcaatctccgcctcccaggttggagcaattctcctgcctcagcctccctagtagctgggactataggtgcctgccaccacacccagctaatttttgtattttgagtagagacagggtttcaccatgttggctaggctggtctcaagctcctgaccttaggtgatccacccaccttggcctcctaaagtggtaggattacaggtgtaagtaagccactgtgtctggtctccttggcagctgtattctggagtctggatgttgctctctaaagacctttaataaaattttgtacaaagaccaaaaaataaaatgacaaaa

SEQ ID NO: 704729 - DNA, 179 bp, Homo sapiens
caaaattggggcctggggaaaataccaaaattttccgggggggggggggggcccctgtttttcccggttcttgggggggtggggccaacccctcccttttccccggggggggggggtttccgtttgttggggttgcccccctgcccccccgcttggggccccgagcggccccctttcca

SEQ ID NO: 704730 - DNA, 294 bp, Homo sapiens
agaatgtagcggtagggtcggcaggctattggtgaatgataggtgatggtgcgataatagtagtatggggataaggggtgtaggtgtgccttgtggtaggaagtgggctagggcatttttaatcttagagcgaaaggctataatcactgcgcccgctcatatggggatggccatggttagatttatagatagtcgggtggtcggggtaaattgagtgaggcaggagtccgatggaggttagctgtggcaataacaatgattaaggatactagtataagagatcagggttcgtcc

SEQ ID NO: 704731 - DNA, 166 bp, Homo sapiens
  misc_feature (12)..(12): n is a, c, g, or t
  misc_feature (15)..(15): n is a, c, g, or t
  misc_feature (27)..(27): n is a, c, g, or t
  misc_feature (149)..(149): n is a, c, g, or t
acaagaacaacngcngccctgcgccanggccaagcaggagatgatggaataccgacaccagatccagtcctacacctgcaagattgacgccctcaagggcactaacgattccttgatgaggcagatgcgggatttggaggaccgatttnccagtaaggccagtggc

SEQ ID NO: 704732 - DNA, 190 bp, Homo sapiens
  misc_feature (71)..(71): n is a, c, g, or t
  misc_feature (73)..(73): n is a, c, g, or t
  misc_feature (78)..(78): n is a, c, g, or t
aagaagccttcagttgtatcgaccagaatcgtgatggcatcatttgcaaggcagacctcagggagacctantnccagntggggaaggtgagtttcccagaggaggagttggacggatgttgtaagagggaagggcccataaattaacggtttttgtacgttttttggggagaagttaatgggacagacac

SEQ ID NO: 704733 - DNA, 627 bp, Homo sapiens
cacaaagagaaatcatatcatcccttacttaataaaggtcccattagggtaagagaccccaacaagtacatgaataaccacaatcatgagacatatttctacaacgttgggggaaaagaagaagatcccagttatagtacagagtgttggtaaaacccagaaaagaaattcaattaagtatattgaaaatagttttgtgctgcaaatctcgctccaatttttataatggaagttaaccagaaaataggacaggctataaagacgctggttttgtggttctttttcctaaaatgcatccgtttctaaaaaagcaggagagagcaggcattctgatgagaacgtgcgttgatttaatccaacccctggattatagcttaactacacttagtgtgggccaaaatatctttttccttgtaggcctggtcctctgcaggactaggggcagagagctacccaaaagcataaacatcatcacttgagattccaaaaggctatgggagcccccaacttcttcatacagagaggcaagagccatgatatttcagcattcccggcccttcttgcactttgctccctcaaccccgttttcttccataatatcccaaccgccttctcttacaagaacga

SEQ ID NO: 704734 - DNA, 501 bp, Homo sapiens
cgagtggtccctgcatgatatgtgaggtgctacaacttgaatgagggagtaagtagtttaaataccaggcctggtttcaggatactactcaaacaggaaactccaaactgtaatttggttagttatcttccactcccagcctccaccccctccaaaaaacaccaagactgtcaactctgtgacgtgctttcctaatggcctgtagctacatgactcaaagaaaaaggtgttttctttggaacacacaattgtaaaactatacccagcatcctacaccctgatttctggcaaacaaaggaaaactacctttttttttttttttccactcatagaaaacagaatggggccataggccatttaaaatgccataactagtttaaacagaaacaacagtctatccaattgtgactgcttgcctatttgtcctctgtcaattgggaaattagagggagctttttataaaatcagatgctgagaacaaagatttttgtgcagaatggg

SEQ ID NO: 704735 - DNA, 995 bp, Homo sapiens
cacaacactaggctaggtcgaggctcgtgttaatcggcaccgagggacagcctggacacacagactccagcctgcttcagtgacaatgtggccttcgtgctgtgcctggacaccgtgttccgtggcagcttagcctgcacctgctcgtgtcaagccgcctcgggagggcaccctgcagtacgccttcctgcgggagctggagacggtggccgcgcaccagttccctgaggtacggttctccatggtgcgcaatgcggatcagcctggcggagtgacgtgctgtgcctgggtaagcacgagcgcttcgcctatcctgtcgagcgtgccgccttctacgcctgtcccacctggagagccaccgtgacggcagcgcaggcacgcatcatggacgtgcggtcccgggtggattctaagaccctgatccgtaacctacgaggtatcttgctagggcctgtactcgagtctatctacaagctgacagtagataggggacacccccagaccatgccggtgttcaacagtagctatatggccagataccagctagggagctagttggactcggtgcatggacgtggttcaccaacctaagccgtgggcctgcgcaacgcttgtggacggggtcagcgagcttcctcagcacggttgagcaaccacctgagccggtacctgaaggacgtgagagcagccctacgtcagtgctgtaacactcgggcagccagagtttgttcttctagacctgctttaagtcaagtggttgcaatggccttccgagtccaggccgggcgccctttgggcctggctccgtggctgatgggcttgcttgcctacctcgggatggccaaaggtgggttttccagaacttttagcttcctcttaagaaaccgcccaaggctgtcctggtaaggccgaagaagtgttcggtgcccccccgggaagcccgggtcaaactcctggcggcccattttttattcccccggggcctcaaaggagcc

SEQ ID NO: 704736 - DNA, 280 bp, Homo sapiens
gccggtaccatccataatgtgtgccaggctggctcgaactcctgggctcaaagcagtcctcctgccttggcctcccaaagtatgggattacaggtgtgagccacctgtatttttttttggtagagacaggatttggtcatgttgcccaggcgggtcttgaacccctgggctcagagcagtcggcctgccttggcctcccaaagtgctaggactaccggcgggagtgagctacctcaccgggcctctcatagactttaatatgctaatagacattatggag

SEQ ID NO: 704737 - DNA, 410 bp, Homo sapiens
gggagccacagaagccttggtctgtgatctctttgatggtggcacactgtgccatgtgttcccgtgcatcagagcttgcagccagcttgaggtccgcggtacgcatcactctctggggtggcttgggcccacacaggaaggtcacacatagcctgttcaagtagctcatgtccacgttgtagaagttgtgcacgtcctcacttgtggtatccggtttgttgccatagttgcacagctcatccgacgcggatatggaaaatgggcttgctccgggcattggccatccccagcagccagcagagggaggcccagagctgtcacatggtgaacgccggctcctagatccccacagcgctgcagcagagagcctacagcacagtgtgcgcacagcggagcggttggcgttgccg

SEQ ID NO: 704738 - DNA, 408 bp, Homo sapiens
cctgagctgcatcaggtggctagattctgagagggaggcatcccaaaacatgcatcctacagtatgaaagctgccagtctcttacggtttgaccctgaaattagaacacatcacttcctctgcattctattagccaaagcagtcacggatcagcccagattgaaggagaggggacataggccccagctttcaatgaaaggaatgtcaagccaggcacgatggctcacacctgtaatcccagcacttagggaggccgaggtaggcagatcacgttcaggtcaggagtttgagatcagcctggccaacatggtgaaaccccatctctactaaaaataccaaaattagccaggcgtggtgtgtacatgctactggagaggctgaggcatgagaatcgcttgaacccgggag

SEQ ID NO: 704739 - DNA, 124 bp, Homo sapiens
ctgcgtggtgggcgtgataaggggggcctgacacccgtgtatgggagcagaaacccattggagagcgaggctcgggatctggtggcctgccccgatttggcatgtaatgggcacctgctgcctg

SEQ ID NO: 704740 - DNA, 276 bp, Homo sapiens
ttaaaaaaaaaaaattttatcccattggcttgttttggaaagacatttctttggcccccaaaaaaacctaaaaaatttccttcccctagggccgggacagttaatcttttttgcccccatcttgaacccaaaatgggtttttggaatatttgtataaccgtgtaaaataaaaaaggaattttgtggcccgggcattgttttttaaactggaaaccatgttgttttaaaagttaataatggaaccccttttaaaattggataaaatttaaaataata

SEQ ID NO: 704741 - DNA, 382 bp, Homo sapiens
gcgttccggatacttgcaagccccgcggcactccccacagccgcaagtcacgccaccactacgggctgcacggcctgacagctggcccgcgccagcgctcacctctcggtctgatctgagcctatgcactgacccaccacatggcttctcacagtccctgacccccattcaccgctggcgaagatccctggcgatgcggtccactggctgcagtggacacttcttcacttggctctggaagccgcggtggtagagaagaaaagcctcagggtcttcctggaagagacgctgtgcagcactggtgggccctgagtacaactgtacattgaggtagcaaaatcgggccccatccagccgctgtgccatgagggctcgaaaagac

SEQ ID NO: 704742 - DNA, 147 bp, Homo sapiens
tggaaacagagtctcgctctgtcgcccaggctgaagtgcagtggcgcgatcttggcccactgcaagctccatcccccaggttcacgccattctcctgcctcaaaaaaaaatttagatcgttatccacgtgaaggttatgtggtacca

SEQ ID NO: 704743 - DNA, 329 bp, Homo sapiens
gacggctggtcaaagtctcagtatttggagggattttattgaatagaatgaaagttatcaacacaaatcataccataattttttatctaggatagaggttctcaaccttgttactgtggaggaacacataaccaagctgtttaacccaaagcttgtagaattataatgaaaactaaagccaagaacataagataatgtttaacagaatagaatatcaaaattaatgcttacgtatgtggatgctgtgtttgtatatgcacaattctcttctctgaaaaatttccccctcaaatggtggtgatttctccatatttaccttgatatttgat

SEQ ID NO: 704744 - DNA, 132 bp, Homo sapiens
atctatgcccgtcggcgggctaaggtcggctgggtcctctggggaggcaggctgtgcccattgcctggggctagtatggcaacaattgtgttgggtagtcttggccttgccagctcaggccctcaagtcgcc

SEQ ID NO: 704745 - DNA, 222 bp, Homo sapiens
gacgccgccgagttcgcgcgagggcaggcgctctgggtgcgttcaagattcagcttcacccgtaacccaccgccatggccgaggaaggcattgatgctggaggtgtactccccgtcactcctgctttacaagaggttctgaagactgccctcatccacgatggcctagcacgtggaaatctcgcacgttcccaaaacccttaaaaaagcccaacccatcttt

SEQ ID NO: 704746 - DNA, 230 bp, Homo sapiens
aacaaaaagaagccagaggaagaaggcagttctcatcaagatactgctgaaaagaatgcaccttccccagagaaagcgaagggtagacatactgtgccttgtatgccacctccaaagcgaagttttcttaaaaagtcctgaggggccagagctggagaagagtatgaaaatgccgcaagaggtggtggagatccggaaaaagattgaggtgttcaagaaactttcttggc

SEQ ID NO: 704747 - DNA, 405 bp, Homo sapiens
aaggggctttaaaataaatctgacggccggttttggtgtctcacacctgtaatcccagcactttgggaggccgaggcgggtggatcacaaggtcaggagattgagaccatcctggctaacacagtgaaaccccgtctccactaaaaatacacacggaaaattagctgggcatggtggtgagtgcctgtaatcccagctactcgggaggctgaggcaggagaatggcttgaaccagggaggtggaggctgcagtgagctgagatcacgccactgcactccagactagcgacagagcgagacaacgtctcaaaaaaagtaaaaaagaggccagcttctagagtcccaagtctcgtcttctgccgctgaaatcactaaatggtcagactataaaatcaaaattcagat

SEQ ID NO: 704748 - DNA, 116 bp, Homo sapiens
  misc_feature (4)..(4): n is a, c, g, or t
  misc_feature (6)..(6): n is a, c, g, or t
  misc_feature (112)..(112): n is a, c, g, or t
aagncngtgatctgtctgaaaacatacaatcgaagtaaccaaagcaaaaccttaaggtacaaccgttagggtttgttggttttttttttctgggagacggattgagaccctntctc

SEQ ID NO: 704749 - DNA, 152 bp, Homo sapiens
ttgtcatacccccgatacagcgagcaggtatgaacaacagtgcaggtatgaacaacagtgcaggtataacaacagtacaggtattaacaacagtgcaggtattaacaacagtgcaggtataaacaacagtgcaggtatgacacaacagtgca

SEQ ID NO: 704750 - DNA, 464 bp, Homo sapiens
caatagtagagagcgcgcacataaatgcgataatgaacccgagaaggggagaagcttgggaaatatatacaaaagagagacatacaaagaaatgcaaacaccaaatactgggaaacaggtacttatacaaaagccgcagaggcagaagtaattaacaccatagaacacggcagggggcagcgtttaactgagagtagaataacaaacacaatgataaggacaaaaacagtgctagggatgggacaggaaagagcgcaagcaaatgatggttaggacggactagcaagggaaacggaattaaccggaaagatcagagaacagaatgtacgcgaagacggcccgtgggacaaggataaaacaaattgcgggggcaaccctaaatttggctgcaatagaagtttccaatgcggaactaatgattgggggatgatacgaccagagcgaccgattagcattaaaatgaa

SEQ ID NO: 704751 - DNA, 391 bp, Homo sapiens
accttagagtacagatgggtgtgccttacactgagcaaatcatacagacttacctcaaacatgtattaccagagagcagttaagccgagagcatacctccacgatggcagcacaggctgccgggtggtggaggaagtaactgaagatacctgcaggtggtggtccaaggagccaggccaaggtgtacatgcgcttcctccccaggatcatcgccctgtgcatggagcaagtgtatcccaatacattgcctgagcgtccctcccctgatgtgaaggccgagctgatagagctccttttccggacgctccatcacaactggaggtacttcttcaagtacaccgtgctggccagtgtacagagggggatcgctgaagagcagatggagaatgag

SEQ ID NO: 704752 - DNA, 172 bp, Homo sapiens
gtaccgtactagcattgatttaaaaataaataaggcaattccaattgtcctttttttttttaaaatcaatgcttactagtttggtaggattcccaggtcagcagcagggttgattaaataatcttgacaatgagcagctgccatctgtgggggatttcattctataggttgt

SEQ ID NO: 704753 - DNA, 901 bp, Homo sapiens
gtgactgcgtgtcctgtgcatgcccatctgctgtgggtcctcagccttctctgctgggttacacgacgagattatcctgtctaatctactgtatattcgtgaccgggttgcatgatatcactgactgaagctttggctgtggcaactacttagtcaagaaaggtctacggtaggtacagcacgttgcactgttggtggcgagtacattgactgatggcacattcgttctgattgatccaccgagggtacctagtcttaagcaccagggatagtggatcctcgtgtgattaacttctgactgattactagaagaccatgggatagtctaagtagttagaagaagaactagatgatataaatagggaaacaaaagggtgggtcgcgaaggagtgcatcccccatgacctctggaacaagagcggatggtacccaagaatgcaaatccctcattgatccccacaagccgcggcccacaaaccacggctcccgtttgggtatgagcgtacccgggatgggcggcttggcggtgctttggggttggcacatggcttgcgttccctggtgagccatattcagccgctacgcaggtcgtcgcggcccttggggacagggtacaaccgcttggtgtgttcactcgccgtgggactatgcttgccttgttccctaaataccaagcccttcatcaccaagtctttgtccaacgcccgtgtggtagtaggaccaacacctggagcaaagtgaggggcgcggtggcacaccaggcgcatacgcccccaagccataatttgacacccagggtttaagccaacacaccaaccccggtcccaaagacggggggctaccccttggctagcggcccacagggtgttcccccccaacgccgtcacccctgtttatacgg

SEQ ID NO: 704754 - DNA, 516 bp, Homo sapiens
  misc_feature (31)..(33): n is a, c, g, or t
  misc_feature (35)..(37): n is a, c, g, or t
  misc_feature (40)..(40): n is a, c, g, or t
tgtattacgcctgagaagtacttatcatctnnncnnngcncccatccttccctatctcacggtccatatgggcgaggctgccactctgcctcctgcttgccttggtgccagctctgccacagagggccaggccccagaactggagcttagagccctctcccagacagccaaagccactgaggtggaccacacgggcgacagtggcctcacagcactcacgggcacctgcattctctgtcactgctgtgctctctctcctcaaagtgggtgctcagtccccttgtcaagaaatgtaggggttctacaagaagagcttggtgagatgtagggactggggtttatggcaggtagggtatgtgtgtttgtgaaggtgtccctgagagagactgcaattcctgcctgcatatgactacacacgcgaatggataacgtattaacagtctgtgtgtgtagactaggaatgtgtgtgagagagggaagatcgtgagagagggaagatcgtagagagggaaggat

SEQ ID NO: 704755 - DNA, 126 bp, Homo sapiens
cccttcatatggtctccagaaccaagtcacttctcaccaccggccccaccatccttcagccctacccatccatctttacctctcaccggggataagtggcaccgagcggcctctcctcttccagtt

SEQ ID NO: 704756 - DNA, 251 bp, Homo sapiens
tctagaggatcctatccccggatctgggtagctggaactacagtgagcatgccaccatgcctggcttaatttttgtatttttagtagagacggggtttcaccatgttggctaggctggtctcaaactcctaacctcaggtgatccacccgccttggcctctcaaagtgcgggcattacaggcatgagccaccgcacctggccagaattttatttttttatttttatttttcgaaacacagtctcattctgt

SEQ ID NO: 704757 - DNA, 124 bp, Homo sapiens
tcgcagttccactcacctcttccggactcaagatcctcagtatcaaaggcagttctggagttgagctccaggatttcacccctgacttaaagacccgcctacgcaccctttacgccgatgcggg

SEQ ID NO: 704758 - DNA, 308 bp, Homo sapiens
tctatttaatggttttcagactccaagacattagcttgtcattaagtaaatattcaaaaacgaaagtctttaagatagttttctttaagatacacttccaaaacttaagggctagtttaatgcaaattgcttctcggtatatgtgaagtacttttaattaaacattttttaaagtagattgactttttgtactatattttaagactttatagacatttatgcatcatttaaaaatgactgtagactgtatttataatagtatatgggttgttctcaggcctagcctcttagaagagaaataatagaac

SEQ ID NO: 704759 - DNA, 106 bp, Homo sapiens
tgggattcaactctgaatctttttagtatgtcccatatgtcatgtccatgattttaatagatatcttctatattaagttctagcatttatttcattaaagtgctgt

SEQ ID NO: 704760 - DNA, 922 bp, Homo sapiens
  misc_feature (879)..(879): n is a, c, g, or t
cctagtaggtcacgggaagatgtgcttcggagaggaagcatgtcttaaatctggaaatgatatgaagagggatgtcagcaacacttgatactgggccactaatagggagagtttctttcatctggtcaaactgctcaatggattctaccctttctcctggcgcggacacctcctttcgcaaccctccaacctctgtgctcactcgaaacctacccactcctcccaccctccgttttttttgaggaaagttgaagtcttttttatctttttttaatcactatttacatcatcgctcccttcgctattcttcatattgcgctactgcatttaattatattctatacccccgtctcatcttacaccctctcccctctcatgctttcctgcgcacccccccccccatctccactgcctcgtacccctcacttcatcgtgcttggttagcagcgcatcaaccttgtttgctccctatatactcgccgctgtattctcgtcttgcgagttctagtgctttgctcgtaccttgcttcttttctttacccgttgtctctccctctgtcctattccgctgacagctgcgctgtcgatgttgtagttctctctcttctcaagactactcgctgtttcgtacgctcatcgaaagcacgtttctctctctgttccgtatatcatcatagagggtccacaaccccccgacacgcacctctcaatcgacccaagtccacattaactctacgccacgatcaaacgactcgatcgcatcacatctcgccacatcctgaagtgtccatgtctaccttccccgccaccgtgttcgcttgcacctcatatatctctttagtgtccttaattgataatgaatgatttacaatgtaaaanacgcacattcaacattttactatcaccactccctcgctcccct

SEQ ID NO: 704761 - DNA, 691 bp, Homo sapiens
acagccgtcagcttaaactgtggaatgtagggaaccctactgcctacgttccttccagggtcatatccatgcaaaaaactttgtagcctggcttcccatggagattatatagcttgtggaagtgaaatatactctctctaccctgtactataaaggactttctaagactttgctaacattttaagtcttgataccagtccaaaagtgttctcgaccaagacccgaaagaagatgataccaatgaatttgttagtgctgtgtgctggagggccacatacccagatggggagtcccatgtgctgattgctgctacaccaggatccgggtcacccattaaggtgctagaattggtatgaagggttaactccagtccaattgtacttgatcctcgctgaaatacaactctgcacgctgaccatgagagaagcaacccgaaaatgtcactgtgatgtctctcccccaagtcatccactgggttttggatttgttttgaatatttttttctgttttgttcttttcccctcccttatgaccccttgggaccttgggaataccccgcccactctcccccatccatgttactccctggaccttgctgctcttggtggtgttatctaatttttgtgatagggaaaccaattcttttgaataaaaattaataaccaaaccattaaagtttattgagccccca

SEQ ID NO: 704762 - DNA, 366 bp, Homo sapiens
  misc_feature (6)..(6): n is a, c, g, or t
ctgacnagaggttcccagttccttctctaactttctctgttaggattctgaattccttctgtgtgttatctgaatttcttgagtttccttaaaacggctattttaaattctctatctgaaaggtcacatatctcagtccttccaggcttggtccctggtgcctcatttggtttagtgaagtcatgttttcctggattctcttgatgcttgtggatgttcattggtgtctgagcattgaagagttaggtattcgttgtagtgttcagagtctgtgcttgtttttgcccacctttcttggaaaggctttccaaggtatccgaagggacttgggtcgttgagaactaactggtcactgcaaccatatct

SEQ ID NO: 704763 - DNA, 1506 bp, Homo sapiens
  misc_feature (963)..(963): n is a, c, g, or t
ccgatgtcagttctgacttcttgctgtctcactggtctgtgtcaaacttgctttgtgccagcacattgtgttggtgcacatatgatgtggtgcggctcccctgttgtgtacaccaggctgcctggtgttgtatccgcccgcccctcatttaattgccgtttctctatgtagtgcaggccatcctgggttggagtataatttggcgcgcaggtggtcctcccccccctccctcaaggtctcccgaaggtagaatattgtgcccctccactgtaaaaaaagaagggggggtcttcccggccccaccctcgtttctggtgaatgatacctacggagggtcttataagaaaaattaggggagaaacaccacccgcggttgtggggaaaaaagggtgctcttaagagaattttgtggggcccatgtgggaccacgggatctattcccccggctcgccttatttgggaggcgcccttcccccccccgcgccttttggtggggacaaattggccccccccgcttatataatccacgggttgtgtcccgccgggtcctcggagtatgcccctttccctctctatttatagccgggtgctgtagaaaggtggccccctcccttgtcggagtttataccccacaggtggcaccccccacagagcccccctgggagcccccgcccccaaacaaagcttatactcacagcgtgtcgttatataagcctgggcccaccaaccacacagtgatcacagacgctcacagagagacccccacacgccacacaggagagagatagaaacccccagagagaccctggttggcacccggggcccgagagagaagagaaggcgctgtcgtgcgcacaaaaggggaaaccgtctcccccaccagagaagagagagccccacccctggtccctttctcgagcgacacagagagagtttaaacacacccggtctaacaccaccctntgtggtgtggagagacaccccagagtaagacctctcagacctgtggtgtggtgtaattgcgcaccccgcacacgtgtggatctccccagtctggagacctgggttggtctcttctgttgccctgtcccctgttgttctggtaaaatagtggggtctcccttaactgccatttatcccagaggaaagagccaagaacatgggacagttttagatcccaccagaggaagaaccctgccaccccctttctcgcccttctcacacacacagagtgtaacatctgggaagaacccaaagagccgctttggctaagactggtggaaactatccaggaccccattcacccatgcaccagataaccgatgagatccccccgtccactggggtggccaatagtccctgggtccctaagtctgtggcgtctcgtatctcgcccagctcgagaaaggccaagggctaaagaacttgcccctaaactgggtttaatgtaccctgttgagttttctgtaccataaaaataattgaaataataccaattttcccttc

SEQ ID NO: 704764 - DNA, 344 bp, Homo sapiens
tatgagatagggttggtgcttgctcaggctggtctcaaacttctgaggcttaagcaatccatttgcattggcctccaaagtgttaggattacaggcatgagccactgctcctggctccttttacatttctcctttccttgtcctactctctggctcagactggagtgcagtggcgccatctcagttcactgcaacctctgtgtcctgggttaaagtgattcttctgcctcagcctcctgagtagctaagattacaggcacctgccaccatgcttggctaatttttctatttttagtagagatggggttttgccatgttggccaggctagtctcgaactcttcac

SEQ ID NO: 704765 - DNA, 112 bp, Homo sapiens
gcactccaagtttattgcagcacaattcacaatagtcaagatacagacgtcagcctaggtgtacatcaattggacaaatgataagaactgtgatatagagagatcatagtag

SEQ ID NO: 704766 - DNA, 418 bp, Homo sapiens
ggaacctcttgaatctaggggaagcatcgtttagggttgcagggacaaagggcagagggggaaggcatgattctttgtagctggaattccagtcacttcacttcccttcgagaaagcacatggggcctggcgcggtgactcaacgcctgtaatcccagcactttgggaggccaaggcaggtggatcacctgaggtcaggagttcaagaccagcctggccaacatggtgaaaccctgtctccgctaaaaatacaaaaattagccgggcgtagtggtgcatacataacattccagctactagagaggctgaggtaggagaataaaataaaagtgggagacagagaaaacagaaagctgagatcccaataacacaatccagccagaggtgaaaagcataagactctgactcaaaaaaaaaa

SEQ ID NO: 704767 - DNA, 451 bp, Homo sapiens
ggccacctctctctgtgactctcagatcccaatatgcatagaacccaggctggatcctgggacatggctggggagctggacaggctgggaatctgtcaatcttccctagtttgcaggttggtggctggtgctggtggatatgcttcatgctctgggagcagagttcagccctggtatcagggtttcgacacacaatactgcgcccataccatatcttgcagtctggggattgggtccttctgttggtgactttggggtctccgttctgggagaccggacgcttggtacaagttgtggattctgaggggataaggggtgctaggaacccagggataagtgccttatggcgaggttcagttgctggaagaggaaggttttggaaagtttaggaagtcccaggttgagaaaacagttctggtctgagttggttttgttttatttgtttttcttt

SEQ ID NO: 704768 - DNA, 168 bp, Homo sapiens
tatttttctaatcagcaaggtgcttcactgccttcttgagacgcctctcaaagctcttaaatttctcctgctgcttatgttgttgtgttgcttggcagtctaatttctcttctgttacatgtttttatacttttcactaggaatatcaacattccatttcttccatac

SEQ ID NO: 704769 - DNA, 254 bp, Homo sapiens
  misc_feature (163)..(163): n is a, c, g, or t
  misc_feature (221)..(221): n is a, c, g, or t
  misc_feature (225)..(225): n is a, c, g, or t
cggcacgagagtcaataaggtttaaaatcaggcaccgttcatgtacatatgtggtaaaaatatcactttaccaaaaaataggctttcttctcttttcccagttctttttctcactttttgatctttccaaaggaaattctgcacatactaaagaatgtatggntcgggcacggtggctcatgcctgtagtcccagcagtctgggaggccgagatgggcggntcanctgaggtcagaagtttgagacctgcctgg

SEQ ID NO: 704770 - DNA, 486 bp, Homo sapiens
  misc_feature (205)..(205): n is a, c, g, or t
gccattctgccctgtgtgcgttggtggactcagatatagcggagaggggatgctctcgagatgtctgagtctgttgttgacagtggctgtgcagggcgaggaaggaagatggggatgagcacgggtctggcaggggcctccagtaagagatgcatgggcctgagcctcgggatgaggccgctctgtcggctgatgccaaaacagncccaaggttcctacacacgtgggctgctgcgtagagtcccaccccttgagacaaagcccctgaccaaggcccctacccacaggttgctgccctcgcctgggcgcctttctcccagattgaccctgcttggcataacctggttaattcccaaccccaggaactcctggtgctcagcacccccgacagattggagccagcccttgagggtggccgtggcaaaggccttcggtccctggggtctcgatgtctcatctgaggtctaaccccacattgcttgttgg

SEQ ID NO: 704771 - DNA, 172 bp, Homo sapiens
tatggatcccatcgggcaaggatgcagcagcagctggatagtaccaggagcttctggacataagctggccctggacattgagatccacgcataccgcaagctcttggaggtagaggaggagaaatcgcttggggaaaagtcggagagatgtaaaattcgtgtactgtgggag

SEQ ID NO: 704772 - DNA, 208 bp, Homo sapiens
gttagtgtggccgggcgtccgctcctcagcgatgtggcagcccgagccatgctctcgccgtccgagtcgtttattgtggcgttaggctacaagtccaagatcttcaagtcaagagagttagagtagtcccgccgctggccaacttcggcagggacctccccagccaccggtctttgtgtgtgttgccgggcgtattaccttaaggaga

SEQ ID NO: 704773 - DNA, 216 bp, Homo sapiens
  misc_feature (13)..(13): n is a, c, g, or t
ttccccccccctntttttttttttggcccgggggggggaaccttttttcccccgggcccccgttttccccttggggccttttgggggcccccttttcccccgtttttcccaaaaaaccggtggggcccggggggggttttccggggttttttttccccccggggccgggaggaaaaggtaaggaattaccggggttttgttcccccccgggtccca

SEQ ID NO: 704774 - DNA, 818 bp, Homo sapiens
aggcgacatgttagccacatctccattgaatggcagtagctgtcatttagcaagattgaggaaaaatttctcttaatcttgaacttgaaaagagcagttaccacagagaagagggatttttagcttttttttttctatttgtagagacggggtttcactatgtgtcccaggctggttttgaactcctgagctcaagtgatccttcttggttgggctcccaaaagtgtctcgggatttacacggtgtgtagacgccactgtgtgtgtggctaccaaaggggagtagtttattataaaacaaaaaccccccataatatgcttcgttccttgagtgcaaggaccttccttttaagactgtcagcttttacttcctctaatggttggttctttggaagaccggtgtctcacttctgtcacccaggctggagtgcaatggagcgatcatggctcactgcaacctccgcttcctgggttcaaccagttctcctgcttcagcctccctggtatatgcggactacaggtgtaccacactatgcccagtaattttggtattctgggcacgagatggggttaactggtgatggctaggctacagttctctatcgttccactttacgaatgttctcccccgattgtccatgttgtctacccaccatttaattcttctcaataacctgagttcaattatcgtacatctaacctgcccgacaaacacatctaaaaaaacacaacaccagcccacacaatcaaccacccacccaccatccccaacaaatcacccaacaaccccccacaccacgcacaaccacacaaccacaa

SEQ ID NO: 704775 - DNA, 313 bp, Homo sapiens
gtctagacatccgctatgctccctcttcaagcagcgaggagtaatagtccatctggttggatgcagtgtactcgttggctcgtacaggtgggacttgccatcgtgtggctgcacaggcctcccaattttccatccaatgcgatgtggggcacatcatctgttgtgaacaccagcaaatgcagtgcatcctttcgccagccaatcttctccttgcagacggctgcctggagtactgcatcaaagcccccctcaggggcatctcggttccgggacaccctctgtttccgaacttcctcattgaagctgtccactc

SEQ ID NO: 704776 - DNA, 198 bp, Homo sapiens
  misc_feature (48)..(48): n is a, c, g, or t
  misc_feature (126)..(126): n is a, c, g, or t
ccgactgcaagtacaagctcaagtgctcgcacttccactgcaccttcnccggtgccgcaacacggtggtgggcatgtcgcagatggactcgcacaagcgcaagcacgagaagcaggatgccgcganccgcggcagaggcccgcgcccgggcctcccatcagtctggacggctccctgtcgctgggcgccgagccgggc

SEQ ID NO: 704777 - DNA, 830 bp, Homo sapiens
tcaatcggcacgagggcgagagagaggaagctagtcgcgagtacttgttcttcatttttacacatttacttcccattttttaatttgtttctctctctcgtgcactctctcactcatttctctcttgcacttggtcttcggagctcattgccatggagtggcttgagctgtccgcatcaaaaagccacccgaaaacgtccatccttggccgatgcggttccagcgttctcactcattttacttcctatccgtgcattcattagacattcctttcctttcctggcgttgcatctcttttttagtaaggacatttattcctcatattagtgagagtcagggtgcccttattgacaagtcctagccaaactcttctcggtggatctacccatttataccatttgggttagtatattatctattataccagtatccttatactacttcttctagtacatagctattaccatacctccctggacctaacatatataacatagcaggtaggggtcgcccagggtggaaccccaaaaaaccctcatacgaggaggacccatggggccatgtattctcattcaccatcatccttgtctattaaggttactccactgacttgttcacttagaatgtccatctatatcacgtggaacagcctgtggtatccgctaaaaagtggaccgaggcaaagccctataattctgtgatgctgcatgtgccaccaacagatcgaatggcttatttacctcttattaccccccttaatgtttctgtcaacattgtccatggtaccatccaataccaatacatcaatcctctaaaaccaagccgaaaaa

SEQ ID NO: 704778 - DNA, 487 bp, Homo sapiens
gagcgtacccccagaatgagccgcttgcatcagtcgccaattcagtcccgcgcgggcacagaggcgctaacgtttggcagtacagctactcacgctgcgaagagagaccggacaccgtcgtgacccggacatgctcctggccctctccagctacacgcgattgcaacctgccgagaaccgaattgaagacgagccggcatgtgtcggcggcatgaacgcctaggctagcacggctatcagggaccaattacagatgacagatacgatgagatccgccgtcactggggtggcaatgtcctgggtcctagagatctgtggctcgtagtcgccaacgctctgagaaaggcacacatggctagaagaagcttgccactaacactgggttaaatgtacacgtgttgagttttctgtacataaaaataattgaaactaaattaggcaaaactttttcccctgtcaacatgaacaacacaaaggaaaagactct

SEQ ID NO: 704779 - DNA, 418 bp, Homo sapiens
cattccttgactcatggccatgcataaatctcacctttgtttctgctgttccatctccttcttcaactgacctttctgcctccctcttataacgactctcatggttacattgggcccacccagatcgtcaagaataccctccccatctcaagatcagtaactcgagcacattggaaaagtctttttatgctatgtaaggatcatgaaagtggggccctaatctggtaggactgtgtcgttgtaacaagtggaagagacactacaagcatgtatacatggaagaaaaaccacgtgaggacacagccatctacaagccaaggaaagaggctttaagagaaatcaactagctaacaccttaatcttgaacttcccgtctccataattgtgaaaaaataaatttatgttcttgaagccaaaa

SEQ ID NO: 704780 - DNA, 182 bp, Homo sapiens
tggggggggggaagggggtcctttttggtttttttgtggggtcactccggaaaaatacttttataatttcagtgggtattatgtgggggggtttcccggggaaatcattaaaggggtgggctggggacagtggtggaaagagcttatattaatataaaagtggatttcacttattgaaaaaa

SEQ ID NO: 704781 - DNA, 1148 bp, Homo sapiens
ggctgcgtcgccttcctggatggcggtggccgagtatgaagtgaccccggatgacgatgcgggaaggcattgtgggcggcgaggctaacgtcacgcaattttcttgagccacaacgggtcttgagctcatccctgacggtcccctcggcagctaggtgactgaactgcacccagtctggctggaagcagtggtccctgcaatgacctttgccaggaactcacccggttgacccacgaggtacctgagcgtggcccctttttgccagactaccatcgaccagtcatctacttcaagccgtttcctgcagtgcgaatgtggcttggaaaggcagctcagtgaccaataaacaccttcaggcaataccgagtcctggcgcaaacggtggcttaggggaggtgtgcgacctgcacaggtgcgggccacatggtacagattgtactgcctgcaaaagaaggcttacgacgataaacacgcggatcaagaagcggaccaggggaggccatggcgctgaaacgagaagcacgatcctggatgaaccacgtgacaccatgccaggtgtgtacgtgagctatgggccttaacgcgcctagtgagcacccaatgggacgcaggctgctgcctgggttgtctgtagcactgtgttgaaccggggcgcgaaccgtcaacgttgtcccacgatctacccatatggcgcccaatgctgattttccccctgaaagcctgcgggccccggtcttctagggccgtccggaagaatcttgctagtgagccgtggtagggaacctagctacacggggatagcgccatcgatgtacaggggatcctatgaaggcaccgatagacattcttgtcttgcaattgagccaaccgggtcagaattccgtatctctgacctgggaacttagctttgagtcactttgttgacccctgatgggggaacaggaaacccgttcaattggggtccattgttttgccacccagtggggataacactggtgttccaggcagttgtgtgttgcaagaattggaccgggtacactctgcaggcacctgaaattgagtggtgcgccacccgtgttgccatccattatcagaggactttatacgtggaggcaaactataccttcagttaacagggagacaaaag

SEQ ID NO: 704782 - DNA, 483 bp, Homo sapiens
cctcgtggatggtcggaagctggttctggtatgaatgtcatgatatcaccgtaaatcctattcatattttgtgcagcaggttcgtggacgcctaccaacattcattcatagcggtgattcagagaagatgaagagaggactctgtgggcgatgaagatcctcgatagagctcacatgagcagagtggactggcttgtaccctaaatacatatcacgatatgtctcactctgacctgggtcgactggatacaataccacacagctcgagagtggttgagctgccgtgggaacccgaatgggatctgagtccaaagcctaactctcaaacatgactctgatgcctcctattctttcctgaaatctacagtaatagtcatgattgtggcgtaaagacagaaaacggcaggcacggaaggtagagggagcccctctagctccattcttagttcccatgaagaaccgtccagtccagttccgggggcg

SEQ ID NO: 704783 - DNA, 350 bp, Homo sapiens
gggacagacattaagagagcaaaatgtaaaacagtgctactcttaataatattctttcctttagaaatttagaggccaggcacggtggctcacacctgtatcccaacctttgggaggctgaggcgggcggatcatgaggtcaacagttcaagaccagcgtggccaacatggtgaagccctgtctctactaaaaatacaaaaattagccaggcgtggtggcaggcgcctgtaatcccagctacttgggaaactgagccaggagaatcacttgaacccgggaggcggaggttgcagtgagccgagacagtgccattgcactcccgcctgggcaacaaagcgagattcgtccc

SEQ ID NO: 704784 - DNA, 103 bp, Homo sapiens
  misc_feature (61)..(61): n is a, c, g, or t
tcgaccccaagactttcaagtgcagagcatagagctgtcctggttccagacggtgggggantcggcactgagcgtagagcccttctcctaccaaggggagcct

SEQ ID NO: 704785 - DNA, 302 bp, Homo sapiens
attcgcggccgcgtcgactgcactgtagaacaacatacatgttaattacacacactacctatgtagcatggagcaagtaagtagtaaggacggcacgcggccgccctgctcctcgctgctcgctgatcgctgccacgtttcttgaatgaaactttatttccatcaaacaacaatgtcgtacgcaattactgtttgtacctgtcgccctatatacacgtctacatacatattgttacactacatgcacgtagttacattgaatgcgaattagaaatccaataacacgtgttgtacttatttac

SEQ ID NO: 704786 - DNA, 288 bp, Homo sapiens
ggcggatacggtgctcgagtcgagaaaagcacgagtgagcacgccggagaggggcgcgggcacgtatttccagccgttggaaatgcccaggttggggatcttgtaggcccacacggattcggccagcagggcgcagttccacgccatcagcgcgccgaacagcagcaccagcaggtggatgaagatcttcaaacgccgctggccggccgccggcaaggcgtcggaccagcgactcgaagccgatgtggccggcgtcgcgcacgccgacggcggggcccagcgatggtg

SEQ ID NO: 704787 - DNA, 351 bp, Homo sapiens
gagataagaaagcgtaagatgaacaaaagagaaaacagtagcttcgaacacccaactttcctttacggattccctgggaccttaagtcaggatatgtttcaaacacattccatggagaaaggaagaaagaggcattctctagtctcaacctgccccacacaacttgggtggtgatctggaaaacttgctcatagccaagccctagaccagctcagccactgtgtgcatcttctgatggcgactgaggttgcagtgtcgattaaagctttacccacattcaatgcactggtgaggtcgctcccctgtatggcttctctgatgttcaatgagaaatgaacgccgactgtagct

SEQ ID NO: 704788 - DNA, 1019 bp, Homo sapiens
  misc_feature (394)..(394): n is a, c, g, or t
gccacgctggaagggatcatccagtcagctcggtcatagcggcatctatcactgcccgtctcgccattcctccaggcctggtgccccatgaggagagttcctgcatcgtcaagagcgcctagtggatcgtacgcctggggcctaacggactggatgcctgtcatcacgaacgagtctccgtcaagtcagttttgtaaaatcatcgaggctccccgcgaccgcgggcgagagtaagagacgagaaatccaggccctccccaccggtccccgtgtcactgaggagcacgtgtaggctccgggctcgtagtgccctgtggtgcctggacgacgtacgtcgctgggtgaggcgtgtgcggcagcgtgcccgtgctaaccaccgtgttccgacaacggnctgcgattcgtggccctgggctggtagccagcgatcgatctagctgggccccggtctgccgaagaatagctcttcgacgggaacagcagacacggccacgtaacccccctggccatcactggggtgagcgttctccgtcctcgtcgtcagtcgtcgtcctccagctcgcccagcaacgaggaacgccacaagcaactcgtgagcccagcgtcggccggtcgggaagatgcacggggtcctttcccaaccatgcctcagccagcagccagtacggcacccatcagactgggtgccccggcggcgccacgcttggctggtcagcgccgcaggtcccgcctgttccctggcaggacccgggcccggccaccggcctcctggcttgggaaggcgtgggccacatggtccccgtcttggggcgtcccaggctccccgtcctctgtctaactcaccctctaaacgttcagcggtggacagattctcatactttccattattactgcttggacataacggcgttggagctcccgtggcggcatgcttgttggggcgggacacagggccccggtcccaggctgagcccgggtccggggtctcacgtcgggcgccgaggccgggcccatcctgg

SEQ ID NO: 704789 - DNA, 368 bp, Homo sapiens
caatggtcttagcttgcaagacctctactgccgggcggtcgtgtcctgcacttgccggtgcacctggtggacaagctcccgctccccattgccttaagaagccacctcaagtccttctcgatgtgccaacgtgccatgaatgccagtgatgatgcacgtgtggttcctactccactcaccaccatgctccaccacacaaaatggagcagcctcctgcaaatgtgaatgctctgtcctgccccctcccatgatgccccccacagaaaacttgcaccatgaacacatgcttgcaaacatttcatataagtgaatggcacttgacaagaaaacactgtgctggatatctcatccatgtgatgaagctctgg

SEQ ID NO: 704790 - DNA, 284 bp, Homo sapiens
gatcctctttaaagccacgcttagtagatatcgagcaaattagctctactcatgctaaggtgatcttagaaccgttagagcgtggctttggtcatactctagggaatgcattacgtcgtatccttctgtcttcaatgccaggttgtgctgtaactgaagtagaaattgatggcgtactgcacgaatatagtagtaaagaaggtgttcaggaagatattcttgaagttcttttaaaccttaaaggtctagcggttaaagtacagaataaagatgatgttattctg

SEQ ID NO: 704791 - DNA, 449 bp, Homo sapiens
  misc_feature (200)..(200): n is a, c, g, or t
  misc_feature (213)..(213): n is a, c, g, or t
  misc_feature (215)..(215): n is a, c, g, or t
  misc_feature (231)..(231): n is a, c, g, or t
  misc_feature (321)..(321): n is a, c, g, or t
  misc_feature (336)..(336): n is a, c, g, or t
  misc_feature (352)..(352): n is a, c, g, or t
  misc_feature (364)..(364): n is a, c, g, or t
  misc_feature (382)..(382): n is a, c, g, or t
gtccgatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaanaaaacctgaattncnctacattttcgaagtntcttgtaattattttgttgatatcccaaataattacaagagacttcgaaaatgtagtgtaattatttgggatatcaacaaaatttgattngtctgtctaatcccntgctagtattttaaanatgtctttaacncattgtatcctttaattnttcattaaaatggaaataagtagatgtttcaaagtaatttacattcctggctttgcttaacgtttta

SEQ ID NO: 704792 - DNA, 912 bp, Homo sapiens
agcggagtcacacccggaagccggcagggagcggagctgcggagccgcctggttctcccgtggatccatcgagtccatttcctgcgttgttgtgtccttccgaaacgcacacttcaatgagcagccgcgaaaggtggtatggcatcgatgcacagacatggttgggctcggaggatatcttccctctaggtgtgccatcacatgcgatgaacctccgaacgtccactggggcgaggagattgaaatggcaaatggaacgtgtggaccgataggcatgtgtcgatagaggacctgccatagggtggcgctagatcgggaaaagtactgatgacgagtggcacacgatgtgtgtactatcagtcttactccaagagatcgtagggggaatgtgcctgcatcagcggctcaatcgataccttatgcacggatgtgtccactgaaacggccccctgcgtacacgaagcataggacgaattcgcaaaggcagaactttgcaaggaggataacaggcgccgcgatgagaagggggctttccgaattgctctattctgggggcgacgcttgcggttgggtccccgggaagcaccgaggcccaagcacaaaatagtcgaggggtcggttcccacgtccggaagggcaacagaaacccagggtgggggtttgcttggtctcaagaacgcaaggcacatagatccgcgatccttcgcaagggcacgaattgctactgggtggccttctcacactaaggtgaaggcagcttttccagaattgacagaaggccggcaaaggggccaacaagggccaatttgcaggtgacggggcaagtgacggatcccttggaaccgaacaagtgggcttagcgtgaagcgcccttacaattaaagtgccacgcaaccctacgagtgcccaagg

SEQ ID NO: 704793 - DNA, 396 bp, Homo sapiens
  misc_feature (200)..(200): n is a, c, g, or t
  misc_feature (213)..(213): n is a, c, g, or t
  misc_feature (215)..(215): n is a, c, g, or t
  misc_feature (231)..(231): n is a, c, g, or t
  misc_feature (268)..(268): n is a, c, g, or t
  misc_feature (283)..(283): n is a, c, g, or t
  misc_feature (299)..(299): n is a, c, g, or t
  misc_feature (311)..(311): n is a, c, g, or t
  misc_feature (329)..(329): n is a, c, g, or t
gtccgatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaanaaaacctgaattncnctacattttcgaagtntcttgtaattatttgggatatcaacaaaatttgattngtctgtctaatcccntgctagtattttaaanatgtctttaacncattgtatcctttaattnttcattaaaatggaaataagtagatgtttcaaagtaatttacattcctggctttgcttaacgtttta

SEQ ID NO: 704794 - DNA, 460 bp, Homo sapiens
aggaatgcccccatttgagaataaaaaggggcaaaacctttgtgttccatatagctacacgaatcagcaggctaacccaaagatcaccttctgagaaggattcacccccacacggagtggtattatttttcctctagtgcatttaaaatatgatttgattttaaatattcatattccacacaattaattctactaaaacatggggcccagcaaatgataggttctccacaaatgtttgaggacaacctgaatgaaccagtgattggaatgaatgaacaatatggcactgtgccctcattttagaatttgaaatgagatattcacaggctttttatatttacctccttctggccttcccaccaagggaattaagcttctctttggactactagacaattgttttcttccaagggacttggaggccaacttgaaacttggtcctcctgtaatacaaactcaa

SEQ ID NO: 704795 - DNA, 227 bp, Homo sapiens
tcttgatgatccctagactgtgaatggggtaaaatactgagtacatctctctagatcagtaatcgaagtgcttcagatctaattacattagtagttctcaaagtggggcttagagacacatatttagtgggagaatggaattctgtgtgtactaatgaaacatagtcctgattgatgttctagtttaacttgttgtgtgtttacattcattatacaacattgcttta

SEQ ID NO: 704796 - DNA, 881 bp, Homo sapiens
tttgcacgtggcgccaccgtcttctccaagggggaccaaggggctttcaccagggacgacgattctttctcccccctcttccttcggccaccgcgggagggggtttttatccccctccgctctccttgctcccccggtgggcttctaagcggaacgtgtttctacgcccacgtttcctttgtgagaacccttctggggtcgcccaagatgttgtggtcgccacccctcggcgttgttgtgctgcaccccgcaagaggtgtccttggttccacaactctgtgttgttctgtgggaggacccaccccgcacccttctcctgtttttcctgtggcaattcttctaatctcctccccaggacacccccccctgtggtggggattgagcaacaaccaacgcgcggtcccaccacacgcatgttctcctctggggaggagattgtgcccaccccagaagagttcttctggagccccaatcgtgtgtgctgtgagaggtttctgaggagccccccaccagggttcctcccgcccacccctccctttcccctgccactgatggtctttatcacgctgaagttgttccgccacactctctccctcactcaccacacgacagtcggttgtttcttttcttcaggcgagtgtgcccgtgttccctcctgggcaacctcgggccccccccgccttgggttccgtcggggggattgccccccgccggggccgccgcgtttcctccccttgggccctcttcttccccccaccacagagttcccccgggcgggatttttcattcttttcccccccttttctggggtttcccccccccgggaaaggacattttttttttgggggccccacacacaaataaacccgggggttccccca

SEQ ID NO: 704797 - DNA, 121 bp, Homo sapiens
accaggatacgactttaatacgactcacctactcggaatttgggcctctaggccagaaattcgtgagtaagaagattcgcagtcggataactgaatctaccagttcgctaacttcggccgt

SEQ ID NO: 704798 - DNA, 439 bp, Homo sapiens
gaattaaaattttcagggaaaagagagggggagggagttagagacaagtcacatcagtaagcctgaaacaacagagatggcatacaatcaagacaccttcaatgacacactgccacctctccttctaaataatgggcattaaacaatttctatttatcttcctgtgctctctggaccatttttcaagatctttctccctctatgatttcaatgagattaaacatagaaaacaatgccctttgtcccatatctatctattccaaagcgaactgctttaggggaggaagtgagagaccccaggggattccatgttcaatgcatgtacctttgatttaggaatggaaccagaagtcaagtacaagagaattttgccaaagaggaaacagtgcttgggaagattcctgtactccagaactggtcaccaaacctagaaggggag

SEQ ID NO: 704799 - DNA, 339 bp, Homo sapiens
ttgcgatggatttgacacaaagagataattgttctcttaagttgtatatgaactaaaacaacttagttaaattactccattactaattaacatcctgcagataattccattagttagagaggcccagaaatcaggtcagcactttttctttgcacacctggttgaaataaaaagtgcttctaataggtttatatctaaacccagcagtatatctccttctcgcggatttatacctaaatcacaccatgatttttaacatctggtttcttttgcctctctcaataattttttggttgttgttcattccatcaaatgtgagttgagatgtgggaggcataa

SEQ ID NO: 704800 - DNA, 664 bp, Homo sapiens
tcagcagcctcccccttgagccccctcgcttcccgacgttccgtatcccccctgaccgcctttctcccgccaccgccgccgacgccttccgcaggccgtttccacctgcacgtgaaaatggtaatcgtatcagtcatgtaccgcgtatccacagaacggctccactacatattctgacgctcgcgtttgcctgcatcgcagacgatcaaattggttgagtgacacctgcaagtcacgtgcgtcggccaccgtgacgagatatatcatccgagtatacacgaacttccgaacaagaagaaaacgcggcaacggacacgacgcactatacatacaatgtcgtccatacgggaactcagcatgactgacgtcacggacgtagacacagcacacaattaggatgaacggcgtttagtaaaggcacacaacacggtttgccatgcgagactgcgatacgtgtagactatgcaagccattacccggaacgtaattgcgcagagacgttacaatatcatgacatacgacaggggttgaacccaaaacggcaaagaaaagcattaaatgccacagtttcacatcggttaagagaatttggaccatgagctaaaggcacgactcacgttagaacggttcaatgaggttctccacgtgctaagtagcatcactg

SEQ ID NO: 704801 - DNA, 108 bp, Homo sapiens
atcaagtgtatatttagcatattggtatacacgcggttctctatatatgttgttctttaataagagtctatcggccgggcgtaatggctcatgcctgtaatcccagca

SEQ ID NO: 704802 - DNA, 358 bp, Homo sapiens
gaaagggggggaaaaggcaagttttgggaaacccttgggggtttggaacccccaggccttgggggcccttggaggtttctttaccagggggttccccatcccccgggggaaattagggggcccatttactgttttaggtctagcccatgtggattttttcctaacatacctaagcaaacccagtgtcgggggggtaattcttattctttcgttcagttaagtttttcccttcatctgggccctgaagggatatgtgaaacaatgttaacatttttggtagtcttcaaccaggggttgtttctttttaacttcttataggaaagcttgggtaaaaaaaatattttctttttttttttca

SEQ ID NO: 704803 - DNA, 854 bp, Homo sapiens
aaggggagatgctttgtctctgcagcagaactacccgaccgtccaagagcaccagcagaaaagagcctcgagccccagcacagcgacggtactactgcgcagctcgtgtacctggatgactgtggacacagagtggtagcgaatgtgggacctacggtctgtacccccgaggtacagtgtccctgcgatgcttgttgtgagggggtcgagttcgtgactaagtggtggccatgctgccgcagttctgcaggaggagactgaccagacggacttgcgggatgccccctcggagtccagacagacaggccccaccagagaagatctgccacgaggaagaggaacgacgagtagatgatgatgaccaaggagtaagacaagaaatagcccctggcagaagcgggaggagagggccctgatggtcgtgtatacattaacatgatgctatcgcagagaccgatctgactgtgagacatataaaattgctcaaaatatccgttgtgctcatggaacgcgcgtacgcgcttgcgatggaggagacggaacggaaggccagacgtgggacggacgtggatgtttactgctttcctgtttcgacgtggtggagtgtgaagaaaggaatataagttattattcggaatataggatgactttgggggatgtcggggcctggcaaggaggtggtgaaagtggtgttccagatgtcttccgaggactcgggtatgcggcaacagggacattaagaaaacggagtgatgtcggtatgctgtaagatactcagttctcctcggattctgggacagatgagacttttggatgggtgaggcatttgatgggagatctagggagctgcggaa

SEQ ID NO: 704804 - DNA, 817 bp, Homo sapiens
agtttctctaagccatccagctgccatcctcgtcgctgctggtcgacactacgctctcgcctcgccgacatgagtgagacagatgacccttcgtggcaccctcaagggccacaacggttgggtaaccgcatatcgctactaccccgtagttccctggacatgatcctctccgcctctcgagaataaggaccatcatcatgtgtgaaacctgaccagggcatgagaccacatctatggaatttactcagcagacgtgtctctgctggggtctaagctcccaacttggttgatgtgatgtggtgtagtcgtacctcagatggtccaggttttgtgctcgctcttcgagtgccctcactgggggatggtgaagctccctttggcggccctctgggggaatgcgtcctagctagacgggtcgatcccatctcgatcgtacggtctgaatttagttgcggccgattactccaaggggatcgttgctggacgttggtgtgcccgtgttcctccttctgtagcagatccggtcaggatgtgtcgtctgggatctgcgtagcgagtaacagccgatgcatagctgatgggtacttgccgctggtgtgtgtggcgaagctacactagttccgggatgctgagccacttcgacgagtcgggtgtctttgttgtcgcgcattcgtcgcccagagcatgcgtgctatcgcctatcatcgtctccttgttggctgggaccatcgcgggtcaaggttttggcacctggctggctgctagctgccgacctgtccttcatgggtcctgcaggctatcttgagcctggggctgc

SEQ ID NO: 704805 - DNA, 883 bp, Homo sapiens
  misc_feature (12)..(12): n is a, c, g, or t
  misc_feature (64)..(64): n is a, c, g, or t
  misc_feature (156)..(156): n is a, c, g, or t
cacccctcgccnagcggccgcgacgctatggcgcactggagtaccctgttcctggcaggtcccnctccattgcccaagctgaagttcagtggcacgaacatgtttcactgcagcctcaacctcctgggctcaagctgtcctgcctcagcctcccgngtagctgtggaccacaagcaactcggccatcacacctgtgcattaattttttgatgtttcatgggagacatgggcttcacttttgttggcctatgctggtcttgaactcctggcctcaatgcagatcattcgtgcttgtggccttccaggagtgctgacaattacagggggaggaaacaggaagagaagagtggtggcctccctagacaatctagccacggagcaacgacctggtcttgaacttcctgacctcgtgatacctcagacctcccaaatgtgctgggattacaggagtgaacccaccaagcccggcttgacctcttgagttttaccaaaggatgttgtgcttctgaggaagcatggaagctgcagccacaattgtgcctttgcaggggagcctgagagcaacagatgtcaaggagaactgcaaaccagtgggttcattgaactaaaagagaatacaaacaaaatggaaaaagcattccatgatcatgggttggaaggaactcactatcggtgaaaatgggcataattgccaaggtaattaatagattcaatgccatcccaatcaagctacaaatgatttcttcaagatgggaacaatacttgaaggtcatatggacaaaatgagcccgattggcaaagtcactcctaggcaaagaacaagccagcggcatctggctactggattcagtatataacggctacataaccaaacagagtgaag

SEQ ID NO: 704806 - DNA, 131 bp, Homo sapiens
cacgagggagggcagtatgtacacacaaattgggagggtttatttcttggactcatccgccttggataaagtcttgatgatctcctccttcattggactggaggcgctcttcacggcgcttgcgtgcttcc

SEQ ID NO: 704807 - DNA, 469 bp, Homo sapiens
  misc_feature (12)..(12): n is a, c, g, or t
  misc_feature (64)..(64): n is a, c, g, or t
  misc_feature (156)..(156): n is a, c, g, or t
  misc_feature (300)..(300): n is a, c, g, or t
  misc_feature (410)..(410): n is a, c, g, or t
  misc_feature (418)..(418): n is a, c, g, or t
cacccctcgccnagcggccgcgacgctatggcgcactggagtaccctgttcctggcaggtcccnctccattgcccaagctgaagttcagtggcacgaacatgtttcactgcagcctcaacctcctgggctcaagctgtcctgcctcagcctcccgngtagctgggattacagtcgtgagccagcatgtctagccttttttggtatttttttgcagagatggggttttgctatgccacccaggctggtctcaaattcctggactcaagcaatccacctgccttggcctcccaaagtgctgngattacaggcgcgagtggctgtctctctctctctctctctctctctctctcaagtgatagagtcttagggccaggcacagtggctcacgcctgtgataccagcactttgngaggccangatgggcagatgatgaagctagagttcgaccagctgaccagatgtgccccg

SEQ ID NO: 704808 - DNA, 667 bp, Homo sapiens
  misc_feature (21)..(21): n is a, c, g, or t
  misc_feature (65)..(65): n is a, c, g, or t
  misc_feature (70)..(70): n is a, c, g, or t
  misc_feature (83)..(83): n is a, c, g, or t
  misc_feature (88)..(88): n is a, c, g, or t
  misc_feature (92)..(92): n is a, c, g, or t
  misc_feature (96)..(96): n is a, c, g, or t
  misc_feature (130)..(131): n is a, c, g, or t
  misc_feature (153)..(153): n is a, c, g, or t
  misc_feature (181)..(181): n is a, c, g, or t
  misc_feature (183)..(183): n is a, c, g, or t
  misc_feature (219)..(219): n is a, c, g, or t
  misc_feature (221)..(221): n is a, c, g, or t
  misc_feature (229)..(229): n is a, c, g, or t
  misc_feature (239)..(239): n is a, c, g, or t
  misc_feature (256)..(256): n is a, c, g, or t
  misc_feature (270)..(270): n is a, c, g, or t
  misc_feature (275)..(275): n is a, c, g, or t
  misc_feature (305)..(305): n is a, c, g, or t
  misc_feature (320)..(320): n is a, c, g, or t
  misc_feature (323)..(323): n is a, c, g, or t
  misc_feature (338)..(338): n is a, c, g, or t
  misc_feature (340)..(340): n is a, c, g, or t
  misc_feature (377)..(377): n is a, c, g, or t
  misc_feature (436)..(436): n is a, c, g, or t
  misc_feature (474)..(474): n is a, c, g, or t
  misc_feature (584)..(584): n is a, c, g, or t
  misc_feature (629)..(629): n is a, c, g, or t
ggccacagcatttgtggccanatggtactctcagggccgacgcagggccgacgggcaaaaagctnttatntccagcctggcgnttccnggcntttnttgaggccaccatgggaatttgatgttttttttnngggctaagaaaaaaaaaaaaanacgcacctgggatcggcggtccggacangngcagggaaaccacacgccctactttgccctttcctntncatcccanacctactcanatccctcagtgcctaanaaaacaggacagtnagganttggggttttgggacggggcttaggggctngggcagggcccgttntangtggacggtggtttntntggatggaggggtgactgtgtggtggtgctgcctctnaaacaccctccccttccccagtccccagccctatggtgatttaaaggggctgagaagcnaagaggcagcgggcccatggaaagcaggaagacctggngggtggcaggtggccactaacagcccagcagctccaggcgcagggcgatgcggttgtgccaggctacaggcaggatgcgcacatagcgagccaggatgggcgtctcaaanaagttcttcttgtgggagtggttgtcccagttgccagggaagatnttactgctgccagtcctggggtcctggtactcagtcca

SEQ ID NO: 704809 - DNA, 1036 bp, Homo sapiens
tgggacaatctacaaccacttttattagcaaaagggaggtaaggtgcagcagggggaagaaaagagggggctcctccttcccctcaaagggcgatcacggccccttccacagggggcaggccagcggggaacaacgaggaccccaagggtggcaagcaggcggggaatcaagacaaaaggggatccggggtccggggaacgctattggaccgtggcgcaagactatgtggagcgctccctcattatcgcatccaagaggccggccggggacagtggggcggggtggtagacacgccacggaagatcacaacaggcgagcgggcctctggcgcctcagagaagaccgcgggacaacttgcggcgcgccccggtgaagaccagtgttcaccgggaggggggggcgcaaatctactcacatctcgggcggggctcctcggagagctccataagcgggttcggcccccggatggtccgtccatagaaagaagaagtgtccttggggaaaattcctcacattaagcccgtggagggggctttcatgttcaccgattcttattttttactctccaccaaaattgcccacacattttcttcaaaacagggttggccagaagcaggggggacaaggggcgggcgcaggaattacgcccaaagcaagggggctcccgggggccaagaaaatgtaatacgggggggcgcattcccataaatataagccccaaaggcccttcatccgacgctaaatttctccaccagagtattcgacggacgggcagagaggaactccaaagcgccaagaagaaattctgggccaccccaagtggggcgagatcacaccgagaggacacaaggggatattgataacacgcctctagaagaacatacacaatggcccaaaagggtccaccccgcgggaacggcggcggcaacccagtatgtgcagctcagggccaactgggcacaaggaggacgggacacaccccagaaaagcacacaggaaccagcgcaggagccggccagaaaacacagaaagaag

SEQ ID NO: 704810 - DNA, 454 bp, Homo sapiens
  misc_feature (145)..(145): n is a, c, g, or t
  misc_feature (373)..(374): n is a, c, g, or t
atagcagcattagtcacaacagccaaaatgtggaaagccaacccaagggttcgtggacagatgaatgaaaaagcaacactgcagttcctttatacaatggaagactattcagccttaaaaaggcaggcacttctggccgagtgcngtgtgtcacgcctgtaattgcggcgtcttggaagaccgaggtgggcggatcacctgaggtcaggaattcaagaccagcctggccatcttggtgaaaccctgtctctactgaaaatgcaaaaaatgagacgagcgtggtggggtgtgcctatagtcccaactactcgggaggctgaggcacaagaatggctggaacccgggaggcggaggttgcagtgagcccagattnngccactgcactccagcctgtgcgacagagtgaggctccatggaaacacaaaacaaaacaaagtcaaacgaacaaacaaac

SEQ ID NO: 704811 - DNA, 855 bp, Homo sapiens
agcgaagatccgggagcgagtacccagacatggagcatgaacaccgtttatgtgtggtgccattcgcccgcaaagtgtcatgacacagtggtggacgccctacagatgccaccctctgccagtgcaccatgctggtagaaaatacagaggagaccttattggtattgataacgagagatctctagggaatgttgttcagaacttctatgagatgacaagatgagctatggtgacctgaagaatcatggtgtctgataacgatgagtggggtcaccagctgggtgcagtttgccagggcaggtcaatgatgacttgcggaatgctggtgtgaatatggtccgcggtgatcaccggggtgcacgttacttgcagtgcccgagtttttgcccccgaggtagatccggagcggggggacagtcaggcgaagtaacctgggagctggactccgtggcccggatgctcaacaccaagcagagtgttgagtgccacaggaacatgagtggttgacgtgggaacgcctggaacaatgggtggtacatgacggttgacgccgtggacagggggccggatgttcgcatgaaggagggtgaatgaggcaaattgttggaattgttcaatgcacaatgagagttagtgggcatattggggtcgcagtggtattctgctaaataatgttgaagaactggattgtcttgtgaataatgcaagcataggaggggctaaaaaatgtccggcagcttcatgtggcaacatgaaggggcattgcatggagctgttaagagggcatgtccgagcaattcaggaccaggttcaggcgcaaaggcttacatgaagggtacgaggcaagggtgacga

SEQ ID NO: 704812 - DNA, 219 bp, Homo sapiens
tcgagctgctccgattcctaattacgcagacacacatttccccacgtcccacatatagtagcctaacatgtccctcctgaaaactacaagggcatagccccagcgaatatgcctccaaatgcccatgcccctggaatacacactcaaacgcattctacacacaactctccaaaacacccaagcagacccgctattacaacctcgccacccccttctccc

SEQ ID NO: 704813 - DNA, 877 bp, Homo sapiens
ccacgcgtgggcggatgcgtgagtagcccatgcgttcggatgctagttcccctatcatcgaagagcttatcagctttcattagatcatgtcctcgtcccttatatcactttaatccttcaatctagctatacctagtctcatgtactgcccatttttcactaagcatctacaagcaaactagaactaccgtcttgtaactaatcactgtcacgacgcttcaatggaaaatacaaaacggtctgtaactattccctgaccgcgctcatctattccatagatcacgacatacggctccatccgcaattcccttacgtctatccatttacaattaactagacgagcgacatgggtaatctccgcatccctttacacgattctacacggtccaatatgggccggcataatggtacctgaacctacaaaatacaccgcaataatgcggacaaactcatgcaactctcgtaaatacgttgccccccattaactatctctaagataccagcgtcgagctgtggaagtccttgaatctctttgatcaattcgttagtattactccgagattggagacccccatgtacgtgtcataataatcatgactatagacgtccttgtcacctcattgaggctggttcttcacactaaaggcattttatatcaccagctgcaacgtatccggggaggattaaaaccgtaaccacgtttccgccgttagacggacgcgggggtataacttaacgtggcaacagcgctcgaaaaacttgagtgtcgcactacaaatcttcgtagctcagtgcgcccgtataattcatatcgctaccaacatcttgccctataggccgtattacctataagcacccctctaccccctctagagcc

SEQ ID NO: 704814 - DNA, 913 bp, Homo sapiens
tgtgtcacttccggccgccctttagctgccatcttgtcgttcccgcgtgtgtgtgacgccgtaatctcaggatgagtccaggccggagaacctcttgagcagcatactcatagtctcccgcgcgcccgcttattcgcgtcgatacgactgaaagatcccagatcggtgataccagggaataaatcatcggcgaaacttgtcaggcaagcgaagttgcagcgatgtggtgggaaatgtgaagtgctcgcacgaaacgggacgaagggtggttcagtatgaacaggcgctactagcgagagtgaccaaaatagaacttcagttctccttaaagaagttaggggtaaagaatatctctggtatggcagaggtgaatatgtttacaagaccagggaacagtgatccactttaagcaacgcctaaagttcaggcatctctggcagtcgaagcactttcaccattacaggccatgctgagacaaagcagctgacagaaatgctacccagcatcttaaaccagctttggtgcggatagtctgacgtagttgtaatgacgactggtccggagctcttgcccaaaccaatctgtggactggacaagcagcacttgctactggagaggatgatgatgatgaagttccagatcttgtggcagaattttgatgaggcttccaaggaatgaggcaaactgaattgagtcaacttcttgaagattaaaactgaagaagtactgggagctggtattttatattatgactggtttttaagaaaatttgcgttcatgggatctggataaaaatctagatctcctaatattttaaggcacaaggcccttgggacactggcaggttctttcaagtttggttatacacaattcaatcttggcaggtaattaaggcggagaaaacctgggaata

SEQ ID NO: 704815 - DNA, 404 bp, Homo sapiens
  misc_feature (379)..(379): n is a, c, g, or t
  misc_feature (393)..(393): n is a, c, g, or t
tactcagaaggctataggacaggaaccacacagctcaccagcaggacaattttgaacctcctttcagaagacggtcttctaacagcaatctatgaaatggtatctccccaggtgacagctcacggtcctccttaaaggacatacagttacaagagttttccactcaggtatgcccaaagctgtggctttctgtcgtgtatctggagatttcccagtccagatgcaacttaccagtcagggtcatatttaccaaaagcaaagctgcatggcaataaatacagttgacacataccatcctatttagttgtcagggtagggaagagctaggtagttaacagaagtcatccagggggaaaaggtttttgtttaaccttttccnttttcaactacttnggggaagtacc

SEQ ID NO: 704816 - DNA, 912 bp, Homo sapiens
ggaagcatgtcctgctcacggcttccctgctgggccccaggccccgggctgagcctccctggtccctcttgcgcctcagtggatcagggcctgtgtggcaggtgcctgggcatgctcctgtgtaggtccggtgaggtcaggcttggaggacgcacagggggtggggtttcacgctgctgcatgttatgttcccgaaactcgtatctagtagaatcgccatcgggctgcgttggcatgaattgtgctagacgtgccccatgaatagtgtccaaatacagactcccatagtttggcgtgtgctgaagcagatttctagaagcgaagaagaggtgcttgctggtggagccagtgcgaatgttgagtgtgttgtagcccctccccgtaaatgagtcccacaatagcctagctagcattgtcaataataaaccatagtttgaaggctacctgaatagatagctgacatgagaagctagagagaataatgaaagacattagagatatctaacaaggagagtggggccagcacccgaagagacatgccccctactggccttacacacctgggctgctgaaacaccaaatctatagttgctcgggtggtgtaaccaaaaatgggatgtccacttgtaggccaccctacaagcgcagaagcagatatgagagaaaattgttgaaagggaaagtcagcacttacattagcgcaaaaattggctacaaacacccgacaacaggagccataagaagccaagttgactaggttcggaattggtgaacaacatgctaggagacagaagtgctaaacatagctcgggttcaaaggagagtggggaacagtcaccccggtaatggataggcaatgcccagaaggaaaccacgctgctagaggtcttggaacatgaattcttacacaag

SEQ ID NO: 704817 - DNA, 113 bp, Homo sapiens
  misc_feature (19)..(19): n is a, c, g, or t
ctgcatacgcaaggccaangaggttgtgtaaggcagcggacatgtcgaaatgaaaaagctacctatagtttgtgccccctacttgcgccttgcccatatgctaagggtatccg

SEQ ID NO: 704818 - DNA, 126 bp, Homo sapiens
cgtggctcatgcctcgtaatctcagcactttgagaggtgaaggtgggagaatccacttgagccctggagtttgaattcagcctggacaaatggcaagaccctatctctaccaaaaaaaccccccaa

SEQ ID NO: 704819 - DNA, 278 bp, Homo sapiens
gcctccagcggatctccgaactcactgttctgacaataacgccatgacttttgaaaaaccagctgaggccgggcgcggtggctcacgcctgtaatcccagcactttgggaggccaaggtgggcgggtcacaaggtcaaagacatcgagaccatcctggctaacatggtgaaatcccatctctactaaaaatacaaaaattagctggacatggtggcaggtgcctgtaatcccagctacgcgggaggctgaggcaggagaatcgcttgaacccgggtgg

SEQ ID NO: 704820 - DNA, 723 bp, Homo sapiens
ggcagatcacccgaggtcgggagttcgagaccagcctgaccagcatggaggggctccgtctctactaagaatgcaaaaattggctgggcatggtggtgcgcgtctgtagtcccggctactcgggaggctgaggcgggagagtcgcttgaacctggcaggtggaggttgcggtgagccgagatcgggccattgcgctccagcctgggcgacaagagtaagactccatctgaaaaaaaaaacaaaaacacttgggcctgatatttattgataagtaataatttggattgattgtgttggatctattactgatttttttaaatctattcaggctccctatttcttctgtgagtttcatttgataattcgtatttgtttaaaaacatttctactaaatccatgttatacaagtttattagcatgaggttgaaaaataacattttctttctttctttctttctttttttccgagatggagtcttgctctgtcgcccaggctggagtgcagtggcgcgatctcggctcactgcagcatccacctcccagattcaggcgattctcctgtctcagtctcctgagtagctgtggattacagatgctttgccacaacccatctagttttgtatccgggggatacgggggtttccaccaatgttgggcaggtgatctcgaactggttggtctcaagcttctgggccgtgtgatttgcctgcttcgggcttccca

SEQ ID NO: 704821 - DNA, 152 bp, Homo sapiens
cactgctggtccttagctgcattacagccccagttcctgtgctgtcttgggctgaagtgcacctgtgtgagaagatggcccgagtttgatgctaagaaagttttgcagagacccaacctaaaaaggacacacctatggaaagatgaagggtt

SEQ ID NO: 704822 - DNA, 163 bp, Homo sapiens
tggtatagaggttcttcctggcatccatggcatcattatgtttatatatgttttagtcgccaaaagtgaccttgaggaaccctatggagctcaggaaaggaaggagcacccagaagcagggacaagggcagctaggttaggggaggacccagaaatccaggtt

SEQ ID NO: 704823 - DNA, 180 bp, Homo sapiens
cgagcctggtacccctccaaattgttacaatgtctgcccattatctagatccaaagacacttccacattttcaggtcatccttacagcagtgccccactctctcagtaccaattttctgtattagtccaatttcacactgctataaagaatacctgagggcagtttaccatgcagcgcta

SEQ ID NO: 704824 - DNA, 827 bp, Homo sapiens
gggacagcatgagcttcagcactcggtccagcttctccagcaactaccggtccctgggtctctgtccaggcgcccagctacggtgcccggccggtcagcgagcgcgggcagcgtctatgcaggcgctgggggctctggttcccggatctccgtgtcccgactcacaccatgcttcagggtgcggcatggggtccgggggcctggtccaccgggcatagccgtggggtcgtggcaggacatgggacgtgcatccaagaacggagaaggagaccatgcgaagagccttgaagcgagcggcctggcctctgtacctgggacatggagtgcacgggagcctgcgagacctgacgaagccgagaggctgtgagagcagaaatcctgggaggcacattggaggaagacagggacgcccagagtcagaagacgtggaggccatgatcgttcgcacgatcattctgacggagccgtgatgtggctcgagatctgtgctgcaagaataactggtgtgaccaaactgcgccggccatcggtgtgcttgacatgtacttcgagccagaataggccacggtcattggacatagcggtgcacttgagcttataggacgtcaaacgtcatgcagaacacgaggctgcgagcgatgacgaccatggtctcgtggaagaaacggactagttccatgggagacttccggtcaaacgggtcaattggatggacacccacataatttcacaccgaacttggcgagctagcgagaccagaagattcgcaggggctctccaaaggcaggaagctggatctttcatgggaaggaaagaaaccaatgaaa

SEQ ID NO: 704825 - DNA, 238 bp, Homo sapiens
cagtggtttttgtgtccctgtggtgccagtgcttttgggcagtgcaggcggctgccaggcccagccctgacttccactttgggtcagcaacctggttatttatgtggggccgtgcaggcatgggccccctgcctgtccatcctgttttttttatttattgaaactccccattgccctatccttgtgtttccccccccttccatgtgttgaataataaaaggtgggaaagtgctgtcca

SEQ ID NO: 704826 - DNA, 1115 bp, Homo sapiens
tttttgtatttttagtagatgacggggtttcacacgtgttagccaggatggtctcgatctcctgacctcctgatcctgcccgcctcgtgcctcccaaatgtgctgggattacaggctgtgagccacctgtgcccggcctggtactcctgaagccctcagatctggtgacctggtgcgctgtaggcaccgatgaaaatacaggcacctgagccatgaagcatgtgcctgcaaccaatgagacctcggctcggcgaaattggctggtgtctggagcctgcgatgtgactgccatgctgtgtgtgggctgtcaaggagaacattcgttacggcgcaaccaacggtactgtcaccaagaaaccgtcgtctctgagaaaaaaagagacgttcggccgccgagaaactcctgtacaatgtgctgtgacagaaaaaccgccggctccgcgcagcggcaaaagagccaacgggaacgccgggtgctgcgaccatgaacccggcactggcaggacgtgggatggagaatgggacacacggagcgagcacagggcacaccgttcgtgcagaccaactagcgccgcgacacggaaaactgacctcgccagtgctgccaatgaagtgcgtgtgccaaaccgatgactggtgcgcaggagcagacgctgggcgctggaccagcgcagtgtgagaatctggcggcgccaaggaccacttcagacgcggcccacgacggcgcaaaccaagacgaggaggccaagcacactgcgcgtacaatgggcgccaacagcggggcagcagggaccaaaccccagggacctgacaacacacaggaaggcaagacaaaagacaccggaccagagacagacggagaaccgagcaccgggaccctcagtggcacgtgcgtacacaattggctattggtacataacaactccaacttaccaacaactacaacgctaccagctgtctgctcactactcctgaataccacgaaagtctggcccacgtcgccacacacctcacgctctgaagccgccaaaaacatcgccaacaactcacacccggtaacaacgacacacgaaccgaactcacgacaacacagacgagccatacacaccccccat

SEQ ID NO: 704827 - DNA, 117 bp, Homo sapiens
cgactcatagaggatcccatgctcactcggcacatccaaacattcactcatgtgtcttctcgcatgtgacatactggaatcagagtttacctttctctacaattttgcaacaagaag

SEQ ID NO: 704828 - DNA, 148 bp, Homo sapiens
taatccctacatcatgcattgctcctacgtccttaccatggcacccttactatggaactcagtcatcaagacctgaatgtttcattcctttttcattaagttgacaaaatagaacaaggtgaccttccttccctgtggcaattcctca

SEQ ID NO: 704829 - DNA, 638 bp, Homo sapiens
  misc_feature (330)..(330): n is a, c, g, or t
attcagagttagatatcatttgaacttcaggtgtgctttaaaggctttcaaattgtaccgagtgatagcgtgtttcgttgacatcatgagatatatagaagcactccagcagtgtgctatattgggaagatattgggaaggaaatatatttgtcaagagatgaaggctgtatctatttattggactttttaacagtttgtgtcacttaaattcgtttcgaggatgggatgtattgttggcttgctgtacagtggcttttccctttgcatctgtagttctgtggtcacacgtgaccttgagcgtacagtagcagactttcccaaatgtatngattacaaataaccagttgttacttagcaagacctgagaaatatgtctcgcacggttctctccttgaagcaagatgtgtgggatcgatggcatttccgagaaatctggcctccttcgacctccggggacagtatatgtcatgcctcacttacttctagctgaagcttgtaaatcattagagcttgaaattgtgcagatcgttcatgtgcctttccaggggttatttagtaaagtttgtttgaagagcaaaatacgccttattctagggtcttgtttccaggtactctgaaggtccagcatcctgatga

SEQ ID NO: 704830 - DNA, 202 bp, Homo sapiens
tgactccaaatgttgactgcataggtgagatgattatacatgtgtaattgtcagtgggatacgtggttgctccagtgtcagcagcacgagtgtcgtgagacatctggttgtgaacttgtcatggtttcgctggtggcgcctggtgtttcacaatgctctgctgtgtgcttgaagtgaagcccttccacatgcagcttgctgc

SEQ ID NO: 704831 - DNA, 237 bp, Homo sapiens
tttgaagatccccgagatgcagctgatgcagtccgatacctagatggaagaacattatgtggttgccgtgcaagagtggaattgtcgaatggtgaaaaaagaagtagaaatcgtggcccagctccctcttggggtcgtcgcccccgagatgattatcgtaggaggagtcctccacctcgtcgcagatctccaagaaggagaaagttctctcgcaaccggagcaggtccctttctaga

SEQ ID NO: 704832 - DNA, 624 bp, Homo sapiens
  misc_feature (430)..(430): n is a, c, g, or t
agtctctacaaaaaataccaaaaagaaaaaaaaaaaagccaggcatggtggctgtatgtgcctgtagcccagttactcaggaggctgaggtgggaggatcgcttgtgcctgggagatggaggctgcaagtgagccatgatcatgccactgcactccagcctgggtgatagagtgagactctgtctcaaaaataaataaataaataaaatgaaagcaaaaaaaaaaaaaagaaatcgggtaacatctcttccccacgccttcatgcccatcctcccaactcttacggcccaccctcccactcctcccctcacacccccgcctccaccccacacacagaggaaacaagcaaaaacaacgtattgtctcttagaacttggaaaaggtttttgttaaccacaagtccaggtgctcagtatttgtaatttatagnctttgcttctatgtttttgctgaaaatatgactctttatcactctttaaaaattatattgtactgttgaccaagcatggtggctcacacctgtaatcccagcactttgagaagctgaggcaggaggatcacttgaacccaggagatcgagaccagcttgggcagcatagcagactccgtctctacaaaaaataa

SEQ ID NO: 704833 - DNA, 401 bp, Homo sapiens
aaatacatgcagtctccctataaaggttcttcaatcccatacctcaatgtatacaaatctgtaaaaatgtatacatggataaacatacatcaaatagagaaatcccaaagttcactttggggaaaaaaaaaagaaaaagttgccaaccagtctaagcaatactgaaaaccactgttgtctcaaataattgatgaatctcttacctttttcttgttgctttaccatttttaaaaaatgtgtctgaagttttacaaccattcctggatgtgaagtggaacgatagtggtttggggcatcagctggggtaggtcagggggataggaaaagcagaggagagttgcttgaacccgggaggcggaggttgcagtgagccgagatcgcgccactgcactccagcatgg

SEQ ID NO: 704834 - DNA, 497 bp, Homo sapiens
  misc_feature (380)..(380): n is a, c, g, or t
  misc_feature (382)..(382): n is a, c, g, or t
  misc_feature (384)..(384): n is a, c, g, or t
  misc_feature (386)..(386): n is a, c, g, or t
  misc_feature (391)..(391): n is a, c, g, or t
  misc_feature (393)..(393): n is a, c, g, or t
  misc_feature (397)..(398): n is a, c, g, or t
gtggagccacaatgctttgaccagtatcgagacctggtattttggaaggtggcgtcctcatctggtctacctctggggatctggttcatgggtttggtggagtggatcccccataaagaagggtggagatgggatccaaggaaagatccaagggtggtggggaattccattcccaaggttggtagaaagtgagggagaatccaggggtcgaacggccattaccagtttgacctccaaggtgatgctgtggctgccagaccaacaaatctggctctggcaccatgaacctcgggaggcagccttaccagacagatggagaaggatgaaactgtgagtgactgctccccacacatagccaacatcgggcgcctggtaggganangncntgtanantcannagtacgctgaacgagatctacttaggaaggacaaaggatatcgtcaatgagctgaggtctgtgcagactttttgctgacgaatccaaacaagaagctct

SEQ ID NO: 704835 - DNA, 269 bp, Homo sapiens
  misc_feature (152)..(152): n is a, c, g, or t
  misc_feature (154)..(154): n is a, c, g, or t
  misc_feature (156)..(156): n is a, c, g, or t
  misc_feature (158)..(158): n is a, c, g, or t
  misc_feature (163)..(163): n is a, c, g, or t
  misc_feature (165)..(165): n is a, c, g, or t
  misc_feature (169)..(170): n is a, c, g, or t
ctaacagcaaccgtagtgaagtatgaccatgtaatcccccagaacaaaaccataaggaaagactagcatcgtccctaatgagagatggagaaggatgaaactgtgagtgactgctccccacacatagccaacatcgggcgcctggtaggganangncntgtanantcannagtacgctgaacgagatctacttaggaaggacaaaggatatcgtcaatgagctgaggtctgtgcagactttttgctgacgaatccaaacaagaagctct

SEQ ID NO: 704836 - DNA, 266 bp, Homo sapiens
gggggggcccccccccccccccccccgttttttttttgggggggggaagggggccgggtttttttttcgggcccccttttggggggggggggggggggccccccccttttttccccccccgggggggggggggggggggtttttccaacccccccccccccccccccggggggtttggcccccccccacccccccccccggggggggggggggggggggggttttttttttttttttttttttttttaaaggggggggggggggga

SEQ ID NO: 704837 - DNA, 141 bp, Homo sapiens
atcacgctctgtacccagtgtcctgatgaaggtggcacgaagaacgccactgaaaagcccaggaagcaggccaaggagatggacgaggaagatagggctttcaagcagaaacaaaaagaggagcagaagaaactcgaggag

SEQ ID NO: 704838 - DNA, 277 bp, Homo sapiens
ggactgtgaaaggggaacgcatagtcactgggaactgggagctcagtactgggaaagcggagcacagtactgggaaaggggagcccatagtactgggaactgggagcacagtactggaaaagtgggagctcacagcactgggcacactgggagcatagcacttgggacaactgggagcacagcacctgggaacttgggacgcacagcgctgagaacactgggacgctcacaagtactgggaacactggacgcacctgatgctcgatgccagggagta

SEQ ID NO: 704839 - DNA, 135 bp, Homo sapiens
cagatgttatgggactcttctgattacctttctctccatagtcaactttgagatagggtgcatcaggacgtaactttttagtatataataaacctttagcgttcagttaaccatcttcatttatggggtaccgat

SEQ ID NO: 704840 - DNA, 382 bp, Homo sapiens
acactactgagtccggctagtttttgtatttttagtagaggtttcaccatgttggccaggctggtctggaactcctgacctcaagggatccacccatcttggcctcccaaagtgccgggattacaggcatgagccaccgcacccagcctactgaactttttgactagggaatttgttctctgttattgttttctggaaataagacgacagctaattcttatctgacatcaaagactcaggtggtgtgactttccgtgcccgccatcgtgcccgtcttcttcgcgttttcctggtagaggtttcatgcatgtcggcccggctggtctgcaactcctgacctcaagggatccacccatcttggcctcccaaagtgccgggatta

SEQ ID NO: 704841 - DNA, 203 bp, Homo sapiens
cattaaaatatactgaagatgaagtataaacagtgtttatcagtacgtggtgggttgtagccctttatgtttttaattactttgcacattttccccggatttttcacaaggcagcatgtgcaacttgtcataatcatagaagtgatgactattgtatttaagtatgggtagtcacagacgcggtaccgagactcgcaattcgt

SEQ ID NO: 704842 - DNA, 239 bp, Homo sapiens
  misc_feature (72)..(72): n is a, c, g, or t
taaggaaaaggctttttttattttaagaaaattaataaaactttcttttccttaaaggaaattacaaaatcnttttcctattttaattccattctttaaaatgtgctttaggctgggtgcggtggctcacgcctgtaatcccagcactttgggaggccgaggcaggcggatcatgagatcaggagatcgagatcatcctggctaacatggtgaaaccccgtctctactagaaatacaaa

SEQ ID NO: 704843 - DNA, 121 bp, Homo sapiens
catttcaactttgagccgcatttacagttcctcttatcacaattaacaacaatctatattttctaaaactatccagatttcattatcagggaaaagtttgcttaggtttattacagcagtc

SEQ ID NO: 704844 - DNA, 530 bp, Homo sapiens
gctaggccctcagcagaccttttaagctactggtttccaaggtgagctttgataagaagatgtaggtcatctaaaatgcagcatcgtgggcacttaagggaataacttcttcctctacttggatactagtccaaaacgctaatgattagaagctgatcttctctaattgccttacacctttctggcccagataaatgtttgtgaaccaaatacctgtaaagcaaactccatcatccacatagacaataactatggcagctcaccagttcttgggaagagtctgctccattgacaaataagccacagtgaggccttactgatgtatactggcacctcttccaacaggcatctctacccattccccagacccaaaaagctggacttttcaccagcactaaatctgcttgtaacaactaatcagctctgattttacctgactctgcggtgtgactgctctttgtcctttacctccatctctcccaaatacacacaacccgatccagtgctcaaaattgaatctgggcagcaga

SEQ ID NO: 704845 - DNA, 390 bp, Homo sapiens
cacgaagtggaggactacatcgtggtgattgagatcctggccacctgcgaccacccctacattgtgaatctcctgggagactactatcacgacgggaagctgtggatcatgattgacttctgtccagggggagtcgtggacgccatcatgctggagctggccagaggtctcacggagccccagatacaggtggcttgccgccatatgctaaaatccctcaacttcctgcacagcaagaggatcatccatcgagatctgaaagctggcaacgtgctgatgaccctcgacggagacatcacgctgggatggaccccgaggtggtcatgtgtgagaccatgaaggacacgctctacgactacacccgacatctggtccctgggcatcacgctg

SEQ ID NO: 704846 - DNA, 259 bp, Homo sapiens
gctgccgcctactactactaaattaaaggccggtacgacacctgatctgcggtcctaccgccgcgatctccatcgtgctctacgccagtgtcagcccgctggccgtgccgggtcccaggactacatcacgctcatcctgttgctgaccttcctggccggcgtcttccaatggctgctggggatgctgcgcttcggtgccctggtgaacttcgtttcacattcagtggtgctcggcttcaccctcggcgctgcgtcgacg

SEQ ID NO: 704847 - DNA, 540 bp, Homo sapiens
  misc_feature (402)..(402): n is a, c, g, or t
gtagggggacaagtagggaaattgagtcggagtggagatttagagatagattggtaaaagcggcggtaataagggtggaactgactctcctcagggaaaatcagagaggatgggacccattgtttttttcagtcagtaaaaatttctaatcccaagcagctgtactcatggggggggacggctttctctttccatgtacctaattattgccggcctcattccaagagggtaggtgaggggggtggagcactggttctacacaagaccctcggggtcacctcacagaggggagtcctccagaggggggggcttcacagccagactcctgggaagaatcttcggcggggggtgtcccctcctcactcctcagtggacaagggtcagcgtcctactcccacgggncggtgtccctgggggaccgagagtcactccatctagtcctcatcagggcttgagctcttgcaggctggttgttgggaccacccccattccctgaagcagtttttctcgtggttctttcccacctcattctcgtggttt

SEQ ID NO: 704848 - DNA, 181 bp, Homo sapiens
attgaggaggcaggaggagattgatgatgaggaaatagagcggcggcgtgacatgatgcgtcaggagcacaggagagaaaaaatgaagagatggaagtcatggcaagtggaagatgagggctcgttcgtggagaggagtcagaatcaagagtctgagatatgaaagagtacacagcacagg

SEQ ID NO: 704849 - DNA, 756 bp, Homo sapiens
  misc_feature (639)..(639): n is a, c, g, or t
agcaaactggcctttagaagtgtggcctggggaggagggagtcaggatgactaggctctgtcctgtgttggtcagtttgttgggctcgcatttatcgagtcctggttctgtaatcttagctgtgtgcttaggtggccacttcacgagcagagaaacagtatgagttctatgtgtgtcacttgcttttaacattctttgctcatcgttgacctatgcgaggttagctgtacaattttgctacctggatgaccacagatgcagcttgctcttttggctggggtgagtaattcaatgtaacagtgtatacagaatatgtcttgtactcccacatttgtaatgagttctatgtattccttgccttatcctttagttcttttctcccctgtgccttgtgtatcatcacctgccttgttcctttttctctggacttgtccatttctcactttcttccatatttgattccttctccttgtttcgtctcttcccctattttcctctatctctgtcctttcaccttcgctcgtgccttttctcttactatttatgcctttatcttcagtcttcgatcattcgcagcttcttctatactcttttttcacttccctctactaccttcttcttctcttctatcttccccancttgtatacttttcctatattcctatagtgttctctatctttctcattgcttttctatttctctccttttctctatctcttctctatttctttatatagtctctcctttcctcttcc

SEQ ID NO: 704850 - DNA, 116 bp, Homo sapiens
gagatcccgtgtagtactcacctcagctcagtggcagcaccgacgtctggccacggtgctggaggagatgccgccttccccgagcgcgagttcgtcatcctggccaagcagtcggc

SEQ ID NO: 704851 - DNA, 253 bp, Homo sapiens
gtgcccaggtatccagctctcagcatgaagcagtatctacttgttgcttcaaggaatgcatatagtattatagtgggaaagttgcaatatattatctctctacactgtgttgctagttggtgatcagctcttctgtcaattccacccatggcctgtctagcactcagctaatttctgaaggctttgaccattcgagcaaagtctgatcgctatataagcgtgtcattagaactattctaatctcttcatggtt

SEQ ID NO: 704852 - DNA, 185 bp, Homo sapiens
ctggtagttctcgaggtcccaagcttctcacgcctgggtccagtgtcaggaggccgatctctcatcccagcagcttgatcctcagtgccccacttctttctgcacagagtgatgggctgatggatttctcacatccattttggtgtcttatcaaagtcaatgaggcagtatccgttgagaagctt

SEQ ID NO: 704853 - DNA, 283 bp, Homo sapiens
  misc_feature (22)..(22): n is a, c, g, or t
  misc_feature (263)..(263): n is a, c, g, or t
gcagaccatggcttggcttcanatgtccgcttctctctgaggatcagtggatgacggtgtgggagtcgcaccagctggaaaggggcaggtcccaggggagccgcctcggggtggggaggccagacagcagctgcgctcacttccagggcaagattgctcagaattctggaagctcttctagcccagccacttgctacggattttccagttaaagacactgaaatccaggcagttccaatgaggtcaggctgaacgggccccgnagcagaacaagagcagcaag

SEQ ID NO: 704854 - DNA, 213 bp, Homo sapiens
ggtcgaccaaagcgctccaaatgtccacttccaggatactacaagaagactgtttcaaacctgatctatgaaagggaatattcagctctgtgacttgaatgcaaacatcacagagatgtttctgagaatgattctgtccactttttacatgaagatattcccgtttccaacgaaatcctcaaagctatccaaatatgcacttgcagattctac

SEQ ID NO: 704855 - DNA, 608 bp, Homo sapiens
taaaaaaaagataccctgttaagccctggattatacttagaaattgtaatggaagaaatgcatattaagttataatgccagatattaagcataatctgattctgaagataaaactgaagatatttttcagagccaatggccattatttctcccaattttcctagtatgcccccttaatttgtccagtttgctgttagccactgttatatgctgccctagagaagacttttggttgaaggctgaataatgaggggaggggataatttatgactgtgttaatacttttttgatccattagctgaataattccatatttgatatgtaacccatatagggatgtgttcgatataactatataggccagggataatattgatttggccacatctatttgatttatggagggccaaataacctgtttcttttagataccagcccttgccggggccattctaaaagttttctactaagataaagatgattgtgtatggctgggagcagattgctcatgcctgtaattttagtactttgggaggctgaggcaggaggatcactcaaggcccggagtttgagacccgcctgggccaccatgagaccctgtctctcca

SEQ ID NO: 704856 - DNA, 219 bp, Homo sapiens
  misc_feature (18)..(18): n is a, c, g, or t
  misc_feature (156)..(156): n is a, c, g, or t
  misc_feature (213)..(213): n is a, c, g, or t
cggtagtattatcttttnaatatgttgttggattcagttagctagtactttgtttaggattttagcatctatattcatcaggaatattggtctgtagttttctttttttgttatgtcctttcctggtcttggtattaggatgatactagcttcacngaatgatttagggagggttccctctctctatcttgggaaaccaggtggtcacaccangggaac

SEQ ID NO: 704857 - DNA, 847 bp, Homo sapiens
ggatataggcatgagccactgccccttggctcaacatagttttaacatatatatacttggattgggaggaatggtggttgttgtcgagatagagtcttgcctgtcacccaggctgagtgcagcggcaccatttgtggtctcactgcaacctccgcctgccaggttcaagtgattctcctgcctcaggttcccaagtagctgggactacaggcacgtgccactacgcctggtaattttgtatttaagtagagacggggtttctaccatgtttggccaggatggttctcgatctccttgaacctggtgatctgcccgtctgtggcctccccaagggtgctgggatcgttaatctttgaggcgtaattaccttacttatgtttcactcatcaacccttcaaaaaatgacttttacaaacaattcaaacagacttattaaacaattagtcttcacatcagaagtacaacttttgggcacacatccgtgagttactcagaatttgtgccttttcacacagttcttcctccctcccgggttttcctactaagtactacttttgtccttcatgtaagtctaagggggcggaagaaaaaaagcgggaaacggcaggacaagggcttgaacggcggaaaacggcttgacgggggaaagggagaacaatattgagatcttatgtgagtcttagaactggggtggatttattaagctttataaaacgtttataattgcctgttttttttcgcttaaacatcctgtctagtggatcttggaacgagcgtaagagctaagacattaaatgggaagagcacagggtttggactgggtgttaaaacacactttgaagagggt

SEQ ID NO: 704858 - DNA, 261 bp, Homo sapiens
gactgttccactcttggccggggattctcttcctccctggggaactttggccgggccccctttttttccctttttttcccccccggttttctggcccccggcctttgggagggggctgttttcccccggttttcccctccggggttccctggccccctcgtccaggcccccccccgggtttccgttccccgggccccgggttccgctgggggttcccccttggggttttttcccagaaaaattaagttaatttagggtgga

SEQ ID NO: 704859 - DNA, 280 bp, Homo sapiens
  misc_feature (87)..(87): n is a, c, g, or t
  misc_feature (98)..(98): n is a, c, g, or t
  misc_feature (247)..(247): n is a, c, g, or t
aggtgcagtgcagtggcacaatctcagcaccattacattccacaccattccattccattccagtgcattccattccatttcattccnttccatttctntccagtccactccactccactcgagtccattccactccactccagtcctttacactccactccaatccattccactcaactccattccacttcactgcactctgctacactccgtcacattccactcttttctttcgacagtctccgtntatcacactgtatgcactgcacctaacgggagg

SEQ ID NO: 704860 - DNA, 278 bp, Homo sapiens
tatctagcggatcttttctgcaccacagcaggtaggtggtgtttgtggtacaggtagtgactggtgatggtggtgatggtgttggtggtgatgatgttgatgacaatggtgatggtgtggtcatggtagtagtggtagttatggtggtggtgatggtcgtgaggtgatggtgatggtcgcactggttaaccgtggtgactgacttgaccaccactgactggtggttgactgactggtgttggagtgttgacggtgacttgctgacttggtttgtgact

SEQ ID NO: 704861 - DNA, 410 bp, Homo sapiens
gagtctagaggatccctgctggaattgagaagcccacgtctcagctgttatatagactggttcaccccagcagtggtcatgttgtgtgttgtcaaaacgtggggctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcaattccacagggggtac

SEQ ID NO: 704862 - DNA, 331 bp, Homo sapiens
agtgaaagcacctagtgaaaactgatttgataatataagatttaaaaatatgtaaaaggtaaatcaggttaaaggggaaattaacggactgttttgttgaggccagaaggaaagtgaatatgcagaatgagacacagcagggtcctgcacgcttgctaaaagaaggcccctcacttaagtgctgaggttcccggacactgaggcaaaaagggaaacatgactttgaaaagagtcagggtccctaaaataaagagcagctgttcaggagcatccctgtgttttaaaacaaatggggccaagagcaatttctctggggcatcctcgtcaagag

SEQ ID NO: 704863 - DNA, 1264 bp, Homo sapiens
  misc_feature (288)..(288): n is a, c, g, or t
tgggggggctacttctttccggtattctcagaatatgtcgtaaaagatggtgccccctataggggccatttccgttatcttaaacaaaaccaacattctgtggtgggattgtgaacaaacttagtgcttagtgactcgacgtgcgttagtggtggtgtagtgtcttttttatttttttcacaaatctcccttataagaatctctttttctctatatataattagagttctccttgtgtgaaaaacccttggagaaagtttcccgggccatgtgggaaattatagaaanatccccccagaggtggtctccgtggtaaatttaaagcttctccacgaggaaaatcttgtggaacattttataaatttgtgtgggttctatcaccttttatagatgtgttcacaccgagataactaagtgaagtgttagaggtgtgtaacaatattatataaagacttcgtgaacctcttacacagggtggggggaactctatttttatatatagaatataaaccagagtggtgtgttatcctctgtggagggtaagaataataacgaggagagggaactgtgtgatgtgattcacaacttagtgtgggggagagtggaagagactctttatataatagagggagggagaatgagagaggtggatgagtgttagggggggaaatataaaaacagtagtcacaacaaaatttatccgaacaacgtgtgtgagaaaacgcgcgtgtgtctccacacacaacgtgcagacaccgagctacgatgggaagaatagtggggacagcgagaaaatacctcccacaccacaggggagggagggggaagaaggaagtagtataccaaccgggtgtctgtctcaaacaagccgagactgattaaaacagaagggtcgccaccaaacaacgcaggggagttcgtgcaggcagccccatcttgtataaacaaagtctggtctgatctacatacaacacgaagcgcccgcagcccgacgagtagcagacgttctagtaaaagacacagagtctattacacacaaaagggtggggcccccaccaatagcaccacacgtgggtgacgaacgaaaaaccacccgaaagaaagaatagttcgggcgaagacaccaacaaccaaggaccgggggaacaacacatggagacaggagcgaaaccaagagagggcgggcagattacacagccaaccaaacggagcaaagctcgccccaggggaagacaagaatgaagcataatcaagcaacaccaac

SEQ ID NO: 704864 - DNA, 946 bp, Homo sapiens
ggtactggtcccgaaggtcgtttggatgcatgctggcacgcaccagtaatcccagctacttgggaggctgaggcaggagaatcacttgaacccgggaggcagaggtcatggtgagccgagatcacgccactgcactccagcctgggcaacagagcgagactctatctcaaaaaaaaacaaaaaaaaaaaaaacaaaaaacaaagatgagtcgcacatctggctggctggggatttcctacgggttggtctatgacagaatggaccatacttttaagatattaatgggagtataaatgggagtctataaggggtctttcatataactttaaactcttgggctatcctgggctctgatcatgatatgttggagcatagtagctccctaaactctgggagccctttcagaaatttccatgtagtgctaattaaccctttttacttgcacactgattaaagtaacctgactcagggtctgtggggctctgcaggcttagcctgtgtttgggtaggatgtccagatatatttctcagaaattttttaccaccttattttagcttattacttcaggttactctatttctcgtgcactaacttacgtgtccttcgtgggaacctatgatggggcttcaagggagttcaggtgtcaccgaatggcggggtaagtactctctacttgcgggaaaatcatggtaagtctgtggcggtatgacattttaggaaacgtcttatatagttccctttccagactgtccctttggactctaaatataatcataagtctgtgcttccattatgcagggtcacattccgtagcatcctgcgcaagtattgagccatactctcattcccattttggcgggtaaaatttgtcccttaccccgaagccctttaagtaaccccgggtaagtgggggcagaatcccgtctagcaatcccaaggtttcc

SEQ ID NO: 704865 - DNA, 391 bp, Homo sapiens
atagcctataatggtctagtcctctacccagtgcactttcttaataccattttccagttgatatgatataaaccactttcacagagagttagggcctacccttctgaccagccttggaaaattccgtgttgtaatgaaagttttcgcctttcacgtggaacctcatagtcaagcatattttaccaaccttttaaaaaattgtatacacagctaagattaagagtaaagtttgttaaagaagatacctttgtcactttatatatagatattattttaatatctcaaattgtggctcactctccatatagcgcctagaaaaagaggtctcagtgtgtttctcaatatgtatagtataatatatagagtattacgcgaggtttccccgcgtgcc

SEQ ID NO: 704866 - DNA, 535 bp, Homo sapiens
  misc_feature (501)..(501): n is a, c, g, or t
tgctgcaaacagatatggtgtcatctagcctttcacattccatttatagagtacaggtagagtagatttagcatagtttttgagggcactaagagtttctaaatggtaaatgaatattggcttcaatttgaagtcaccagatgcattagcccctagcgagagtcagcctgtcctttgaagctttgaagccaggcattgccttctctctagctaggaaagttctagatggcatcttcttccaatagagcactgttaattctgcattgaaaatctgttgtttagtctagccaccttcatcaattattttagctagatcttctggataaccctggtgcagcttctccattagcacttgctgcttcacccttgtacttttatgttataggaaagggcttctttcctttaaacctcatgaaccaacctctgctagcttcagacttctgcaacttcctcaccactcttaagcctttataggaattgaagaagtgtcaaggccttggntctttaattagggctttggcttaagggaaatgct

SEQ ID NO: 704867 - DNA, 561 bp, Homo sapiens
  misc_feature (4)..(4): n is a, c, g, or t
  misc_feature (97)..(97): n is a, c, g, or t
  misc_feature (237)..(237): n is a, c, g, or t
  misc_feature (284)..(284): n is a, c, g, or t
  misc_feature (300)..(300): n is a, c, g, or t
  misc_feature (303)..(303): n is a, c, g, or t
  misc_feature (328)..(328): n is a, c, g, or t
  misc_feature (332)..(332): n is a, c, g, or t
  misc_feature (346)..(346): n is a, c, g, or t
  misc_feature (365)..(365): n is a, c, g, or t
  misc_feature (380)..(380): n is a, c, g, or t
  misc_feature (439)..(442): n is a, c, g, or t
  misc_feature (459)..(459): n is a, c, g, or t
  misc_feature (496)..(496): n is a, c, g, or t
  misc_feature (555)..(555): n is a, c, g, or t
tgcnttcagaggggcaactttttattgtagagatctgcaaagtgctcattgtccttaggttgtctgttttcactcaaatgcccaaattctgtttttnactgacccaggctcactctgtgtgaacagttttaataccaccctcaacgtgggataaggttagctgttagcagcaaaattaagcagatgctttctaggaatattcctagggaagatggtaaaaaaaaaaaaacaaaaatntgaatttagcagtttgcctcacaagattttcacttttaaagaatacngtcttaatgcccaccnccnggcaatatccaggtaatatccagcncacnggttaattttgganggggggggggggggggggngacaagcagcaaggntttctccttagcaaaacagaaaaacgtgattctcttctcagagtacacctgaacaatannnntcatctaaacaacattnttacataatcatttcttcatttacttaataccattcntctttattcacacattattacatcataatcatcacattacatttcatatcaaattctcnaatttc

SEQ ID NO: 704868 - DNA, 948 bp, Homo sapiens
gaagtcagattccgcggatatacgagtgactccggagtctctgaggctcattatgcagttgtgaaattgtcgcgccgattgttagcaaatcagtgtatgaaccaatcagagtccttgggagtggagcagatgctcgaattgcatattcattgttgatatcggataggaattggtatctgtcttaggtcaaagatcatggttactatacttctatggtgctgtgagtgagtatcacgcaccgtcaatgatggggtgtcctggaatgcgtgtccttatgtggctgctagatattgtgccactgtgccccaccctgaaaagatgatcatcgcacacagattcacgacagacgttgccgttggtaggacctggaagtgtgggccattctggtgggtcgatggcctacgaagtgagggcgtggagatatcacgattggcttcaagggaaatgtgaaatcatcttattttgccaggtggacttttagatgacagtacgactagatgtcagtgaaggtgatcgcgggggtaaatgcagcatattacatttgtgtgaatgtttgcaaaatgagatcaatccatggtctatgagaacttcctgtgtagacttcgtttggtcacagcgattttaactttcaaattgtcattgagctggggtgactggtatgggtgcgcatgtcatttcggggaaccgttctgggtcagtttcataagttggcattgcagtgtgatggaggacgaagtgggttgaggctgtatatgaaggcatagagattgccaaatgggggtggagggagggagacaactattgtgttgggagaacttggactctgctggttggcctaggaagtggactgaggtggggacaaggtagagagcatcgggtagaagagtgtagtagactaatgtggaaagttttctctatcttctcttatttgttaatttttttgttggt

SEQ ID NO: 704869 - DNA, 2083 bp, Homo sapiens
  misc_feature (113)..(115): n is a, c, g, or t
  misc_feature (154)..(154): n is a, c, g, or t
  misc_feature (178)..(178): n is a, c, g, or t
  misc_feature (202)..(202): n is a, c, g, or t
  misc_feature (1446)..(1446): n is a, c, g, or t
  misc_feature (1448)..(1448): n is a, c, g, or t
  misc_feature (1455)..(1455): n is a, c, g, or t
gtggtgcaagaagaaagggggtgcaattccccccccctttcagtgaaaataacccccctttaattaaaagagcaaaccagggtgggtacagggtgtgactaagtggtacctgnnnctgaaatatcttccattcattgggatcattaagaagagnaggtaaggttcctgtgaactgggncaattccatttgccattaaacacncgagaattgtaatggttagtgattccagagcctctcttataaacacttagattataggatgtgcatttctccttagaatgaagtctgggtatttccatttgcatctggatttagatgatttagggacaaaattacctacatgtgataagttgaactcttcctaatgactattcttattcttctcttatttcatctttatctcaagacattatctttaattcagcaaatcaagtatttccctagaaagctatgtattaaaactctctatgaaaagttaaaataaaacatagagttgcctaaactgagaagttttgagtcactgtttggaatttcactccctcgctaatattgtatgtgaaatctgctgtgcaacatttgaaaatgaaattatgtttcctggatttctgtgataatttttgaattcttactagagtaagattattctgtatccataaggattaatattacttatcctttaacaaaattagaattgcccctaaagaatgctgttttagctacagcaacattgaaatttttaaataaatgtctcgtttggtagaaggcaaaaatggtctaaaatttattggtccattttttaaccaaatactttcatctaaatcaagggttggccaaatctgccccactgtctgtttttgtaaataaaattttctttgaaacacagccatgttcattcatttatgtactatcatctgtggctgcttttgtacttcagtggtagagttgagtagttgtgagaaagactggatggcccacaaagcctaaaatatttactatcttgtcctttacagaaaaagtttgccaacatctgatctaaaagataaagtgcagaatctggctgctctaaacattctggttttgaatgaagtcattttcactttactcttttgggtgagctcttaattctgtttccctaaagacataatgatcatgtttctattgctgcccatgaaattagtttttttaaaaaagtcttgatgctgtttaggaagtgatttggttgtacaactatcttgagaggtgggagggtgtatacattatagaatttccaagctagaagtgatcattaaggaatattgttattcccttaggactgtgaccaagtcagaaacttgagactgttttagtatagatgtaggcagtataatttaagtcttatagtaaccataatgaaaacacatacattttccttcttaatactttaaacttttaattatgataaattncnggctcantgaaaaactgcaagaatagcattctgtacatattctacatgttacacacattctagtgacgagtctagagaaaattcagtgaaaaattcctctaaacttttcactgagattccccagtgttaacattttaccttatttttttattgttttctgtttctgaactttaaaaaagtaagttacagcagaggtgggcagatcatttgagcccaggagttcaagaccagcctgggcaacaaagcaaaaccctgtctctacaaaaactaaaaaattagcgaggcatggtggcacatgcctgtagtcccagccacttgggaggctgaggtgggaggattgcttgagcccaggaggttgaggctgcagtgatccatgatggtgtcactgcactccagcctggatgacagagtgagactttgtgtaaaaaaaaacaaaacaaaacaacaacaactaagttatagatatgatgcccctggatattgtgtatttcctaaaaccaaggatattcttctgtgtaactttagtgtacttaccaaaatcagcaaatcacagtgataaaatactatgatctaatcagcagacctctttcagattttgccagttgttcacataatggcctttatagcaagaaaga

SEQ ID NO: 704870 - DNA, 1405 bp, Homo sapiens
tacttctttaacatctttaatgtcttatgatgatcaagcatgtatttaaatagtatttactgatgcctgttagcagtggtaagcacgtgtctgtttctgctcacaccccaagagtgtagagctttgagggttttgcagtcagtggtcccatgatggggcgttgggtgattaatccaatccagcttaggccacccagattcttagtctcaagggcttggtcatgagaaccttccagaggctcctgtgactcagtgactccagtcccctgggtggttcttggtgcaggtcacatgagggaggagaccgggcttttatagaactcacttcactgtctgttcaaagaaaagtgttacttgatcataacagctcaaaaaaatctgtttcttaaaatgagattttacctggatgcccatcagctgggaaagggaatatctattccccagttgatgggcacctagatgtacatagagacatatgtttgtacatctatgtaatatgtacttatatttgtagatagatacatggaattatctgtggccagagtccaaaacattttgagtgggaaaaaacaaattatagagtgttaagttttgtttttttttaaattctgcacaaaaaccaaacctgttcacaagggcttgtccaccaggccagggccagatgggccgccaggcaaaacagttttggagcaccttctgaatttccttgagtttacagaatgtttccttcaaagtaacacttttataaaaaattattattataaaagcaatgcttgtttgttataagtttggaaactccagggaagtataaagaaaaaatttaaacaatcccaaatttaaccatccagaggtagttaccaccagcatcccagccatttttgggccatgactatctacgttcacacatgtatacatgggtgtgtacatatatgcacacattcctagatattgtttcacttatttttctgtgttgctgaatattcttcgatggcacttcgaatgagtgacttgtggcccccttcttggacatttcccaactcctcactgatagaaacagggcttcactgggcccatccttgcctcgggactcattcctaggactgcccagctaaagggtctgagcttggtcaagtccttgggaggagcattctctggtgatcctggacagtggggaattgttgaccaagagaccggacaaagatgagcagatgccacagtcagtaaagcagggaaaatgcattactaaagtcagcttcattaaactggcgatctcttcttttcaaaagtccagcatgtgccacagaaatggaaagctctctggccactactgtcctgcccagggaggggagcgtgggtccacccacaccatttaatacctgtaactggatgcacctctgcccctacac

SEQ ID NO: 704871 - DNA, 495 bp, Homo sapiens
ttttttttttcacggtggcattctgggtttgggttttattggctttccattgagaaaggtggccagtgggcatcaagggtgccataaaggcccacagagctttgacctggggaccctgcttgttttccagaagtgacccaccaggagaggtggaccagagagctctctgcctggagggctgtggctggggagcacgaccggatgatgcagagctggaggaaggcgtgggtaagtggccgcagccgggcaaagaaaggagggctggagccaggggcagggcacctgcaacaatccagtggatctttcaagggccccattcagcatgggaccccacttgttccctcttagccccggagcagtttcctttatgaaatctgcaacactggggggggaaatcccacgtcttgttgctgaaactgcaggagatcaaggggcatctggccccagcccttaaaagagactgaagggaggcgagactgggagggactcacaggt

SEQ ID NO: 704872 - DNA, 232 bp, Homo sapiens
aggtcagtgaaaaagttggccagggaaataaatactcggagttgagcctgactaagtcatccggaaggtggagatcagagagaggctgcagtatggctgaggatctcctcagcattcactagcatcaccaagcccagcaccagtatccgctcagcctcacccgaaaccccgtcgtctatccccctgacggactcaagcaggacgttgaagtacacaattctcatagacaaat

SEQ ID NO: 704873 - DNA, 220 bp, Homo sapiens
ggctaacgtgcttctgctgcaccatagtgtttgtctgtgtgagatataatcgccgagacaacttgcactgctaacattgttgcgattgctaagagaccactctattactaggtgcactacacctagtagttacagtgggatgtggtctggtccacctgcctagcgatgagtacaatctgtcttaggatcgtgcttggcatgccattgcatcgaaagaaac

SEQ ID NO: 704874 - DNA, 1368 bp, Homo sapiens
cggcctcgtctcctaaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatggaaaaaaaaa

SEQ ID NO: 704875 - DNA, 162 bp, Homo sapiens
cagacatatgcacttcggaatcaactcaggcatgcacagctatccctgtgctggagttcattttaaaaaacaacgccccagttatcacagttatcttttatggttcaccacttttccagtaacacaaagaagctacaccaaaatttgggggggcagatcact

SEQ ID NO: 704876 - DNA, 881 bp, Homo sapiens
taagatcacagactgttttttgcaagaccacattgttctttcaggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatggaaaaaaaaa

SEQ ID NO: 704877 - DNA, 907 bp, Homo sapiens
tacttctttaacatctttaatgtcttatgatgatcaagcatgtatttaaatagtatttactgatgcctgttagcagtggtaagcacgtgtctgtttctgctcacaccccaagagtgtagagctttgagggttttgcagtcagtggtcccatgatggggcgttgggtgattaatccaatccagcttaggccacccagattcttagtctcaagggcttggtcatgagaaccttccagaggctcctgtgactcagtgactccagtcccctgggtggttcttggtgcaggtcacatgagggaggagaccgggcttttatagaactcacttcactgtctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatggaaaaaaaaa

SEQ ID NO: 704878 - DNA, 311 bp, Homo sapiens
tgcacaacctagggtcagtctgcaggtggtaagccatttaccaagatagttgtaggtaaagaagggcagacttattagagaaatgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 704879 - DNA, 260 bp, Homo sapiens
cgcaaggccttgccaggccagtggaccttgtgcagttcccaccggagccaggagctgcccagaccgcagacccagcccagtcacactgccgttatcgccaaacacatgctccctctgcagcagcatgggcttttgaaaagcacgcgcatgccgccgccagcatgcatgccatgggatccgcgcgttctccccggtgctctgcagagctgaggggtacaaactgagctgcaaacgaaacagtgtgttcccccttggccttg

SEQ ID NO: 704880 - DNA, 14715 bp, Homo sapiens
aggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaacatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttaaagtgtattagtcacgcatgtatggggaagtagtctcgggtatgctgttgtgaaattgaaactgtaaaagtagatggttgaaagtactggtatgttgctctgtatggtaagaactaattttgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcatataactcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgcgtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatatatatatatatatatatatatatatatatatatatatatatatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaa

SEQ ID NO: 704881 - DNA, 9223 bp, Homo sapiens
aacgcgctcctaggtactgcactctgcaaagggaaactgtgcatcggggaacaaagctcagccccaaggcggctatggctcaggatcgcagcgctatgcctagttctcacctagaccctaggctccccatagggccaaggagggtctgggctgcctctggctccgtgggcagagttcatatgccactccagcgctggagtggcatataactcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgcgtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatatatatatatatatatatatatatatatatatatatatatatatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaa

SEQ ID NO: 704882 - DNA, 255 bp, Homo sapiens
tcggaagtgaacgcagctgggattacaggcatgcaccaccacacctggttaattttttgtatttttagtagagacagggtttctccatgttggccaggctggtcttgaactcctgacctcaagtgatctgcccgcctcgggctcccaaagtgctgggattacaggcgtgagccactgcgcctggcccagtgtttttaataagtgaacagaagcactaatcatggagtttgaggggaaaagacctggggtccggct

SEQ ID NO: 704883 - DNA, 466 bp, Homo sapiens
  misc_feature (10)..(10): n is a, c, g, or t
  misc_feature (91)..(91): n is a, c, g, or t
  misc_feature (181)..(181): n is a, c, g, or t
  misc_feature (313)..(313): n is a, c, g, or t
aagggttccnattcctactggtgaacccccaacaaactgaaccctgaaccccagtgaacacggcaagcaccccatgtgaggaaacagcaanctggggtccattttcaccctccctccctagggaacccccagcaagagattgattgatgaacataagaatttaggggctgggaggccgggncgtggtggctcaggcctataatcccagcactttgggaggctgacgtgagtggatcatctgaggtcgtcaaaagttcgagaccagtcctgatgggtgaaaccccatctctactgaaaatacaaaagaattagnccaggcgtggtggcacacgcctgtaatcccagatacttgggaggctgaggcaggagaattgcttgaacctgggaggcaaaggttgcagtgagccaagatccagccattgcactccggcctggacaacagagtgagacaccatctcaaaaaaaa

SEQ ID NO: 704884 - DNA, 596 bp, Homo sapiens
aggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactggatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggctttgacgctgtttgtgcacacgtaagatcagagtagatgcggtcatctggaactggtctcaactgcaacaggtgtcgtgcgatagaa

SEQ ID NO: 704885 - DNA, 14661 bp, Homo sapiens
aggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaacatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatggttcaacgatgactgtagattggatttaaagtgtattagtcacgcatgtatggggaagtagtctcgggtatgctgttgtgaaattgaaactgtaaaagtagatggttgaaagtactggtatgttgctctgtatggtaagaactaattttgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcatataactcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgcgtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatatatatatatatatatatatatatatatatatatatatatatatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaa

SEQ ID NO: 704886 - DNA, 235 bp, Homo sapiens
caattgcaactatcggacttcagaattcctcctcaggcacctggcagcctgagacagcatacgctgggtcacggcacagccacctaaggaaagaatggaacggacacaccttgctcctattctgagcccgtttcccaaaaacccccttccaggtgcttctaatgggtgttgccatagcgtacgctgctaatgcatcatagcattctttgaactggtcgccaatccgggggatcct

SEQ ID NO: 704887 - DNA, 664 bp, Homo sapiens
actacatgatatggcttctagaggaatatattatggtatatgacaaggcaacgtaggggatttcactctgttctatgtgatacatcgctcaacaagatctgcatgagtccagattcactgtccctgctatgaaaagatgtcgcgtgtgtaacactgaatagccaagaccaccgttctaatatccaaggagtccgtgcacaatcttgcgagctgaattgacctacgtgtgactcgtctctcccggccactagagtgtagaagatgtacgataacccacctcaatttcctctgcctggactataactgttgaccagtatgagaaggttatacgtacagaactgcagccttttctgtcgccagcaattaaagaccaccaatcttgtttgtccatctacatggtttgtcggggacatttaactcatggaggtgctttagatttcaacatcagatggttgaagctggaagtttacttatatgtagagtgagaaggcagttccagttttagcacagatttgttaatgtgtccagatatttggtggagtctttaaattttttcaaatataagagatcatatcatctgcaaacaaggataattagacttcttccttttcaatttggatactctttattctttctgttgtctagttgttctagctaggacttc

SEQ ID NO: 704888 - DNA, 13928 bp, Homo sapiens
  misc_feature (14)..(14): n is a, c, g, or t
  misc_feature (73)..(73): n is a, c, g, or t
  misc_feature (84)..(84): n is a, c, g, or t
  misc_feature (87)..(88): n is a, c, g, or t
  misc_feature (95)..(95): n is a, c, g, or t
  misc_feature (105)..(105): n is a, c, g, or t
  misc_feature (107)..(107): n is a, c, g, or t
  misc_feature (109)..(109): n is a, c, g, or t
  misc_feature (111)..(111): n is a, c, g, or t
  misc_feature (117)..(117): n is a, c, g, or t
  misc_feature (124)..(124): n is a, c, g, or t
  misc_feature (127)..(127): n is a, c, g, or t
  misc_feature (134)..(136): n is a, c, g, or t
  misc_feature (142)..(142): n is a, c, g, or t
  misc_feature (144)..(146): n is a, c, g, or t
  misc_feature (148)..(148): n is a, c, g, or t
  misc_feature (158)..(158): n is a, c, g, or t
  misc_feature (161)..(161): n is a, c, g, or t
  misc_feature (165)..(166): n is a, c, g, or t
  misc_feature (177)..(177): n is a, c, g, or t
  misc_feature (187)..(189): n is a, c, g, or t
  misc_feature (193)..(193): n is a, c, g, or t
  misc_feature (199)..(199): n is a, c, g, or t
  misc_feature (201)..(201): n is a, c, g, or t
  misc_feature (221)..(221): n is a, c, g, or t
  misc_feature (223)..(224): n is a, c, g, or t
  misc_feature (227)..(227): n is a, c, g, or t
  misc_feature (232)..(232): n is a, c, g, or t
  misc_feature (234)..(234): n is a, c, g, or t
  misc_feature (237)..(239): n is a, c, g, or t
  misc_feature (242)..(242): n is a, c, g, or t
  misc_feature (252)..(253): n is a, c, g, or t
  misc_feature (259)..(261): n is a, c, g, or t
  misc_feature (264)..(264): n is a, c, g, or t
  misc_feature (267)..(267): n is a, c, g, or t
  misc_feature (271)..(271): n is a, c, g, or t
  misc_feature (276)..(276): n is a, c, g, or t
  misc_feature (301)..(301): n is a, c, g, or t
  misc_feature (304)..(304): n is a, c, g, or t
  misc_feature (307)..(308): n is a, c, g, or t
  misc_feature (311)..(311): n is a, c, g, or t
  misc_feature (314)..(316): n is a, c, g, or t
  misc_feature (322)..(322): n is a, c, g, or t
  misc_feature (327)..(328): n is a, c, g, or t
  misc_feature (331)..(331): n is a, c, g, or t
  misc_feature (334)..(335): n is a, c, g, or t
  misc_feature (337)..(338): n is a, c, g, or t
  misc_feature (354)..(355): n is a, c, g, or t
  misc_feature (357)..(357): n is a, c, g, or t
  misc_feature (362)..(363): n is a, c, g, or t
  misc_feature (366)..(366): n is a, c, g, or t
  misc_feature (368)..(368): n is a, c, g, or t
  misc_feature (370)..(370): n is a, c, g, or t
  misc_feature (373)..(373): n is a, c, g, or t
  misc_feature (376)..(376): n is a, c, g, or t
  misc_feature (378)..(379): n is a, c, g, or t
  misc_feature (382)..(382): n is a, c, g, or t
  misc_feature (384)..(385): n is a, c, g, or t
  misc_feature (388)..(389): n is a, c, g, or t
  misc_feature (392)..(392): n is a, c, g, or t
  misc_feature (396)..(396): n is a, c, g, or t
  misc_feature (399)..(399): n is a, c, g, or t
  misc_feature (406)..(407): n is a, c, g, or t
  misc_feature (412)..(412): n is a, c, g, or t
  misc_feature (419)..(422): n is a, c, g, or t
  misc_feature (428)..(428): n is a, c, g, or t
  misc_feature (438)..(438): n is a, c, g, or t
  misc_feature (443)..(445): n is a, c, g, or t
  misc_feature (450)..(450): n is a, c, g, or t
  misc_feature (453)..(454): n is a, c, g, or t
  misc_feature (456)..(456): n is a, c, g, or t
  misc_feature (460)..(460): n is a, c, g, or t
  misc_feature (464)..(465): n is a, c, g, or t
  misc_feature (467)..(469): n is a, c, g, or t
  misc_feature (474)..(475): n is a, c, g, or t
  misc_feature (487)..(488): n is a, c, g, or t
  misc_feature (491)..(491): n is a, c, g, or t
  misc_feature (493)..(493): n is a, c, g, or t
  misc_feature (497)..(497): n is a, c, g, or t
  misc_feature (508)..(508): n is a, c, g, or t
  misc_feature (511)..(512): n is a, c, g, or t
  misc_feature (516)..(516): n is a, c, g, or t
  misc_feature (518)..(518): n is a, c, g, or t
  misc_feature (522)..(524): n is a, c, g, or t
  misc_feature (526)..(526): n is a, c, g, or t
  misc_feature (539)..(539): n is a, c, g, or t
  misc_feature (543)..(544): n is a, c, g, or t
  misc_feature (555)..(555): n is a, c, g, or t
ccttttcgccgcantctaaaaggaatagggcgcgacacacaatccaatctaccggtcctaaccgtacaagcanttaatttattnganntttaagntcaagctttntncntntaaagnacccaanacntatgagnnngaaaantnnnancttaaaatcnagntttnnaaaacaaacgnccataaaaannntaancccatncncattttcgcgcgcactacantnnttntattngnggnnngtnagggggcagnngaaaannntcnttngttngcagntccctctattgtaattgcgtaaagnaantannaanccnnngggatnagttnnggnggnncnntaagttcacttcaaanntnaaaannaangngnatntgnanngtncnnagnnttntctnttntcccttnnatttnttaaatnnnnaaaaanatgttgacangctannncaggnctnnancaangacnngnnnatganncaaacaattacnntcntngccnatggacacgcnatnnacgnancaannnangcgcgcgcaagcntagnncttcgcgcgtnatgctgttgtgaaattgaaactgtaaaagtagatggttgaaagtactggtatgttgctctgtatggtaagaactaattttgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcatataactcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgcgtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatatatatatatatatatatatatatatatatatatatatatatatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaa

SEQ ID NO: 704889 - DNA, 481 bp, Homo sapiens
  misc_feature (393)..(393): n is a, c, g, or t
attcttccaaacttaggataaatgctaaaaacattgaccatacaagcaaagattaaattagcctatattaatcataataactgtttatcgcacatgtaccccttaacctaaaagatgaagaagaaaataaaaaataaaataaaatttgaagaaaatgttaaacaaaaatgaaaccataccagtactagaagaaaaatgggtgaattcctctttaacctaggcaaaggaaaggcttctctggctcccaatctggatttaattaatcctaaagtttgtatagaatcacaaaatacctcaaatagccaaaacaatcctgagcaaagagaacaaagctggaggtatcacactaccagatgccaaaatatcctgcaaagctgtagtaaccaaaacagnattatactggcatacaaatagacatatagagcaatggaacagaatagcgaacacagaaattaatccaaatatctgtaaccaactgatt

SEQ ID NO: 704890 - DNA, 13532 bp, Homo sapiens
ccctatagcaaacagacacttcaaaagaagacacacatgcggccaacaagcatatgagaaaaagctcaatatcactgatcattagagaaatgcaaatcaaaaccacaatggcataccatctcacaccagtcacgcatgtatggggaagtagtctcgggtatgctgttgtgaaattgaaactgtaaaagtagatggttgaaagtactggtatgttgctctgtatggtaagaactaattttgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcatataactcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgcgtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctaggtaagcaccgcatatctgtattcatgtctgccttggtcttttcaacatctgtgtggtagccgtgtttgaattacccattccctttttggggaaccattaagttgtttcagcaatttttactgtagataaggctataccgcatatctgtgtacatgggtttttatgtacatgggcaagtatatctgtgagagaaaagtttcctcaggaggaattctgggcacagcatgtgtaaatttctaaatatgatggacacccccagcttccacctcaaggaggttggtcccattgacatttccccacaccttcacccaggctgtgcccttaaacttggttatttgtcaatgtgagaagtggaaaatagtatttaattgtagtttggatttgtatttctattgggttgtatacttactgattaataataagagctctttacatattaaggaaattaacccttttcaaatacattcctatttctcactaatctttaagttttattgtaatattttgctctttagtttatatatatatgtatatatatatatatgtatatatatatatatacatatatatatatatatatatatatatatatatatatatatatatatatatatatatatatatatatacatatatatatacatatatatatactaattttcttttatggttcctggattttgtgagtagtttgaaaaggctaatccagctgaagattttgttgttgttgttaaaccccatgttttctcctaactctttttatttttattttggaggactctatctagacttaattttagcataacaagtgacagggttagttagcctgttgtccttacaccattttctggctaatacagctattaactattgatctgtctattcacgtgccagttcctaatggttttacatagtgtaatctgcacttcaaaatagcgaagggaagccctacctcattattctacttttccagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaa

SEQ ID NO: 704891 - DNA, 101 bp, Homo sapiens
ccagcagacctgaccacgtataaggaaggcaaagggcaaaatcgcttcagttaaactgaaattaaatgacacaataaggcaactatataagtaacttctag

SEQ ID NO: 704892 - DNA, 332 bp, Homo sapiens
cgcggcactccaaagggcgcgagcaccaggagcgcttacctgactcacgcgcccactgggagagcacttgcctgaaagacactgctggcgaagccagcgccgcgccgatcatggtttgataaggcgggtatcgagaccgaagcgctcttggctgatcagccggtaatggccctcggcaaggtcgcaactcaccagcaggttccatgaatggccggtcacggcagacgggatcagcacaaagggatgcttggccagcaatgtgtcggcgaacttctgctggtttggcgaagcggaagcgctcgatagccacacagggttcggcacgtcctcgg

SEQ ID NO: 704893 - DNA, 625 bp, Homo sapiens
atcgtggaagagcggcaaaaatgggggggtttataaaggtatcccgctcctgggcgggggttggtgttaaggtggaccccctcgttgggacggtggtatgaaaaaggtggggagtcctctataagagagttcctccctcccgccgacgttgtcggtgtcggatagcaggtcttaccggtggtgcaccctctgctatagcgcgagcaatctctttgtggtaggcgcgcccccgcccccattgggtggcgttccaggaataaatatttttctgggcgttatgtgagtgttaagaagaagacagagcgcctccccgccacttgtcaaaacttgggtgcgcctctctctagggcccctcgggggaacacacgctacattgttgtgctcttgtatgttgtcaacacgctcctgtagagtgtgtctgtttggcgagagattctgttttctacagcgtctctctatatgtgtcacgaaatttgtgagggtttaggaaaatatttattgtggaaagcggaggggcgacaagtgacagttatgcccacatattgatcattttttgggtgtccccgacgatgatggcccccgccaccactactcaccccccgcacccatcatagaacaagaaata

SEQ ID NO: 704894 - DNA, 509 bp, Homo sapiens
gtagtagcaagaaacagctactaggctgctaaaataccgtccaaatatgaaactgattattagtagtgtgtagaagcgtttacaagtggtactattatacgtttgaagagctaacagaatacaggtgatgatgatgaatgtggggctgggaggtgagaatgcgagacgtacgtggatattatcacgggttcatcgcgcacacacctgtggagaatgggggatcccagttaccgagagggggagcctgacggaagaatagtttctgggaagaagttaaagatttgggttctacacatgtttactctggctgcttaacttccagggacagatgttacttaagcagctagataccaaaatctggatttcaatgggggggtctgagctagattaataaatatgggagctttcagcataaagatgatatttaaagacatgggaactgactggagattatctagaagtaattcgaaatagaaaagaacagagtctggagaccaaataaggctcat

SEQ ID NO: 704895 - DNA, 691 bp, Homo sapiens
agcgggagggacatgtggccgtcgatcatctcgagatccgtcggccgtgcgtggacgcgggtgctgctgctgcacgatgttaggtctggcgtgagactcagtgggctgcactgatctgccagcgcatctcgttaccgcttccggcactcgagtagcagggcgtcaccatgtggacgctcgtgtagagatcgagcgatcgtacttctgtgctcctcccatagttcgttggagctagagtagagagcgtgctcggagctctctaagaagaagatcccgattatacggacgctacctctatcgtaaaccgacaacatgagacatcgattgcgtacgaagtttgagaccacgcacgagccaaaaaagacatcgcgcaatcccacgaggcatcgtatcacacagccgaagcaagttcggagtgctaggatcaggaccccattatcgcatgagcaggacgtatggaacaaggagcggatgggccatggggcaaggacgcaacatcaatgcagacgaaccagacgctcaagaccgcaccgttcgcaatccacgagcaagagggaagaccaagcacagaagtagctgtggcgagcacagaagcgagtacccccaggacgaatcgtcgactgccccgggccgtaagtcgagcagcgaggacaggaaagcccacgcgcggagaaatccggagggcaccccg

SEQ ID NO: 704896 - DNA, 272 bp, Homo sapiens
cccccccccgggggggccccctgggggtttttttttttccccaaaaaaattttttgggcaccttgggtttcccctgcaattaccccctccccaggggtttttagacccctccctttcggccaacctaggggccagggtgagggccccccggattacaccccccccccccccgggtggatggggggttttccccccccccccagggggggccgtccttagggggaagttaaaagggccccaaaagggccaaataaaatgtgtgtgccggggga

SEQ ID NO: 704897 - DNA, 432 bp, Homo sapiens
  misc_feature (120)..(120): n is a, c, g, or t
  misc_feature (149)..(149): n is a, c, g, or t
  misc_feature (188)..(188): n is a, c, g, or t
  misc_feature (210)..(211): n is a, c, g, or t
  misc_feature (307)..(307): n is a, c, g, or t
  misc_feature (383)..(383): n is a, c, g, or t
ctaagttcaagcgaccctttagggtgggaagaagtatccccccaggaagcatctgcaaaggaaaaaaattgtaatcatgattccaaagcaaaaatggctaaagttggaagagaagaaatnccaagagagaagacaaaacaatgcttgtnccaaggacttgaggagtgactttacaaggacttgtcagntggctcttgtacttctattggnntggtccttcaccatttccaaaggggttcttggagaccttgcaggaacaggaacagcaccttagccaagagggttccagcctcctcctagcctgggntctcctcgttaggtcccaggaataaattgagtcccattggcagcacttgcaggtattctagtccacgggcaagatntgcttagggattttgtggtacagccggtgaagagaaagtgagggttttc

SEQ ID NO: 704898 - DNA, 1210 bp, Homo sapiens
  misc_feature (543)..(543): n is a, c, g, or t
  misc_feature (568)..(568): n is a, c, g, or t
  misc_feature (622)..(622): n is a, c, g, or t
  misc_feature (850)..(850): n is a, c, g, or t
  misc_feature (856)..(856): n is a, c, g, or t
  misc_feature (921)..(921): n is a, c, g, or t
  misc_feature (942)..(942): n is a, c, g, or t
ggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcaagctgctgcagccacgagtagttcctcccatggtgggtggccctccttttgtaggccctgttggctttggccctggtgatcggagtcacctggacagcccagaggctcgagaagccatgttcctgcggcgggcagctgccggtcgcccgncctatggccctacggccccctcacnaggccctcgtgggccccctctgcctgggccccctggaccacccatgatgctgcnaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtggggggcaggaggtgccccagctggccctgcagtcattggggccagcntgccgntggccctggccatgccattgcccgagcctgagcccctgcccctcccgttggaggtcgtccgcggnctcctgccccgctgcgcattncgtgaacatccgtgtcccgtggtgttcgcatcgggtgcccgagacccgcctcggtgacgagaagccgatgcgccccctaggggtgcttcaatttggcttcctttggatgggtcccccaggagttcctcaccttggtggttgaaaggaccacacgacaagaagggggggaaatgcacaggcatccacagatttttgagagcttgggttggcatttctcggcacacatgggggggccttggtaacgcaggagatagggggagtgagaccc

SEQ ID NO: 704899 - DNA, 659 bp, Homo sapiens
ggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcaagctgctgcagccacgagtagttcctcccatggtgggtggccctccttttgtaggccctgttggctttggccctggtgatcggagtcacctggacagcccagaggctcgagaagccatgttcctgcggcgggcagctgtggcccccagagggccctatcctgcgtcagcttcgtcccccacgtgctacagagagcagattccgtctctcctctgcagaggcggtcctccgtggccgggcccacgggctgggggggcccttgtgtgg

SEQ ID NO: 704900 - DNA, 861 bp, Homo sapiens
  misc_feature (501)..(501): n is a, c, g, or t
  misc_feature (507)..(507): n is a, c, g, or t
  misc_feature (572)..(572): n is a, c, g, or t
  misc_feature (593)..(593): n is a, c, g, or t
ggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtggggggcaggaggtgccccagctggccctgcagtcattggggccagcntgccgntggccctggccatgccattgcccgagcctgagcccctgcccctcccgttggaggtcgtccgcggnctcctgccccgctgcgcattncgtgaacatccgtgtcccgtggtgttcgcatcgggtgcccgagacccgcctcggtgacgagaagccgatgcgccccctaggggtgcttcaatttggcttcctttggatgggtcccccaggagttcctcaccttggtggttgaaaggaccacacgacaagaagggggggaaatgcacaggcatccacagatttttgagagcttgggttggcatttctcggcacacatgggggggccttggtaacgcaggagatagggggagtgagaccc

SEQ ID NO: 704901 - DNA, 378 bp, Homo sapiens
tcacgccatgtccacaagccatagacaaaagcactgtctgtgtatgcactgacatacctctcaattttttttttcctcttattgcccaggcgggagtgcaaaagtacggatctcggctcacggcaacctccgtctcccggattcaagtgattctccggcctcagcctcccaagtagcctccaagtggcaagcaggcgccagccactacacccagccaatttctgtacttttagtagagacagggtttcaccacgctggccagactggtctcgaactcccgacctcaagtgatccacccgcctcaacctcccaaagtgttgggattacgggtgtgagccactgctcccagctaggaccagctctttgttagccatgtgg

SEQ ID NO: 704902 - DNA, 220 bp, Homo sapiens
ctaagacggagcaccaggtgcggggtggactctttctggatgtggtcatcttacagggtgcgtccatgttacagctgtttcccatcaaagatcaacctatgctggtcaggaggaatgccttccttatcttggatctttgccttgacattctcaatgggtgtcactcggctccacctcaaaagtgatggtcttaccagtcacggtcttcaccaagatttgc

SEQ ID NO: 704903 - DNA, 253 bp, Homo sapiens
aggtctgagccaacacgagttgggagtgagttcttgtatctgagaactagtgcttgtgatcagaaatacctgccctatgctaaccaccagaagaatgaaggcttctcctactgaccaataggccactcttgtatgtagatcctctgcggggattcggccttgagcttctcttaaacggaaatgagtctgataatcgatgacagacttcagagctatcgtgaattgaaacacaggcagattccatctgggtcag

SEQ ID NO: 704904 - DNA, 272 bp, Homo sapiens
aacgcactgacacactcctttgtacctgagctgaagcagcaccttgtctgcggggaaaacagtactttgaccatcgacagcagtcatgcctccccagtgcataagttcaagcagcaccctgcctttcaggtaacagtgtcttgggcatcctaagcagacacacagtccagtacctaatgtgaagcaccttactgcatccgaggaaaatggcgcctgcaccaacctaaggtcacacaccctagacctcagctgacgaggcacattaccctctg

SEQ ID NO: 704905 - DNA, 196 bp, Homo sapiens
aatgcagccgacagctaacaggctcaccccttccattccggacatatcctggacatcttttcagtcctgtgaagagtctctctggaaattctgagttagatacaaaagtacagaaatatcattacacattcacccgacctggattacatttaattgtactggaacagctacaacaatctgccgagtccgctgcatt

SEQ ID NO: 704906 - DNA, 350 bp, Homo sapiens
caagatatagattgtggattaaaggtaatagctgaacaggagggttgtggtgagaatgaaaatcagggtaggaaagagcaggtgggtaaaagtggtagcaggtaagtttatgaggcaaacaggtttgagatcatatggacaggctagaggaagactttctaggtggttattagttattatcaatattctactttttgtgttgggtgatgaaattttgggtgcttattttatgatggatatatagagaccatatgtagaccaataatgtaaatgtgtcataaaacaagaattgtgaatacctaatattgtgtatgtaatgtaaaaaatgttttctgtggatgtaaaaacta

SEQ ID NO: 704907 - DNA, 118 bp, Homo sapiens
ccaagacgaaaaaagaaaaaacaagaaaagacacaagaagaagaaaagagaaggaggagaggagcaaaaagccaagggagaccggggttaaacgacatatgtgggccagtcgcgtttt

SEQ ID NO: 704908 - DNA, 415 bp, Homo sapiens
cccagatcaatgttctatggtttcaatgttctatgagctagagcattgtagaagctcagctgaaccattgccatcaaccaataggcttatgtctaggaaatcctttcaagtaagaagaaaatctggggatgggcaagggcagagaaaaaagagggaaaattagaaaacaccgtgcctatctctacgtagtggatgctgtgatatgccacccaggtcctgccttcaggacaaaggcactcattcccccacctgcttggagtgattctttctgacggtgcacagctgaatttctcccaaagaattgccctcagagtaagcagctgcctcagccaagggcacacccattcctggggcagcctacaattaataattggtcagtatagggattcaatggccagccccattgcctcaattc

SEQ ID NO: 704909 - DNA, 592 bp, Homo sapiens
  misc_feature (28)..(28): n is a, c, g, or t
ctgtctagaaatgtaatcctttagattntgtctgtaatgtggtgttggttcttacagaactctaaatagtatatatagtatttttcaagccgaaaagtctctggagatatgatgttaaaaggtgtatccatgcctcaagaatcacccccctccaaaaaataaggtagtgtggcataatcaagtaagttggggaaatgtggcattaaataagatttaacctgtctttactgtataatttagaacttttaagatgttgtatacaatgaatctgcaaaatggatatggcccacggcatttgagacttgatgtcagaaccccttttttgtaaaccatctattgaagtctcagtggacacaaagtgctttgcagaacacagttttggaaagtctgataactacagtaacgcgatccagtattgcctggaaatgagctgttatgtttaattgactatattgaagtgttttctttaactgtcaagagttttgtttcattttgaattgaaatctttctaaattaaattgtataaaaatgttccgtcttaatagtgaatataaatttaataataatttaaataaaagttaaaaataataaa

SEQ ID NO: 704910 - DNA, 202 bp, Homo sapiens
atagtaggcaactcacatcccaactatagacactgccagccacagatccaaatgcccaagtctaatatgccttgttaactgtaccccgcctcagcaacatccctccatttctattcacatgctcaatgcaccagtataatgtgtctcccaggaagcttgctctggataataggaaaattccagtccctgacatcttgtagag

SEQ ID NO: 704911 - DNA, 191 bp, Homo sapiens
tgatgcctgatgtatctcagctcatgcaactctgctccgggtcatgtgatcttgtgctcagctcctgagtagctgggattacatggtgtgtccagcatgcctggctgatttttgtattttacgttagagatgggttatcgccatgttgtctatgctgttcttgacctcctgaactcaagtgatcctcctgc

SEQ ID NO: 704912 - DNA, 280 bp, Homo sapiens
aggctcaaggtggtcaaggggtttttctaaggccccatggcagcaggtgatagagcctggattagaaccgaaatttggtgcactgccttcaactccagcttgttgtttccccttccccttggggcccctcctcggattatttggtggggtgggctttcagcccccccccttttctcctcacaactcaagtgagcccctctgggtctgtggcttccatgcccatttttcttttttctttttctttctttttttttttatttgggacagagcgagaaactga

SEQ ID NO: 704913 - DNA, 572 bp, Homo sapiens
  misc_feature (39)..(39): n is a, c, g, or t
  misc_feature (43)..(43): n is a, c, g, or t
ccgccgccctttcaattttccccggaggccactccagantttnaggtgttgggggcgggcctccccccccggcctttggtaaaaaagggcggggggggccctcccccaaacccttaagcctgggccaagccggggaccctttacccctaaaagttttcgggttggggccggccacaaccccggccccttttggaacttcccctttggggcgggcccccgaaattcccccgggggggtttaagggtgctttagggccaaattaccccccccccccgggtggccaaagttcgggttccaaccctcccctaaaccccggggccccccccgcgaaaaatcccaattttcccccgggccccaaaaaggggtttttttcaaaattggtttcccccttccccaaaaggggccgggggggggggggggccccccccatttcaaaaaaacccccaggggggggggttccaatttttggaaaaaggcccccaaagggtttaaaaaggggccggcccgccaagaaaaaagggttttttccaaaccttttcctaaaggtttaaaaacggtttttgcccctggga

SEQ ID NO: 704914 - DNA, 188 bp, Homo sapiens
  misc_feature (106)..(106): n is a, c, g, or t
actctagaggatctccaatgcagggactcggcatcacgtgttatggttgagtgatggcacgcagcgtgcctagaaaccgtctcagtggagctgtctgctgtgtcgntgacagtctcccagggttgtcggtctgacgaattcgagtgacgttgtggctgtggggtgctgcgatgtccccggggcggcag

SEQ ID NO: 704915 - DNA, 162 bp, Homo sapiens
tcccggggggccccccttggggggccccccccccccgggttcccctttgggtttttttcgggcttttttccgggaaaacccccttggggggggtggggaggggccccaaaaattttttttttttccctggcccccggggggggtggggggtttttcccggga

SEQ ID NO: 704916 - DNA, 405 bp, Homo sapiens
  misc_feature (320)..(320): n is a, c, g, or t
ggtcttagtaatcttctatatagttaatgagctaaaaaatgatacttaaagttccaggttggtccgctagcatgaaacatgccttcctacactcccacatgttcctcagaaaattattttaagagttgtgaaaccgattaaatatctatattcgttggcctaatttaaaataatttataccagctttggtattggtgtcatcaccacttatgccaaattcccaaggaatcagaaaactggaggttagccatctccattatttccttttgcacattgggtacagtgggtggcattagtatgcactagctgcaaagtcacangcaccttatgggaacaaaccttacacggctttaacttggatattttaacttttaacttacatttaaccaacaacagcttttacaa

SEQ ID NO: 704917 - DNA, 115 bp, Homo sapiens
gccagtggtatagaaagagaagaaaaacagtaagcaggcaggaccatccgaacagatcctcaaatgctgcccatggacctcactctccctgtaccccgacaggaaggctggctgg

SEQ ID NO: 704918 - DNA, 204 bp, Homo sapiens
tctagaggatcccgggcaggctgactgaattactaccaggtgccgctggcgcgtgtggtcgaggacctggggcgctactacccggggcggatcgtcttgctgaatgaggaactcgggcagcgtaaggtcagtggcagcttccccttggccgagccgctgctggcactggattcgctgggcaaggtgatgggcttttcacggcag

SEQ ID NO: 704919 - DNA, 117 bp, Homo sapiens
cccccccggcagagctgccctgaacatcacctaagaataatgccaggtgttctttaaaagcataacagcacctgggatccggtaagctagacgtatgacggcagtcaggctggactg

SEQ ID NO: 704920 - DNA, 344 bp, Homo sapiens
tagccacaacagggtcaatgctcgccttgcaggtgcccccagcgaggacccccagttccccaaggtgcagtggccactccgtgaactttgttctgcctgccacaatgaacgcctggatgtgcccgtgtgggacgtggaagccaccctcaacttcctcaacggcccacctctccccaagcaacatcatcctggacttccctgcagctgggtcagctgctcggacgggatgttagatatttgcttcctcttcagcattgtcgatgggagctttcgatctcgtaatcccgtttttaactctggaccctgggaagcctgagatgatgaagtcccccacaaacaccacc

SEQ ID NO: 704921 - DNA, 907 bp, Homo sapiens
gagtgctggaaatttatctttgacagaggaagaatgcttgtgaaaacgagttcttacgtgatctttatgtaacttagtttgccctggaagggaaatgtctcgtctctggctatgggacaaagcgggagaacgacagtcaaccatcttaatcataaatacactctggtagtgtcagtggctgagtatcaccgcaggatcgatgctctaaatactgaacgcaaggtgcgcacactctgcagacgcctccagattattacaggggaagacataatattcatgagcaggttgctacagtgaaagcacggacctggagtctgaacctgttttcgacactaatacctaagtgatcccagtgaactttagtgccagatcacattgaaatagcttaccaagcatctttcaccaagaacaaattggctagtccatggactcttgtttactggttacgtggatagaacatggcacaagcttgagaactctttatcgaacaagtgacaggtttagacgccccagtgctgactggtgattaaacgacggtgatggccaggtttggtgcgttagcatctgagcactgaaagtgagttgatggcttctatggtactggagagaccttgtcttctacatttctgtcccgggtacgaggtcttgaagtggaccgggatagtatgtttcagtccacggcgcctgaattcccagcttccgggtggacagaaggcacctgcgcttgcctgaggagatcctacaggacaagcctcttggtaacgttggatctccctgcacaaggaaatcttttaccaaagtgcaatcggcctcgaacaaccacctgtttaagagaaggcaccctgtgtaatgtgtactacacaccggctatgtgtcaccgtcaatgcagaacaatctccctcacacg

SEQ ID NO: 704922 - DNA, 319 bp, Homo sapiens
agagagagaaggtttttaagggaggggcttctcgataacttggggagataacgggaccgacccaaggaccacactcccaggggtgcattccgttgctccctcgggcaccacttctgggattacagtgtgccaggtcctttggaggccctaccccttcccattcattgccaccagtaagaaatgggggtcccctctttaaagaaacctaccaaggtttacatttgcacctagcctcaatagctacgacccctagagaggcagctagctggagctcatgtcccactcctgattctcaggagaaagatggatttaccccaaa

SEQ ID NO: 704923 - DNA, 250 bp, Homo sapiens
ggtcactcacggaccgctatgcacgccagcctgtgcaacagagcgagacatgatgatctgtcttaaaaaaaagaaaatgaccatatatgtgaggatttatttctggtctctccattcagttgattggtctttatgtctatctttatgtccttactgcactgttgtgatggctgtagctaaatggtacacttaaaaatggttaaaataggccaggcacggtggctcacgcctataatcttagcactttggg

SEQ ID NO: 704924 - DNA, 842 bp, Homo sapiens
tcctccaggggcttttatttcccggtcaaaaaaaaagcgggacaggcccctctgcctgaagccctggcaaacacaacacagaaagaccgggggatgggcgcggggagaggcacaggaagacgggcttctcagcaattgtgtcgcactgggtcccttgtttggtccctggctgggtcagggaaggcctgccggggttggtggcactgaaacgcctgggggaacaggcgccaggccagtggcccagggacggcacggacggaggcaataaattactgattggccaggcggggcttcctggttggccccaggttgggttggcttaggaggttgtccatcgagggctctatgggcgggttgtgggctcatgggcactgcccgcatgaaacagaaaaggcagagcgcaggacaattacccagccttccgtggagtggtcactgagggtgacttgagttttgggcaacttgggcttttcccaaagccgccggagccatctcaagaagcccgtgttccagggaagggggcaggcttgcccaggaccgtggatggcactgtgggagcagcagaaagcaacaccccaggtgtcccgtgggatcaaggggatacgccaccgggggaaagggcaccgggaggccaccatgcctcagtgacaggacacaaaggggagattacgagggcatagatgaacgcccccgaggggtaacactgtccaccatgtaagagggcaatcaaacgggcttaagaacggcgcacgcgagagagaacaggggggcgctctggccaagtgaacacacggaggcattggagcagaggccaggcccccacaaaggccgggaactcacag

SEQ ID NO: 704925 - DNA, 345 bp, Homo sapiens
ggaaaagttgcaagcattccctctgagaactggaacaagacaaggatgcccaatctcaccacccctcttcagcatagtactggaagtcctagccagagcaatcagacaagagaaagaaataaagggcatccaaatcagtaaagagaaagtcaaactgtccctgtttgctgttgatatcatttaccttgaaaacccctaagtcgactccagaaagctcctagaactgatagaagaatctggcaaagtttctggatacaatatttaggtatagaaatcagtagttcttctttacttcaacagtgatcctagctgagaatcaaatcaataattcatccccttttacaa

SEQ ID NO: 704926 - DNA, 962 bp, Homo sapiens
cttacgttgaacacgtgtgttcctagctgacactggactaactggatagttatatttggctgatgttcttaaccctactcctcaataatatctattggagagtcggtatcctcaaaggtggccactgctatagcaaatcgagcgttgggccaagccaccgagacctgtgtcacttctctctcgtggatcatcgtatagtggacggtacgagctgagtaagtcctctctgagatacttcgtatatgaatcagtgcggcccaagtgaagaatgcaagagagccatgcaattctcggtgagcagaagagtttgacttcttgagtggcagttatttttgctcaatcgcacaccgaattgtacatccccttgcggtgcaacgcattgattctctttgtccggggactacaggaaagaaaggacactggatgttcagaacattgaatagtgtacatgctctaaagaaagactgatgtaaagtaaatgaatgaaatgggctgacaggacttaatttacctaacaatgattaggacctgttctgcatggatgtgtcatatggtgtacactagcactgtaaatattggaatccgtgagtaatctcaggaattcaggagtatttgaactgatggggatattgaactatggtcaggagagaggagtccatgagtgttggagatctagtgatgggctttgtgagtacactttggttattgttgcaggttttgtgacctgtgaatatatgtaagttctctagtgccttgaaatgggatcggtgaggaaccgtccctttaaaagattttgacttaacgtggagggaggtacatgttcatatatctgcaaaatctgattgtgatatgtcaaactataactttgaagagtattgttggtaattaggattttctcacagggcgggaagcgtatttaatataggcactgagtgctaaactgattaagatcaagtcaatac

SEQ ID NO: 704927 - DNA, 778 bp, Homo sapiens
cagacggctgacggctcacactgtgccgtgagcgatggggagatgcaggaacactatgatgagtttgttgaggaggtttttacagaaatggaggagaagtatggggaagtagaggagatgaacgtctgtgacaactcttgggagagcaccctggtggggaacgtgtacgtcaagtttcgtccgtgaggaagtatgctggagagataggctgtgatttgacttgaataagccgttggtttaatggacagccgagtccacggccgagctgtcacccgtgacggactgtcagagaagcctgctgccgtcagtatgagatgggagaatgcacacgaggcggcttctgcgaacttcatgcatttggacatgcccagttttccagaagagctgcggcgggcaacgctgtatggccgccgtcgctggaggcgtagatcaggatcccgatcccgggagcgtcgtggctcggtctagagaccgtggtcgtggctggtggctggtggctggtggtggcggtggcggcggacgggagcgtgacgaggaggcggtcgagagatcgtgacagcgatcgtgggcgattctgagcgcatgccgatttttaccttatgtctgcgtagaaagtgtggtagtgaggtggagcaataccggttcatagggggaatttggtgtaaaaagagcaactgaaggaggatgatccaagggtgggttgctgagttaacattgggtcgcgcctgagcggttagcaaaccaagggcgggggggcaagggtttccgcggggggcca

SEQ ID NO: 704928 - DNA, 389 bp, Homo sapiens
gcacgaggagaagaggatggagatgaacatgaggaagctgactcagctacggacacgcgggcagctgaagatgatgaggatgactatgtccataccaagaaacacaagaccggctaggatgactacacagcaaaaaaggaaaagtctaaactaaaaaaaaaaaggccggcgtgacctattcaccctacacttcccgtataaaaatctaaacgcggtcaccttcaagtaaagaggcccgcccgcccaccgtgggcagcgccacccgcatatgacacgcgctctccaccacccaacccaaaccatgataatttgcaacaggggaggaaaaaagaaccaaaccttccaaggccctgctttttttcttaaaagttctttaaaaaggaaatttg

SEQ ID NO: 704929 - DNA, 455 bp, Homo sapiens
  misc_feature (88)..(88): n is a, c, g, or t
  misc_feature (112)..(112): n is a, c, g, or t
  misc_feature (124)..(124): n is a, c, g, or t
  misc_feature (126)..(126): n is a, c, g, or t
  misc_feature (138)..(138): n is a, c, g, or t
  misc_feature (150)..(150): n is a, c, g, or t
  misc_feature (169)..(169): n is a, c, g, or t
  misc_feature (172)..(172): n is a, c, g, or t
  misc_feature (175)..(175): n is a, c, g, or t
  misc_feature (374)..(374): n is a, c, g, or t
  misc_feature (410)..(410): n is a, c, g, or t
  misc_feature (445)..(445): n is a, c, g, or t
gcacgaggcaacgggagtgggagccccaggatttggggttgggaacgagattgcacggattgttttaaaaaaatggcagacaaaccanacatgggggaaatcgccagtttcnataaggccaagntnaaaaaaacgganacgcaggaaaanaaccccctgccgaccaaanagnccnttgagcaggaaaagcggagtgaaatttcttaagatcctggaggatttcctacccccgtctttttgagaccccagttgtgatgtggaggaaaagccccctgcaaaatggacacgagccccaagctgccttgtgaacttgggcactccgcgccgatgccaccggcctgtgggtttttaaagggaccccccccccatcgggnttgccaaattttccggtttgccccgggatattatanaaaattatttgtatgaataatgaaaataaaacacncctcgtggca

SEQ ID NO: 704930 - DNA, 497 bp, Homo sapiens
  misc_feature (210)..(210): n is a, c, g, or t
tcgcttgaggttgggagttggacagcctgggcatgtagcaagaccccgtctctacaaaaaatgaaaattagccgggcatggtggcgcatgcctgtagtcctagctactcgggaggccaaggtgggaagatcacttgagcctgaaaggttgaggctgcagtgaaccaagattgtaccactgcattccagcctgggagacagagcgagactntgtctcaaaaaaaaaaaaaaaattcatttcctccactcatggcaaacctctcacagctcccactcctatcgggggaattcacttcaaactttacggagaaattaaaggcagctctggtcatcttttcaccaccaattctacaaactggtctggatgggtcctctggttcggtcttcctttcattggttatcggaagaccattccggacggtcggatttctctactggggactcagatttcatctttccggcatctcggtcttccatatcattcttctcctcgctatc

SEQ ID NO: 704931 - DNA, 1089 bp, Homo sapiens
  misc_feature (88)..(88): n is a, c, g, or t
  misc_feature (112)..(112): n is a, c, g, or t
  misc_feature (124)..(124): n is a, c, g, or t
  misc_feature (126)..(126): n is a, c, g, or t
  misc_feature (138)..(138): n is a, c, g, or t
  misc_feature (150)..(150): n is a, c, g, or t
  misc_feature (169)..(169): n is a, c, g, or t
  misc_feature (172)..(172): n is a, c, g, or t
  misc_feature (175)..(175): n is a, c, g, or t
  misc_feature (374)..(374): n is a, c, g, or t
  misc_feature (410)..(410): n is a, c, g, or t
  misc_feature (445)..(445): n is a, c, g, or t
gcacgaggcaacgggagtgggagccccaggatttggggttgggaacgagattgcacggattgttttaaaaaaatggcagacaaaccanacatgggggaaatcgccagtttcnataaggccaagntnaaaaaaacgganacgcaggaaaanaaccccctgccgaccaaanagnccnttgagcaggaaaagcggagtgaaatttcttaagatcctggaggatttcctacccccgtctttttgagaccccagttgtgatgtggaggaaaagccccctgcaaaatggacacgagccccaagctgccttgtgaacttgggcactccgcgccgatgccaccggcctgtgggtttttaaagggaccccccccccatcgggnttgccaaattttccggtttgccccgggatattatanaaaattatttgtatgaataatgaaaataaaacacncctcgtggcatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaaaaaaaaaaaaaaaaaaaaaaaaaaaaaaaaatggggccccccttgcccaaaccaatttaaaaattaaaaaattttaaaaatgcgccccaaattgggcccaaatggccaaaaccccccaaaaggggggcataaaaaaaaaaaaggccccggtttaaaaaacctcggaacgggaaaaacccgggggtacccaaaaaaaaacccttggaaaaaaaaccccttttcccaaagggggaaaaaacaaaaagggccccaaccaaggccctttaaaaaaaattgccaccccaaaagggcaaaggaaaattgaaagccaaaaaatttggaaaaaacccccgaaaaattttggaaaaaacgcctattttttaaacaaaggccccaaatgcggaaaaacccctaaaaacaaaaataaaacccccaaaaaggttaggggtttcccaatttggaaaaaggcccctttaaaaaacaggggcccaaactaaaagggaaaaaaacccttaagaggcaaaggcccatttggaaaccacccccaaa

SEQ ID NO: 704932 - DNA, 663 bp, Homo sapiens
  misc_feature (205)..(205): n is a, c, g, or t
ttttccggggttttcttaaaagacccttgaaagttttgcactccatgggtcccttctccaatagcttccaggggtattgggtctggtgagccacatgttcaaactctttagttcgaaatccagctgtcagctgtcccaaaaacaagatgtttcagggcctcaagctccaacttgtccgcccaaaatgaaattcctgtaccctganccagcgtcggtcctatcatgcatgcccctgcatgttatgtcgtacctgcagaaccatagtgtgtgattccatgcatgtagtgagactacaatgtcggggtaatccacagtcccacatgtgaccattgtgtatgtatctcctaccagtagtgtaacaccaactacccagactgtgtgcggcagactgagctggcactagcgttctgttggccacttggggacctgaagggtgcctcgtgggcccacttgcctgctttacccacaactgctgggtcctgcaaggaattatattccccagctgagtatgtgcaaggtctcatgtgtgacaactgtcttcacgcgtgtctctgtgtttgtggactggattcgcaaggtcatgagatgtgggttaggcccagccttgatcccatacgcgttagggagaacaaaacttcgtgccaaaataaatccatggttcct

SEQ ID NO: 704933 - DNA, 118 bp, Homo sapiens
aatgattcagagagtctcacagttttatctttgctccctagcaggtgcacacatagatatggttaggagggtgtgcaaaacccaggcagcagagacttcaggaccactggtcacagcc

SEQ ID NO: 704934 - DNA, 136 bp, Homo sapiens
  misc_feature (58)..(58): n is a, c, g, or t
  misc_feature (66)..(66): n is a, c, g, or t
gtagagatggggtttcaccatgttggtcaggcagatttcgaattcctgacctcaagtnatccaccngcctcggcctttatttacttatttttttttaatagacacggggtcatgttgccagccatgttgcccaggc

SEQ ID NO: 704935 - DNA, 491 bp, Homo sapiens
gcatagaatttcttcttacattgggggaggtggggagaaaaaaagaacgtgaagaggacccacctaagatgacccttgtgatcaaagcctgagggctccaagggtagtgcgccggacaggagaaccccacatcaaaccaatacttgccctgatgaggcagggtgactccagaagaggacttgtgataagaatgtggaaaagaggatgaacccaggcccactagccatagctgtgctcatgttggccacacagtaggtgacaagactaagttacctgcattcctagaggtggggcaagttcactttgggcatgtgggctagccagggtgtctatatggtaaaccggaacccagcatcatgcccaataatgaaactccagagcattcccagcaatggcagaaaatccatcatcatcacggacagctagcattcttctagaggtactaaccaaagcagttgtataagaggaagagataagttcaagtagtagta

SEQ ID NO: 704936 - DNA, 464 bp, Homo sapiens
caataatacctgtaggttcagcctgtgacaggcagagactgctggactatatagcatagctcctaacccaccacgccttccaaactattattttaccaaaagggcagaattagggctggtaatggtgccagactttcttagggctgccgctgccaactctcacccccagtgcatcctagttcaggaaaagagtatttcctaatgtaaatgacgagttgatgggtgcagcaaacaaacatggcacatgtatgcctatgtaacaaacctgcatggtgtgcacatgtgccctaaaacttacagtataataataatttttttaaaaagaaagaaaagggtatttttggccaggcacagtgactcacacctgtaatcccgacactttgggaggccaacgtgggcagattgcttgagcccagaagttggagactagcgtggacaacatggcaaaatcttgtctctccaaa

SEQ ID NO: 704937 - DNA, 434 bp, Homo sapiens
aggactggcagtatctcatgtatgaagagccaaagcgactgccacaaaagaaaaagttgacaaatgggacataattaaactaaagaacttcttcacagcaaaacaaactaacgggattaaacagagaacctacaaagtgagagaaaatatctgcaaactatgcatctaacaagggtctaatatccagaatctgtaagaaacttaaataaattaacaagcaaagagaaaacaagaatgaaacattaaaaagtgggcaaaggacatgaacacttttcaaaagatatacaaacatgagaaaaatgaacattatcacccatcactaagaaatgcaaattaaaaccacgatgagataccatcttataccagtcataatgctgttactaaaaactcaaaaaatagcctgggcagggtggtacatgcctgtaatcccagca

SEQ ID NO: 704938 - DNA, 918 bp, Homo sapiens
  misc_feature (906)..(906): n is a, c, g, or t
cgcccactccggctcggcggctctgggcctgcggcgggcgctgcgggttggagctcgggacgtggtcgtgggcgcgcagccagcggctccctgcccttcccctccgggccctgagtaccggccccccaccaaggaggagcccgaggtctccgtcccggcggcgatgctgccccgtcggcctctggcgtggcccgcgtggctgttgcggggtgctccgggagccgcgggttcttggggtcggccggttggccccctggcccgcagaggctgctgctccgccccggggacccccgaggtgccgctgacccgggagcgctaccccgtgcggcgcttgccgttctccacggtgtctaagcaggacctggccgcctttgagcgcatcgtgcccggcggggtcgtcacggacccggaagcgctgcaggctcccaacgtggactggttgcggacgctgcgaggctgtagcaaggtgctgctgaggccacggacgtcggaggaggtgtcccacatcctcaggcactgccacgagaggaacctggccgtgaacccacaggggggcaacacaggcatggtgggtggcagcgtccccgtctttgacgagatcatcctctccactgcccgcatgaaccgggtcctcagcttccacagcgtgtctggaattctggtttgccaggcgggctgcgtcctggaggagctgagccggtatgtggaggaacgggacttcatcatgccgctggacttaggagccaagggcagctgccacatcggggggaaacgtggcaaccaacgctggaggcctgcggtttcttcgatatggctcactgcatgggactgtcctgggcctggaagtggtgctggccgacggcactgtcctgggactgcctgacctccctgaggaaggacaacaangggttatgaacc

SEQ ID NO: 704939 - DNA, 156 bp, Homo sapiens
cctccacaccagttttccatggtcccatttcatcagcattccaatcggtcgtctgcagtcatcatcagggctggcaggttcagccacagcaccctcaacacacaggtcccatgggcacaccctgtggcttccaacacacacatgcaacacaccacc

SEQ ID NO: 704940 - DNA, 292 bp, Homo sapiens
  misc_feature (19)..(20): n is a, c, g, or t
gatcgattcggtcccgagnnctctgcatacgacacagccccgtgcgcgtctctcctctcataatcccctccacgtacgtgcgcgatcgacgatcacggggctggcgccggcgcgctggggctgccaccgacaggccccacgcgagcccgtgcatgcgccaccacccccccgatcgcccacgtacatactactgctatatatccttgcagcagcaaaaaattccatcaatttttaaaaagtagaaaaaccgttgcagagaaaaacagattcaagggttgcgatggactaaatt

SEQ ID NO: 704941 - DNA, 811 bp, Homo sapiens
ggggagaaatgggacccatgggagggggagtcgtcatcccttacacaagaaatagccactttcctttggttgtcattcttgtgatcctgggtgggtttctgtggcactcttttagaacatgtagcatcatcttagaggtctatttttaaaaaatgtgttgaagaggaaaaaaccattctcacgatggggcttaagtcattgtccaggaataagatgtggcgtggtgcccatgacatcaccgtcactctgcctaaaaagcactctagagctactgtgttcacgtggagaggcaaggataatttgcgaagaaaaaggcgcaggtggagagcccttgttcaccttgatagggtctagctgtgatagtaaatataataccggtgtttcctttggtaccagattgaggtgtcatgtgatgaggactgtaaacctcattttgcggttcctctgtttaaaacaaacatcttgaaggatgaactaaggctgtggtgcctgagcaatgatatgcaatgtggccaacagtgtctgttacaactctagcctgtcatatggacaaattcaacaagaactcaagaaattgtacctgcgaattatgcttcatgtaacaaggtggggaggggtgtctaggggtgggggaatttttcaaaataatttcaatgttctggccggtttcaaacaatacaggtggtggtttaatgtactttggacatgacaatttttgaaacataggggaatttttaagagaaaaaatttcgcgcccgcggagtaaattgggggcaaaaagtagtcaaaagaaggggacaaagggggaagg

SEQ ID NO: 704942 - DNA, 768 bp, Homo sapiens
  misc_feature (146)..(146): n is a, c, g, or t
  misc_feature (282)..(282): n is a, c, g, or t
  misc_feature (768)..(768): n is a, c, g, or t
actgatttccaggatgagcggaacacatatggaaggccttagcttatctttagcgcctcatacacccgttctggacttcagaaaggccagtgagtgggattaggcctcagagataggatgtagtccagtgaggatggcctagagcnttctttaattctttcctttgggtcacacataagaaacaattttccagcactgatgagtgttattaacatgagatgggatagaatttagttttccctatggctgtgcttcaaaaatagaaaagctgtcttttctctngaatgattgaatgaagctctggggaggaaaaggtggattggcagatctcttaaaggaagcttctccttctaggcactgttctaagggttaatattttagctccctatattaacctagttcaactaaacagtgatctgagtaattttatttttattaaggctcagatcaaaatgccattaacattgattgagaaaatcaaaggaatctttgatgcgagtggttaaattgctgaattatttcagtcccataccctcacagcatgagtacctgatctgatagacttctttgtaattccttttttgtttgagacagaatcttgctctgccgcccaggctggagtgcagcggtgtgatcttaaccattgcaacctccaccttccaagttcaaggggattctcatgccctcagcctcctgagtagctgggattacaaatgtgcaccaacatgcccggctaattattttgattttttagtagagatgaagttn

SEQ ID NO: 704943 - DNA, 1007 bp, Homo sapiens
gtggactagtaggatagtagctcttctacactaggggttgcgaacctggaggttgagacgcagtcgctcattagtcctgccctgtcagactgctctgtatctaggtccagtgagtacgtgaaagaagttttgagtgacaatgaggtccacattggcgcagtgatagactatgagcggttagagcttaaatctgctagatactttgagcgtgtcacatatgaactaaggcaagtctttagatgtgtacaatgtagtttgatgacaggtactgatgggtggacagtaatgagactagtaggggtcgtgtagtatcatgtaagttatatgaatggagtcatgggatgttggtttagggaaacactagggagacatgagtttagagctccaaattccttaccatatttatgtaaggtgcataagaatatacagtaggtgtcagatatagtaatgtgttgaacatttagatagctattttagtatgagtggaaaataagtcgaaggagatttaattatttgagtaggggagatcctcttcaaaaccgtagataatcacgttaagttgcctttttataatacgtatattttactgaatgggaggcagaatgggagtcaattttgtgagtagtttccttttatgataaatgaaatcgatcttgtgttcgaataatatggagtggtctgatgatgaaatagttcttgaaaagtccgagtgtgaactatgaaatatgaagagcaggagtgatttggcttatgctaactgtgggaagctccgagagctggttcgggaggcagatgggattgtgtgaagggcgctgatttggggtagacagaggttgcaagtacattgcgatgttccgtgtttttggccacggggcggaagttgggggggggggggtgaaaaaaagggtcgcaaagttttggggtaaaaggtagacaactggtgtggggaggaaaatttttttaactgctcgtgttgatgatgttctcttcgtaaggaaaagaaaagc

SEQ ID NO: 704944 - DNA, 681 bp, Homo sapiens
ggccattctcctgcctcagccttccgagtagctgggactataggtgcccgccaccacgccaggctaattttttgtatttttagtagagatggggtttcaccgtgttagccaggatggtctcgatcttctgacctcgtgatccgcccgcctcggcctcccaaagtgctaggattacaggcgtgagccaccgcgcccggcgagcaaattttaagccaagaaatcgaatgtgccagaaacccaggaaccacccagactcttcccatatgaccacttccccacatctccaccttccttacttctatgatgcccctggcttcagatagaaaggccctgaacatctactggggttctgagaagaatatcaacactttcctcagagaattgtctatctgtaagatcatatacttgactggaaatggctttgctaactggtatatttcattcatttgatcaacttaaatatacccttacaaaagaagtttataccaatacatcaagcgtacaaaagcgtgaacaatagtgactggaaagccagatctgtaggcctcatgctccaaatactgagacatggtgatttttttcatggtgcaaacaacttgattatgaactctgatgaaatatccgctaaaaatatggggactatttatgacaaagcagttgggaacactcgatattgtattc

SEQ ID NO: 704945 - DNA, 795 bp, Homo sapiens
cttagtgacaaggggtcttggtgtgtgtgtttagttgagtccatgattaatttgttcaattagtgacttgactatcagtcaaaccagaatatagcaaatctagtaaagaataattaatagtagtaaagcgttctgaaacaaataattctggttctctggtgttaacttttgtgaggtttttgttgttgttgttatatgtttatatagtgtccagtagtgtctttgatatgtgtgaattaattttatgccctgaaaatcagcaccttcaaaaaggaactcgattttttttggttattgttctctttctggagaaaaaaggagctccatttaaaagataaggcctacatacctagtacttttttcttcgttgggcaagtcaacttgttacagatgggtcatcttcaagagccagctccggtgtcctctagctatgctgcactcatttcataccaagcagctggaactgagtcaccagcccagcttcctccaattgttgcaattgtactgaactacattttaatagaaattaagccactcaagtctcttaaaatattagctcctataggattcctccttttcattcgtttcttttcctttgggtatagtatcatttccttttcttcatctagaagaaacactgggaaacaacagacttaactttatttcatctgaaagacttaccatgatacatgagggtacacaatactaaacccaaaacacctggacatatttgcccctgttgcaggcatgagtctgtgcacttcgctctcgatgtccgtacgggacatattcgag

SEQ ID NO: 704946 - DNA, 111 bp, Homo sapiens
ggcttccctttctatgcaagtgtaaattaatgaacagagaaggtatttcggaaatcggtaatacatttgtcgacaggatttgtataatctatacagcattggaaagtgtcg

SEQ ID NO: 704947 - DNA, 195 bp, Homo sapiens
  misc_feature (33)..(33): n is a, c, g, or t
accgtgactctgtgggttttggggttggtgtcnccgtggtggtggtggtgctagggtgtcagtgattgtagtctgtgtgccggtgggtgttggggttggggtccccgtggtggtggtggtgctgggtgtcgtgggttggcgtctgtgtgccggtgcgtgttggggttggtgtcacccatggcatgtgaatcacaa

SEQ ID NO: 704948 - DNA, 884 bp, Homo sapiens
  misc_feature (2)..(2): n is a, c, g, or t
  misc_feature (84)..(84): n is a, c, g, or t
  misc_feature (159)..(159): n is a, c, g, or t
  misc_feature (214)..(214): n is a, c, g, or t
  misc_feature (216)..(216): n is a, c, g, or t
  misc_feature (345)..(345): n is a, c, g, or t
  misc_feature (348)..(348): n is a, c, g, or t
  misc_feature (365)..(365): n is a, c, g, or t
  misc_feature (384)..(384): n is a, c, g, or t
  misc_feature (395)..(395): n is a, c, g, or t
  misc_feature (403)..(404): n is a, c, g, or t
  misc_feature (407)..(407): n is a, c, g, or t
  misc_feature (412)..(413): n is a, c, g, or t
  misc_feature (417)..(417): n is a, c, g, or t
  misc_feature (423)..(423): n is a, c, g, or t
  misc_feature (674)..(674): n is a, c, g, or t
  misc_feature (696)..(696): n is a, c, g, or t
  misc_feature (700)..(700): n is a, c, g, or t
  misc_feature (739)..(739): n is a, c, g, or t
  misc_feature (782)..(782): n is a, c, g, or t
  misc_feature (822)..(822): n is a, c, g, or t
  misc_feature (876)..(876): n is a, c, g, or t
tnggaggagcccggggcagggaagggcgggcggtgagattgtcaactcttcatcagggaggctgagaggaggggagtgggaatngtcactttaatgtccaggtatcaagccgcatcctcttcacagctgagccctcagcctcaggctctggggctgggngcagaggcccagtgtgggcccgaagtccccccgtccgttatcccggtctcccgtntnataggatcccccggctgggctgctgagaccatcgccaggctcagggcgggcagctgggaacacagctggagggggaggcgcagggctgcgctcacggcttggggacaccggttctgacttgatgctgangtnggggtgggtggtgattnttagggcagcacccacgtngggcagggggntgcttggnntgnggttnntganattttntagggaccaggtgggatttttgctgaggtggctgttgcggctgctgaggctgctgttgctgttgctgctgttgctgcggtggctgctgctgttgaggctgttgcttctgcggctgctggggctgctgttgctgttgctagagaagtaacattacctagcgacacaccccaggtgaactaaaggctggtaaggaggagagctctgcactggtcaactggtaatctgtgtcgtaggcagttggcatggaaganaaggggaggccctggctgagtnaacncggcgttgccacagaaaccactggggtggtgagcaaatnaatagactgggagacccaaggcgctgggcattgttcagatctnaatggtcctcagtcaagtaatgcattaaccctttcctgcntgggaagtaatgactcgcaggtcgggctttcggctggggggtccaagctgggtnctgtgggt

SEQ ID NO: 704949 - DNA, 388 bp, Homo sapiens
  misc_feature (315)..(315): n is a, c, g, or t
aatatggaccaatagtattttttaatgttcttcctctcacactcacaaagggagtcagaatggctgagtttgagtcatttgccccctgccaggaaccacggcaactgattaacagttctcaaaagactgcctgtactaggagagagtaggtcccaaaggcaactttaaagttctggaaccaagacggagggcgaatatgggggcaaataaaaacaatagatacctcctaaaactctttttcataagtgttatttaaagccatcaaactgtccaggtgcagtggcttatatctgtaatcccagcacttttggagtntgagatgggaggattgcttgaggccagaactttgagaccagcctgggcaacatagacccctgtccctacaaga

SEQ ID NO: 704950 - DNA, 278 bp, Homo sapiens
aatttttggggggggggtcccccggggcccctttggggggggggggggcccctttcccccccttttgggggggggggggcccccttggggggaaaaaaggttttcccccctttttccccggggggcccccccttttttgggccctttgggtttttttttttcccccaaaagcaaattttttggccggggggaatttttttttttttttttttttttttttgggggccccccccccggggggtttttttggggcccctaacccggggggggccccggga

SEQ ID NO: 704951 - DNA, 266 bp, Homo sapiens
gttacctccaccgtgaagtgcaagcagccggggtctccctcccacagccaaggattagccatgagggactgtgctatacggcccagatactatgcttttcccacggtttctgcaatctgcagatcaggagattcccttgttgcctacaccaccaggactttgaattacaaggacagcactgggtggatgtctgggcagacaccaagctagctgcaggagtattgtttgttagtatgtttgttattcgtttactttttttaatgcca

SEQ ID NO: 704952 - DNA, 454 bp, Homo sapiens
  misc_feature (27)..(27): n is a, c, g, or t
gtgatgttatccccaacacttacggangccagggcagaaggattgcttgatgccaggagttagagtccagccttgtgaacatagtgagagcccgtctccacaataaaattaaaaattaagggcaggcacggttggctcacgcctgtaatcccagcactttgggaggccaaggcaggcagatcgcttgaggccatgagttcgagaccagcctgggcaacatgggaaaagcccgtttctactaaaaatacaaatattagccaggcatggtggtgcgtgcctgtaatcccagctactcagaaggctgaggcttggagaatcgcttgaacccaggagggagaggttgcagtgagccaagactgtgtcactgtacttcagcctgggcgatagaacaagactccacctcaaaaatatatgtatatattaaaaattaaccaggtgtggtgttgggcgataa

SEQ ID NO: 704953 - DNA, 797 bp, Homo sapiens
cgaccgttgactattctcgtacaaaccacaaagacattggaacactatacctattattcggcgcatgagctggagtcctaggtcacagtctctaagcctccttattcgagccgtagactggtgcctagccaggcgaacgcttcataggtaacgcaccaatatctacaaccgttgatcgtcacaagtcccatgcattctgtaataatcttcttcatagtaatacccatcataatcggaggcttatgtgataactgactatttcccctaataatctggtgcccccgatcatggcgttgtccccgcataatacaacataagcttctgactcttacctccctctctcctactcctgctcgcatctgctatagtggaggccggagcaggaacaggttgaacagtctaccctcccttagcaggaaactactcctcagccctggatgcctccgtaagacactaaccatcttctccttacacctagcaggtgtctcctctatcttacggggccatcaatttcatctcaacaattatcacatatgaatccccctgccataatcccaataccaaatgcccctcttcggctgatccgtcctagtcacaggcagtcctacttctcctatctcgtcccagtcctagctgctggcatgactatactattaacagaccgaaactcgaagagcacttcttcgacccgccggagggaggagaccccattctataccaaactattctgattttgcggtcaaccccgaagttattattcttatcctaccaggcttcggataatctcccctattgtg

SEQ ID NO: 704954 - DNA, 958 bp, Homo sapiens
  misc_feature (3)..(4): n is a, c, g, or t
canncggacaggtccgagcggaacaacaggcagagtttatgttcacctaatggaaccctctcaatggcactacgagtcgtcaccattagctgtacaaaactaccgtgagcaagcggctacgtaccctatacagatctcgtggtggggacaactccgcatggtgcgccaacacggaagcttgatgtttgttacaaacaggccgatcaggggctacaccctttaacgccccttcgtgtcattgggcctatacccaggggggcacctctctattgcacacaccctggggacgatgcattcatcatcccgcaggagcagccaacaaatactccccctgtgtacccccctgcgccttacagccaagcggtttttttcgcaccccgccgcaggtgaggtgttctggaagcccctttcatgaggcctcttccgccttcccttacagtgttctgctgcccgctgtaaaaccagcctttctttcgtgtttccccgggagttttgcccctctcttgtggggggtcttccaaccaaagcgtgttcaaggtcctgagtgtgcttttccagatgatcaccatgctcaccccaacctttttttgtggcgcacactctgggtgcctcccacccttcgtttttgtaaaccacctgggtcgacccatttttccgggcggccccaaatccaaattgtgcaagaaaaaaacagggtttatacctatttcgctctcattatcattcaggcagtttcatgcaccgtacgggaggaaccccggcccctgggccaggcctcaccgaagactcgcgacacccctggtgggacgcaccactgtctaccgccaccgcccgcgaccggagcaaacgagtgctgggtcgggcggccccctgagccggctcggtaggtatgcatgggaggggataaactgggggcaccgggggtaaaaaaaccaagagggggggcccccacaaaaca

SEQ ID NO: 704955 - DNA, 405 bp, Homo sapiens
  misc_feature (10)..(10): n is a, c, g, or t
  misc_feature (18)..(18): n is a, c, g, or t
  misc_feature (49)..(49): n is a, c, g, or t
  misc_feature (401)..(401): n is a, c, g, or t
  misc_feature (403)..(405): n is a, c, g, or t
cttgagtatncctcctanttcccaacccgggtttagaggtcacacagtncagtttgagataaagtagatctaaaaatctggtttttctagtctaaccctagattggtttgcactaaactagtggtagttctcagcctgcccagaggagtgaaatatagaatgcaggcacatccccttcctgcaatgagatgaccacaccacacaaatgtcatagcactgagaaggaaatcgtttacatttcaaagaaataaaaccctatataacatgtaaagaatattagagttggccgggcgcgggtgtcacgcctgtaatcccagcactttgggaggctgaggcgggcagatcacgaggtcaggagattgcgaccatcctggctaatgcggtgaaaccccgtctctacncnnn

SEQ ID NO: 704956 - DNA, 1249 bp, Homo sapiens
aattggggcacgaagcggggctttgatgacccgcaaagggcgaggtcatgcatgtgacgtgtggagcgaattaagtgaaacagtgcaaggtagttagacagcaccgatgtgtggcgagtgccttaagggtctgtggtccttgtcttgtgctggtggtcttttggtgcgtcgactgaggccttggttctgttgtaggctggtggctactactgtgtggcggtgcctgctttgtggaaattgccttgccctgctgcgctttcttgcccagtgccgcattggggtgcatctgtaactactaaagcctacctactacctagcccctagtttgtgggccatacaccatacacactgtaagcgcctacagactcctagataactagtcggccattgggacactagtgataacttagccattaacttaggtaccagatactatttcctgggttgggaagtgtggaggcaataatgttaccttaggcaacaacttgtgtggtagtttgcgtaggtaaacattaaatagctgtgaagtacagaacggtaacttagtgaccaatcctaagagcttacaaagacaacttggcatatgaaatgaccaggacttccgcgaactattggacaaccatttgatatgtaaaccctggatggagcaggaaacgacatgagaagccacaaaggggactaaggaccatgtggcgccgcaagcagcccgagggaacctagaacggccttatgtggaagagtggacctgattgccatagcaagaagagataccctattccgccagagccgtttacagaagtttgttcaaacccgacataggtagagttccaaaacacgatgatgttaattacgagcagtcaaaacatcagcagtgagaggtatatcaccaggttagggcgaaactattcagcacgaagcgattatactcgataaatggaaatggtcgtttggctgctactccaatagtcaaagacatattatacgccgaagtgtgggtgttggtatggcacggaaccattgtcgttatgttcgataatcataaagggaaatcacccgccgaaattaccgacagacaattggacctcctatataagatagctttgcgtttgtattagtatgatcgtatggcgatccccattccccataaggatagagtctcagaacgcaattacaggtagcccaggactgatatacaactattgtgggagtatatgtgagttgctgaagtactgcgcagctaggttacaca

SEQ ID NO: 704957 - DNA, 192 bp, Homo sapiens
cggaccggactctgggctgtgctacacgcctggctggtttttgtaattttagtggagacaggattccgctatgttggccagactggtctctaactcctgacctcaggtgatccacctgcctcggcctcccaaagtgctgagattataggcgtaagccaccgtacccggccatgcgtgattcacttcttatta

SEQ ID NO: 704958 - DNA, 252 bp, Homo sapiens
attcccccccccctccccggggcaaaaagtaaatttttaatccccccggtcaaacggccggggttgaggccccccccccctttggggccgggggggggggggcttttggggggaaaaatcccccccccccttttctaatttttttttttttggggaaaaatcccctttgattttttttcccaggggtcaaaaatttttgcccaaattttaaaaaaggccaaaaaagggttgggggggttgggcccctgggga

SEQ ID NO: 704959 - DNA, 645 bp, Homo sapiens
aaaaaaaaaaaaaaaaaaaaaaaaaaagaatgtcctcatgatggcctcaagcacattggtccctgaagagagtcaaggaaggcccactttactctgcactgcaaagcaggcaggtggacaggaatctgagaagtggattcagtgagaggcattgacccaaaggattttctgcctaatggtcggtccagcagaatattaaactgagcacagcatcctgttccctgaaaccatctggttggtcagtggggaatgttcttgtctcgttaaatgtcctcatgctactgtcaagatatcctgttacaaaacgtcataaaccaggtttacaaataggccaggtgattgtggaatttctccttggcaatgccttagctatgggcgtgcgattagtgtgcaataatcacagtgttccgggccacttgagggataaaatataccttaggtgattaactgttgtattttaatgtgaatatttccaccaacattaaacagtaactccatgagttttctcatacctgttacactctggagttgcaacaagctgacatgaagcaagttgcaacataattatcgtatttggttcctattcacagcaagggttcttcaagctgtacgtggggcagtcttcccagctgttgtactgggggt

SEQ ID NO: 704960 - DNA, 614 bp, Homo sapiens
agcttcaagctacagacataacatcactgagacgtcactgaccttggactcgggaacagatgagcacacccagctctcacaaacacatccccggtgctgattttaccccatccagggctgggcacatgacccaaagctgccctatgggagttcctcagggccatcagaggagactgctccttttcttaggcattgctaaatagaatgttagttggggactgccagcagccatcttgccagctctagagagagaatttggttgagagggggagaaagggcacccatgacatcctctgaacccctgaagccagccatacctgaagctggtgtattcctggactttccaactacacacatctctagcccctcttctttgcctaagtagtgtgggctgagtttctgccacctgccaataaaatgccaagaataaaaaaaatgggtcacccattcaaggaagccaatctaatagatctggctttatcttgattgtggtggtttcccaggcatatgcaactggtaacattcactaagttgtacactttccgttactgcagcttcttgtaagtaaattctagctcaataaaactgttaaacatataaaaaacaaaaaaaaa

SEQ ID NO: 704961 - DNA, 854 bp, Homo sapiens
gcacgacaccgacatggcggctgagcgccggatgcgtgggtccgcgggcccgagggtggctccgtggatggaaacgctgggaatggtagaaccagtggtgagcttccgtcgtaggttacgggcggctgagcatctctggtgggccgttggtcgacgggacagttgcgaagcgggagacacaggaggaccgtcaagccggcgtgtagacttcagaagtgagagccgaggtcactgatgcgaagttaggagatgagatgcacgcagctcactcacaatgctagtggagacgcgcgttgggatcaagatggactctgtagacgatctaaaagtcaccgcttgcgaagcgccagatcctattcgtcctctgctccacatgagcctaattacaggcatggtctgtaggacttgggtctggaatcttcgttaccatggggggggcactcctcctcacaggggaagtgaagggaatgttcagcaaggaactgtattgggccacgcgtggcacgcaaaagacaggaaaccggctgtccgggcacaaggcggcgaccgagtgctctacaacggggacaatgtatgctttggcctgatttccgttcgaaagctacaccgaattggggtaccaccgctcggtgcatctcagcgcgtttgtgtgtaaaggtagcataccaaaggagacagcgttcgggcgctacgcgtgcgcgtattgcactgtggcggcgggccgatcgtatgcgcattcggccctacaagctgcttcgcgtattcgggctctccctctggtcgctgccacgcaagggctgtacctgtgggagagggtagagcggaagggtactccccggtggcacattgggcca

SEQ ID NO: 704962 - DNA, 985 bp, Homo sapiens
gtaggaggaccacttgagtccaggagttggagaatagcctgggcaacacagcgagacctcatatctaaaagtgaaaaaaaaaaaaaagggaatttcaaaaacgggacaaaggaagggagggaaacacacaccacacacacacacacaccacacacacgggcacacacaccaaaacacaccaaggggaggggaaaaacacccccacccacccaagggggagggaacacacacacaacacacacaatcacacacacacacaccattcgtgggcgtaggacaacggtgtgccaacacagcgttaaggccatcacaagcaacttgggggggccccaggagaagggagcaaaatcatcattgggggccaggcaccgggtggtgacaaaacaccccctgtctcttaggagcaacaactaggccaaaaagtgggcgacgcaacaggggtggcaacaacccgtgtgaaaccccccacgcatgaggagcacgaccgtagagggggcgagcgcacaacagaggacgggaccaaaaagtgcgaagaccacctcgcgggcacaatgggggggaacccccctgtttgcggcaaaagagaggcaaaaaaaccgcggggctaaggacggaactatgcagcgagtacacccacagagggcacgagacgacggacgagcacaatcttgcgtaacacccggggagggtgaagtgtcgccagctaccagaataatcagcacagggcatccaacccgtggtaacagatggagcctccatcctaagcagcatgaatacaggaaaaaaaaagggtgcgcgcacgacgcggaaatcatcaaaacacgtggtggacgacccaaaatattggacggtcactgcttacaggaaacaggagagagtggtgtcccacaaaaccgcgggacgagttaaactagggtggcaggacaggcagtagccgcggagcggaagacacacaacgacgcacgaacacgcagccacataggcg

SEQ ID NO: 704963 - DNA, 802 bp, Homo sapiens
agcggggtcgtctcgcgcccggtcccgctggtcgctcgtccagccgcctcctccgcgcggcctgcgcctcaaggtgctctgcctctgtgccggtcggtccgtcgtccggcgactgtgggcctgccagtcggcgccgctccgaaggcccgtgtcagggccgccccagtgtcctcctccgttctccggccagacccagcgcccgcggaagatggctggaccggggagcaagctggtgcagagaagcccggcgttggccgagcaggcggagcgctacgacgacgatggccgcggccatgtaagaacgtgacagagctgaatgagccactgtcgaagtgaggaacgaaaccttctgtctgtggcctacaagaacgttgtggggggcatcgccgactcttcctggagggtcatcagtagcattagagcagaagacatctgctgacggcaatgagaagacgattgagatggtccgtgcgtaccgggagcaagatagaccaaggagtaggaggctgtgtgccaggatgtgctgagcctgctggataactacctgatcaaggaattgcgagcgagacccagtacgagagcaaagtgtctaccgtgaacgcatgcacgggggactaggtaccggtacctggctgaagtggccaccggagagaaaagggcgacggcggtggagtcctccgagaaggggctacagcgaaagcccacgagatacagcaaagagcacatgcagccacatcacccatgcgattaggcctggctcttaactactccgtcttctactatgagatacagaacgcccaaa

SEQ ID NO: 704964 - DNA, 147 bp, Homo sapiens
actccttactttctttctttctttctttcttctctttctctctttccttccttccttccctccttccattccttctctttctattctttttgtactatctttatgctgtaatattctatgaaggagagggtgatccctctaaagtta

SEQ ID NO: 704965 - DNA, 541 bp, Homo sapiens
atatctagaggatccctgcacggtagatcgtcatcatcattagctaataggagctatgtattcagcacctacttactagccaggcaaggtatatgaagtgctaagcacaggacctattacatcataagctctcaataactgatgactacttatacagagatttaacttcttaaaagagcttagaaaaggaaactggaacgaaacagaagttaactggaaactcacaggaaactgaaacagaagttaaccgggcaaaaaaaggggaagaacataccagagtggacattttagagaatggcaatgtataccaaagcatacaagtgaaaaaaagcacagtgcattcatggaagtgcaagtcatctggcatggctagagagcagacaacaaatatagacagagcaggaaatgagggtaaaaaggcaggcaggtcttggtatacaaagaaagatgcttagagtttatcctgtgactgagagaagccaaggaaaacttttaaacagggaagagaacacaattaggtgagtgtgtcaggatgatcaat

SEQ ID NO: 704966 - DNA, 196 bp, Homo sapiens
atagcctggaaaaggcggtataaggcgttggacagaaatcatctcttatactcaggacaaaataacattagggttaagggggataagagagaagtattataaaagagaaaaaaaacaaatgtaatcctccgggcaagcccagcaaaattaccggaagacccacttatatctaaaggcaatataggtaaaaaaatag

SEQ ID NO: 704967 - DNA, 301 bp, Homo sapiens
  misc_feature (109)..(109): n is a, c, g, or t
  misc_feature (250)..(250): n is a, c, g, or t
  misc_feature (278)..(278): n is a, c, g, or t
gaggccctggagagctatctatgctgagctctagaatgctgagtcttacggctataagccgattgcggctttgaagtctgcttcgctctctgcttgggacgagcccttnaaataaccgaggggaggatctgattgctggcacgataaatcttcttgcttctcttgcaactgggcttgggagaatcacgagcaatgcgtgcccgcctgctcggaacccgcaccaaattccggccctccgggcaatcggaancagcaaagctttttacaccactaatttngcctatgacgcttaccgctggca

SEQ ID NO: 704968 - DNA, 806 bp, Homo sapiens
gggctcaccaaccccgtaactacactctagaaggaagctacgtgtacaagtgtctacatcacagcacggccgccaggaccagatacagcaagttgggaatcatggactagtcccattccttgtcagtgttcttctctaaggcagattctaagacacacaaaggaagctgtatggaccgtgaccaactataccagctggtcgaacagttgaacagatctcgtgtaccgttgttcagctgtggcataatagaaccagctggatgtacctacataaactgcagagaatgataccaagatataattactggtttatacctggatgccagtgctcaaatatactattcaggctgctgagaaagtagggtgaaaactgagaaagcttagtataatgatttgaagaatcgtgtgaggcttaggagcagagacattgaagcatctacaagaagccaatgaagagagtgagtcttgtgtataaggcttcgttaagcttaattgagaagtatgttctctggtagaggaagaggaagatcacacgttgtaccagaactacctactgaaggctacactttccaagttcaggatggggctcctgggacctttaacttttagatcatgtagctgagacatagaatttgttgtgtactacgtttggtattttgtctcattgtttctctactgagaactctttcttaaatgtggtttgttacttgtagcactattacactgaactctacgtgaactgttccaactgtacatacatactgtatgaagctgtcctctgacaggttcaaaactacccgattcttt

SEQ ID NO: 704969 - DNA, 272 bp, Homo sapiens
gactgtaattacatggaaacttccctgtgaatgaatgtgcagcatctctcgccttctcctctgtgcttggtggtcttttggtctctgtctgtttttctctgaatcttctgtctgacctctcttctttattcagctgtacctaatatgttgttaaacatattcattgagtttgtttccagttattgaatactttgactcaagagcttccgtttgtttctttcctggagttcttacttctccattgagatagtcaaccttgccttctacctccg

SEQ ID NO: 704970 - DNA, 173 bp, Homo sapiens
tatgcgtggccggcctgaccacacaggtcgttgttctttgttgagacggattctccgccgatctgtccgattacgcccatgaaatgctctaactgccagcagggtgctctctttgctgacgtgcagctgctctcgtggtcgttcggagataccgacgccttcgaatttcgata

SEQ ID NO: 704971 - DNA, 85 bp, Homo sapiens
taagggggcgaactgacctcaggcatgttttgtaactgtagagcgcctgccattaaacgtgtccgctgctgtggcgacagaaaaa

SEQ ID NO: 704972 - DNA, 218 bp, Homo sapiens
cacgcgcagcgggctactaaaacctataaactcttacaattcccccgttttacctgtccaaaaaccggataagtcttacagattagttcaggatctgcgtcttatcaaccaaattgttttgcctatccaccctgtggtgcccaacccgtacactcttttgtcctcaatacgttcctccacaactctctataaacttttctcttagaactgttttcact

SEQ ID NO: 704973 - DNA, 180 bp, Homo sapiens
tggggtttttttgggcccccctttagaaccctgttaggggacctaccccccctttattaaaggggcccttgtgccactgttgtcattttaaaggcttttcctcccctgtgctttttaatggggaattaaagtgaggagaaattaaaaactctgagggcgttttatataataaatttgtta

SEQ ID NO: 704974 - DNA, 225 bp, Homo sapiens
attttctgggctgtggggggtagaattggtgcttaaaaaagaaaagcctccccccaatataaattactaatactatgaggcagttgttttattttgatgatcccataaatacctttaaatctacatccttaacccatgattttatagtgggaaaaaaataaggtctgccttttttaatgccccctggccctgaaatgatttttaaatcagtggcgcccccccata

SEQ ID NO: 704975 - DNA, 879 bp, Homo sapiens
gtcacaccactgcactcctggaggggtgacagagcaagaccctgtctcttaaaaaaaaaaaaaaaagaaaagaaaaataaaatgtccagatactacccatggtttttaaaaaggctacacaggtttcacacactcaccagcagtaaatacatacattctttcaataacatttgggtgaatatcaaataagtgggatagtaagtacttgtaaatttggtgttggtgtggataagctacatggtggcttaacttctatttcctggattacttataagggttaatggattatgaaattccctaatggtttcactccggagttattttcttaggcctggcctgggggtattttaacatctttttattccaagggcgctttatttagaagttgggttggttacccatagctctggtaaacaggcaacgtagctggatttccttggtggaagttcttataaatttgacctggatctgggcagttgaaaaaaggggaactggcaaaatttaacaggtgtggtaatggacaaatcactaagttggtttaacaagttgtctatgtggccaggtatggggctaagttgacgcatataatccaatggcgtggacaacttacaacgtgatttatatagacatcacacggggggggagagggggggtagaaacaaagcctggcctgtgcgcaaggtgagtggcagcgggccagtcaaatcatggacctctggcccgggggcaaggcaactgggtgcgcgcccggaaaggggatacggggggccaccagcgggcacttgttcacagaatgggtcacattggagaggggagaactgagcaaagggccctggtcaacggtgggggggcagcccctagtggaagacggagaaaccg

SEQ ID NO: 704976 - DNA, 239 bp, Homo sapiens
  misc_feature (202)..(202): n is a, c, g, or t
  misc_feature (221)..(221): n is a, c, g, or t
taccccttttactctagtaaatataatgagtttcctaatgttaacccattcctagtcccagctacccaggaggctgaagcaggataatcgcttgaacccgggcggcggagattgcagtgagccgaggtcatgccactgcactgcagcctggggcgatcagagcgagattctgcctcaaaaataaacaaataaattttaaaantaaataaataataaaaggntgtgttaggacaatgtaa

SEQ ID NO: 704977 - DNA, 843 bp, Homo sapiens
ctaaagaaagatcacgttgatgaatgagaacatcctggccaggacccgatcgatacgatattctgtgcaacgatcgtatgatgtgtaatcataatacaaacgtgtagctgtctgacagttgaacaacatataatcacaactgagaaaattaccagaaaaataactcaaaaaatgaagaaaaagagaaaaaaatatatctccaatataaaatgaatataccaatatataatgcaagaataaggatgatgatggtcacagtgggggagctgtgaagtaccaccgctggtctaatgcaaaaatggacgattgcctaacaaaggacccttttaaagccctattaaacaagatgtgacaacaaacggaaaacttcgcttatgttgcgaatttgttcccgtataagaggatatatctggcaagctatgcgtgccatccctcagactttgcggaacgaccccagggcacaatgataagacaatactggggctgtatgtgggtgaccaatgaccccaaatttgatgtgtcgtgaacaatccggaagcaaggttatgtgcaacgaggtgaaactaactgtggcgtcgacaaggtaccttaggccatacttgcgggccttatggaatttggaccgaaagggggcaaacctggacctggggaagcgggccccgtcttcgccccatttcacctcgtcgcggattgcattcccctggattgccaggcccaacttctattccctggacttctccccacctgccatgttccaaacacgggctgtgcacaacctggcgcttacctcagcaacgccttcactggcggggaccctggcctcctagcgacagcgctacttac

SEQ ID NO: 704978 - DNA, 1144 bp, Homo sapiens
gctcttgttcttttgtttttttctcgaagagagcgacaagtagctgcaggaagggtatcgacgaggagaaaatatatcggcgcgctttttatatatgagatgtgtggccaccgacaactttcgcgaaaaatcaaatgtgtgcgcacccacgagcccttttttcccggcacagtgacaaaattccttgaaaggttccaaggcccttttctggaaccaggggtcccaaagccacttgcgagagagaccacaactgtcttttgggcggagagcccaagatgcgcactactggtagcgcgccctccggtagagcggctcccctacgggattttggggtcccctcttcaccaggccctttatccttgcgggctaccacattctccggcctacgggggcactttggacgcgcccgagtacacccagctcctcggttttgcgccaaaacctttaggcccagatgtgagattgttcccaaagcagttggagcaataggacagtagaatagttgttcccaggaccaacttgcccccggagttccagcgtatttcgcggtaatgtggccaccacgtgtgcccctcgggagccacggccaactgttatggccgacttctgggcgtgaccgtacacaccattttctaggccctccacgctgtcgtcccaagcccctggatccccagttcttaacagcggccatcccgggatccaccgtcatctgcgggtgacatggactcagacaccttctaaccatatgtgtgctccatcacaccaggtataaagatggcctgtgacccaccatctgggagagcccccgagatgatgataagagaactggcccctgggagccccacttgctctcgtgtctcctatcggtgccttcgagagacatttgtctttcgccggcgatacaggattcccctgggaaaagccccctcccagacgggtggctcggtggtctcaaggctcccaccatggcccaccgggagcttacttaatgatgtaccccccgacccacacgcccgtggtacaccccgtcttcccgtgagaaagaaggttctggctccccgggtgaatctgactttttgattaaattttgccttacttaaaaataaaaccctttttaaccagtttaaaaaaaaataaaaataaa

SEQ ID NO: 704979 - DNA, 114 bp, Homo sapiens
  misc_feature (5)..(5): n is a, c, g, or t
caacncacctggagacaggtgcagaagattgaagctgattctcgcaccctctgggcccactgctggtgccctttactgcagggtattgcctgcctgtgctgcgatgcccggcgc

SEQ ID NO: 704980 - DNA, 779 bp, Homo sapiens
ggcgcgtttggcaatgataaccaactgcagatcatctcaatccctggagagcacagacgtggggaaagcgcatgtacgagcagctgtagtgaccggcagcgggagctgaaggagctgcacaggaaaggcgggcccatcaggttaacactgccctccaagtccacagacgctgaccgttggctcgtttgctgagctccggctccttcggaaacctggataacctcagtttggcacttcaccaattgtaatccaagtggcctgcgccgacgcacctcatcataactgccttcgcgtcataggcagctgaaccctgtggtccacgtcacgttatggaggacgctggccttcggctcctgtcaggaacagcctccaccgatgctcgcatggtgcttgaaccctgtggctagaccccaggatcacagagatcgctgggcttgctaggggccctgtagctccattgaacgacgtactctgcgaggtttgattactatgatacatgcaacctaacagctctcacagccttgacaccctacggaccgaattctgacaggccacagcttccccgaattttgaacggacatggtggcaccagtcctgtcttaacaacctgcacaggccctgtgtgaaatggctcccatgacgtcacagggcacggggaagacgttcttgcaaagcccggcgcaccaaaaaattaggcctctttgcacttaaccaaggcctgtcacgaagccaagcccgggtccatagggggtccccaacccttggtccccctggagctg

SEQ ID NO: 704981 - DNA, 183 bp, Homo sapiens
tgctacgagcgcactatactcagcccaagtgacaggcacgctctgtctcaaaaataaataaataaataaaaattaaaattaaataaaaaaaaaaaagatcaaactgattccaagtaacttaagtgtgaaccagaaaaaaagtccaactttatttaaaagaaattttaaataatctaggaaccc

SEQ ID NO: 704982 - DNA, 187 bp, Homo sapiens
ccccacccctgcccccagggccagggtgggtccttttgtggggtttccttgggaaaagcccaaagcccaaaaaaacccagtttttttttttataaccctttttaaaaaaaaaaatgaataaaaagcctccttttttttatggatttttgggggggggggggggggtcagggtttccctttttttcca

SEQ ID NO: 704983 - DNA, 298 bp, Homo sapiens
catacagcagccccagcacacttcagcagccaagggcagcatggtcaagtgcaccagggcgcacagcaaactggctcagtggtggtttgctgttttccaaggctcgtctggtgccaagcaaggcacattcatacattgcagctgctcaaaccatcatcaccacacagttcttcctttcttccatcactcgtctcatctggaaatctcacactcatcctctctttcctgagcccaattctcaacgccatcaggcatggggacccaaagggcatcagttcagctctttcccaaggcatgt

SEQ ID NO: 704984 - DNA, 1011 bp, Homo sapiens
aaactgttactagtcggcccggtgtaattcatcgaggcgcgatcgagttctgaaccttgtgattgctccgtcacgtgctccgctcgccatgacttcctacagctatcgccagtcgtcggcacgtcgtccttcggagtgcctgggctgggctggctccgtgcgttttgggccgggggtcgcctttcgcgcgcccagcattcacgggggctccgtgcggccgcggcgtatcctgtgtcctccgcccgctttgtgtcctcgtcctcctcggtgggcctacgtgctgggcgggctacgtgctgggcgtcctgacctgccgtcctgacgtggctgctggcgtggtgcaacgatgaagctaaccatgcagaacctcaacgaccgcctggcctcctacctggacaatggtgctgctgccctggaggcggccaacggcgagctagaggtgaagatccgcgactgtgtaccagaatgcaggggcctgggccctcccgcgactacatgccactactacacgaccatccaaggacctgcgggacaatgattcttgtgtgccaccattgagaactccaggatttgtcctgcagatccgacaatgcccgtctggctgcagatgacttcctgaaccaatgtttgagacggaacagtgctctgcgcatgagcgttgaggccgacatcaactggcctgcgcagtggtgctggatgagctgaccctgtgccagagactgactggagatgcagattcgaagggcctgaagtgaagagcttggtctacctgaagaatgaaccatgagcgatggacaatcaggtacgctgacgggccatgttgggaggccactgtcagtgtggagggtggttccgcctccgggcaccgatctcgccagatcctgagtgactgcgcgcatattacgccttggcgagccgaccggaggttttgacttttccccccggctaatgaccgggttctcgcccgggccccgatgcgccaggtctgctcccgcccttggtctatagggc

SEQ ID NO: 704985 - DNA, 304 bp, Homo sapiens
ccttcgtgaatcataagattacaatgcactattttacgtgtactttttaatgtttagatacatagtatgttactattgttttacacttgtcatagtattcagtacaagtaacatactgtacaggcttgtaccgtatgagtttagacacatatatatacacatatatctcaaaccatcctttgctggcattaaactctccagctgtaagttcttcaccttgtcaagtgcagtgggagcactccagcactttgggaggccgaggtgagaggatcacttgagtccaggaatctgagaccaatctggg

SEQ ID NO: 704986 - DNA, 128 bp, Homo sapiens
ccaccccgcgccctggcggggggccggcgagacggagtccacaggctaccctctcaatttgagcctgaaagaagaggaagaggaagaagagatacagagccgggaactagaggacggcccggcagaca

SEQ ID NO: 704987 - DNA, 232 bp, Homo sapiens
ccagtatcgctcgtaccgtagctggactacaggtgccgcgagcttcgcgtgggtatttgtattttagtagagatggggttcaccttgttagccaggatggtctcgatctcctgacctcgtgatccgcccacctcggctcccaaaggctgaggcaggagaatggcgtgaacccgggagacggcgcgtgcagtgagccgagatcgcgccactgtcctcgcaacctgggcgacag

SEQ ID NO: 704988 - DNA, 521 bp, Homo sapiens
  misc_feature (4)..(4): n is a, c, g, or t
  misc_feature (20)..(20): n is a, c, g, or t
  misc_feature (53)..(53): n is a, c, g, or t
  misc_feature (78)..(78): n is a, c, g, or t
  misc_feature (149)..(149): n is a, c, g, or t
  misc_feature (193)..(193): n is a, c, g, or t
cttnaggaaaatgggccagngcccattcagctccagtcccagagagcttcctntctaactcagagccaactgaactgngaccagaggaggaaaacagagcatcagaagcctgcagtggtggttgtgacgggtaggaggataggaagacnagggggccccaacctgggattgctgcagcagggcaagctttgcnatgttgctctaaggtacatttttaaagagttgttttttggccgggcgcagtgctcatgcctgtaatcccagcactttgggaggccgaggtgggcggatcacgaggtcgtggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaa

SEQ ID NO: 704989 - DNA, 265 bp, Homo sapiens
attatagcattagtgaaaatatatgggatctgtgcaaagtctgactttgtgaatactctttccaattacataataactacttagattgagttgaaattaaaaatagccaacctcaaggaataattcagattcaaagctattctctttcagacagtgctagcataatatacgtatttctacaatactgatttatggtaaacgaagagagattgcagagagagagcgtcgagagcgagaacgcattagaataattcgtgaacaatct

SEQ ID NO: 704990 - DNA, 212 bp, Homo sapiens
  misc_feature (112)..(112): n is a, c, g, or t
  misc_feature (172)..(172): n is a, c, g, or t
  misc_feature (199)..(199): n is a, c, g, or t
ctggggttccccttctgtgcatgaattggctccctctttcgtaccctgctttctgtctgatacttgagcatttagtttcccagatgcctttagtgatcgcaagttgcaaggngcagaaatctgctcacattggtccaaataaagggattgagatctcatggaaatatgacancgctggacttaatgagaactggagttnggaacggggtact

SEQ ID NO: 704991 - DNA, 844 bp, Homo sapiens
gaagaattaaagtacacttgatttgagaagaatgacaccaaatcaccatcgctgaaaaaaatttaagtcagctcagcacgagttgaaattgactacattagatttctttccacctagaatcaacaggatgtttatttcctatgctgattctggaggagttaacctccgtgctaaaaaggcatcttgtccctacatcttctcttctgacttgggcgtacatctcatagtcaagttcagagtgagttcatgataaagttgaaaatagtaatggtcattgccgcacaaatgtattgatgttgtaactgtccacccaagtaagaagtgtatcgtgcctttccatcgtttaggatttcatgctgggacatgtgcgtattgaccagaatatgactaacacgttatcattgtacagatacccttcatttgacacaggttctgaatgagtgatttagtttcctctgtatttgtatgtcttagagagagtgatctagaaatatgagcagctgtacttcataaaggaaactgcgtatgcagattcagtatagtgtatctttggacagtcagaatggacattgaacatggaagttctgttatctgacaggatcagctacaatgccctgtgttaacatgtctaaacagtttcgcttttcttttcagccactagaaggttgggtaaattaaaagcacccaattcatggcctttaaagattcccaaaaacaggagtgacagccgaccagcagcgtgtaccacacaataagaatgcataacccgtaccgcgagctggacgcaatgggacgacgactgcacgacccatgaaaagagctccgggacagtggcggccactct

SEQ ID NO: 704992 - DNA, 732 bp, Homo sapiens
taggcacggcctggagtgggctgcccgccggatgcttgcgggtgggttttctggctcagagatgacggctgtggtgcgcccccccgcggtgggtttctcgatcccaagcatgcttctgtgcggtagccccgtctcgcgccggacaacgtggttccccggggacgctcattacagtttgtctccccgccgttggccggcaggataattcccgccctcacccgatcgcggctgccagccgcacgcaatgttcggttcgtcgccccctcagcctgctgttgttaacacccgtggcgcgtgtttacacacacgccggaacgtacgtgccttgacgcccgcgcggtggtggcaccgatcgttcccctccgcgccgagttgtgtctctctgcgggggttgtcccaccacggcacccacagacttctcttcggggggggtaccactctctcgtgacgactgcggtgtaactatcaacctccgccgtgtactgacgcgggttcctccactacagtatggggcgccccccgggtctcgtcgccaagccccgcgagggcgggtagtacatgcttgtcaaggactcctcaagtttcgcgccacctctatcttggcgcccccctggcacgcagtgatttctggactgcatgacttcgccgcaccgtcctggcaccgtcgccccccagacactccatttctgccccccccccgtcgggtccaaaaaaccccccctcaacaaaaca

SEQ ID NO: 704993 - DNA, 286 bp, Homo sapiens
  misc_feature (264)..(264): n is a, c, g, or t
caaccccccaggtcccagctcaggctaaagggctcttcagggccttggggagctgcagggcagaggtgggggcacccagggaaaggaggcctgcggcctgcgttcattcctggttctcccctcccagccgtgagtccttgggcaggggggttcttcttacagagcctcagtgtccccacctttaaaatagaggaaaagtttccttcccctggctgcccctggagagttgggtgaatgaattgggatgcgcctggccccccgctncccgcctcgcccccgcccctcg

SEQ ID NO: 704994 - DNA, 109 bp, Homo sapiens
atcgccgtgtagaggacccccaaggtccttagcgtacatatgtctacatatgatttcttcctcttcagtgtctgttacatcctggaactcatggcttaagggaccttgt

SEQ ID NO: 704995 - DNA, 694 bp, Homo sapiens
  misc_feature (309)..(309): n is a, c, g, or t
  misc_feature (385)..(385): n is a, c, g, or t
  misc_feature (534)..(534): n is a, c, g, or t
attaatcccctggcccaacccgtcatctactctaccatctttgcaggcacactcatcacatgcgctaagctcgcactgattttttacctgagtaggcctaccaatatataacatgtcgtagcttgtaattccgagtctctaacccaataacaaataagaccctcgtgtgccacagtaagctgcccgtcgagtattgtcctgcacgcgaaggcaaccggcatgccatatgtccttctatatagctgatcctctttcgaagcaatatactctccggacatatgataccgatatacacaatacgtagccaantaacaaataactgcattcatgtaagtaagtgcagtaaatgggctagtatggcaattatgaaaactagtgaaatagnccccgctttatacatcttgctgagatcccagtaggttcatccccaaaaggacagcccacttctggacattgccggcctcggtcttccttctcatcagtgtaccaaagataactaagctccctcatcttcaatcattataccaataatcntcgtccgctcacttaaactgttaagcgctttcgtcccttcacgtctgcgtcaaatcttgtatcctatcgatatgctaggccagtctcgaggttgggattagactcgaaacccgagctgagtgcacagatcttagcatagtcctctatttaccccacatag

SEQ ID NO: 704996 - DNA, 361 bp, Homo sapiens
tcccaccactttggaagacagaggcgggtgggcacttaagcccaggagtcatcactgagcccaggagtttgagaccagcctgggcaacatggcaaaaccccgtctccacacacacacccacacaaatagaaaaaaatttagtcgggagtggtggcacacacctgtggtcccagctactcgggaagctgaggtgggagggtcacctgggcccaggagtttgacgctgcagtgagccttgatgacagcactgcactccagcctgggcaacagagtgagaccttgtctccaggaaaaaaaaaaaagagaaagccatccccttcctggaaataatcggtaatgagtaaccagccttaaaaaaaga

SEQ ID NO: 704997 - DNA, 117 bp, Homo sapiens
tccatcccttatttgtgtcatttttatatctattttcttccaatcacctttggtacacacacctcctaggtagctttgtccagttattttgttggacgattcgtggtatagaaatca

SEQ ID NO: 704998 - DNA, 255 bp, Homo sapiens
cttcggggtgactctagaggtccctgggatagtactccatcacagcattatccaggcgtccatctggcggggattctctcatctccaactataaggcgggcaaggtggtcatggtccatcaagggcacccggtaattgtcctttccgtggataaaatccggagggttggcaagggaaaacacttttacaggcaccgggacgctcatccaaggagccttaatatactggtccatatcgacctcggccaatcaacat

SEQ ID NO: 704999 - DNA, 840 bp, Homo sapiens
agcgggggtggaagccctgtgtgtgagctgtggtgccatggagcggtgtctgccgatcttctgtgtgaagactgtgatccgtggagctgacgtccagggaacgcgtggagtgaggagaatggtggggctgccacccctaatgacgcgagtcctcaagttcactttccgacatgcactcgtatgggaatgacagatggatgatgtccgagcagcttcattggtgcttactgcttgggatctcttacttttatcgactattggtctgtgaggaaccacacgtctgtgctacagaggatgaaaggcacgcttgcatgaaacatctgcattgcacaggtgaagggagaaattcccgatgctcattagcgctacagagaagatcatgattgtacgatgactgtaggcaagtcgtttaagaacgatgtcacggggtacagacataacatgtccttgcagactcatcccccgggctttcgtatgatagcctaccaaggaaaaggtgacatatggacccaaatcggatcattgctggacttgcgaggagaacttttgactcaactcacatcgggttcgaaagaaacttgacaacgcacatgatgcacagtgcacttcgcacgcagctgacttccacggtggcaaagtagatggaagagaagtcgagggatatgaaggaatagcgtaaacagaacggcctgtgacagcgcctcctgtgtgaatgatgggccaacttgcagcgaagacacgacgccgcctgtacacaagggacagctgttgtgccaacagcctgaccattgcaatggcttgcagaagccgcaagagccctggcgtggtactctacccccc

SEQ ID NO: 705000 - DNA, 349 bp, Homo sapiens
  misc_feature (111)..(111): n is a, c, g, or t
  misc_feature (135)..(135): n is a, c, g, or t
tattttaaagtgagaagttcaggtgccacttaggtattgttaacaattgttgcataaccacccccctttattaaagttccaaaaaaaatgttctcctctaaaaggaaaccncccatccattaagcagatactctnccattccttccttcctccagcccccagcaatcaccaatctgctttctgtctctatggatttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttata

SEQ ID NO: 705001 - DNA, 540 bp, Homo sapiens
gcttcgataacctgcttaatactgccaaagtgtgagttcctctgatctcttgattccgtagttctaatctcacgttttgtttataagagatggagtctctcactactgtggcccaggactggagatgcaagctggcaatgatcatagctcatatgcatccattgaaatcctgggatcaggtgatcctcccgcctgagcctccagagtatctgggaatacagaatgacgtgccaccaagcactggctaattttgtctcatgtcttagtacaaagtattttgtgaagccccttcacaagaaaccttaagggaaagtctgatggtgctcaggaatctaagctctcccataaaccatcctctttaactgcgttctaaaatatctctgttggccgtttcttagccttgttcatgtattccattcagtgctccaagcgctttttgtttgtaagcttgagtgcattgggatatgacaggtagtgacgtgtagcatgacagctgttaaccttgtaaatacagatacagcataggagtaagaatgggca

SEQ ID NO: 705002 - DNA, 468 bp, Homo sapiens
ggtgtcatcgatgccacctcatggctacaccttgacctaacgtctttacgtgggtacttgcgcttactttgtagccttcatcagggtttgctgaagatggcggtatataggctgagcaagaggtggtgaggttgatcggtgtttatcgatgccacctctagagggatatgaagcatcgccaggtcctttgagtcctaagctgtggctcgtgtggttcggacgatcagggtggtcgatttagttgttgaggttgaggagctaagcatagtggggtatctaatcccggtaatgggtcttagggatcgtgtgtacagatatgtcaaatctattatagtaatctatgtagtgtaaagtgtgttatttgacaattcaggtgagtcagatcagtatgggggagggggtgatcgaaatagattcataacgccgtgttacgatggattcgattgactcgtgtgatcgtggtgagtg

SEQ ID NO: 705003 - DNA, 629 bp, Homo sapiens
agcggagtgacgcgcgcgcgcgcgatcgcgctcggaccccggccgctgccgccatcactgtcgcccgcccagtcgcccctcagccgcttcccctcgccatggaggcgaggccgccgccgccgacgcggggctcggagccgcgggtccgggcggcggccctgagggctagtggcggcccgaaacgccgccgcggagccgaggcggagccgctgtcctcgtccccagcggtcccggccaagcgcccgactctgtgacacaacgtaagagaaaaagacaaaggtattgatggaattccactgagtggtaacgggatgatgcagttcaaataacctaatgttaatgcatggattccgtggtttcattctgtgttctgctcggcagtgggtctgaatatgtgtcgggtgccaactaatgctaccacagtggcacctgtcttgtaggacacttacacagattaagttacgctcatcagacggcagaaccagttgaaagaagaggccaaaacgttcaaatccaacttcttcagtaacttctctttctgtgggcaccaacattcagcccgaaagtataactctgggacccacctatttagccactgtcaattcttcagactctgacaatgggaccaa

SEQ ID NO: 705004 - DNA, 316 bp, Homo sapiens
tgctgggattatgggcgtgagccacggcgcccggccgattgacccctttcaacaagcccagagggatgaagcaactaggccaaggtccagtgctagtcgtggcagcagtgggactagaacccaggtgtccaggactccaaatctggactcgctgctgcatgacacccatgggcccacagcagcctctgggatttctttaacataggagaaccaaaggagacacgggaggccctgaagggcccagctgagactgtcccatctcaggctccatcgaagtccaagactccgggtggttcactccagacctgcccgccaa

SEQ ID NO: 705005 - DNA, 346 bp, Homo sapiens
agtgtgaggtcactgtaccaccccagaacactggtctcgggcccgagaagacctcagggggccaggcttcaggtatcaccactaaaatctccaggggcaccattgaaatcctgagtgatgtgcagctgagtcaagactggaggacaagtgggagccggcgaagccacgctgctgaacatgctcgacatctcccccttctcctgtgggctggtcatccagcaggtgtccgacaatggcagcatctacaaccctgaagtgcttgatatcacagaggaaactctgcattctcgcttcctggagggtgtccgcgatgttgccagtgtctgtctgcagattggctacccaa

SEQ ID NO: 705006 - DNA, 1135 bp, Homo sapiens
gagaagaggggagagtggagggccgatggataagcttccaaaatgatgccgcacaccagttatcctattgaatcgaggggactgatagctcccaaggcatcccccagcttgtgcagtaacatcagtgcctgccaggtgcattgctgcaggctgtaagcaactaccctgggtccccgttggccatggcacacagcttcatagtcagcatggccagcaggcacacagccaacacatcctcgtcacactgccatggcgagcccaccaactcactcgcagacaccaacctacgcacagctacgctcccatccccagcagcaaacagcacctaccggcccagccacaatgggcccaaaatcgccaacggcatgaccacgcagcgcctgaggatggcactggcaaccacaacccatcgacgccgcacccatatgccacgccgcccggcccacacgccttcacatcgcacagcccagggccaagcaacaccccccataatgctcgcgacgcgacagcggtcagcaaccaccacccaccacgaacatcgagatcaaataacagcacgggcatatctgtcgcggcacaacaacgacccaaccccccagccacgtagcaccaacgccacaaacacccccaagcaccctcccacccacgcaccgcactcctgacatacgcccacaccccgggtgcaccaccaacaagcgccacagcacctacacacgccaggcacgcccaaaacgcgccacacggccaccggcgcgcccacaaaccccgggttgcatgacccaaactgaaacccggcacaccctgcacgcccaacccagagccacggacgtcccccccccaagaccacacccaagcgccccacccacgaccgggcatcacggaaccccgcaggcgccccggcacacccacacccaggaacggacaatcgcccccccgcaacggcacaagctcggacccgcacacgccctccacacacaccggccacccggcgcaccaccaaaggcaccggggaccccagagccaccggcaagaaccaccccgcacgggcacccacaccacaaccacaacggcacacagacctcgcgacagacacccgcgaccaccaaccaccaccgcacaaccagcaacaccacac

SEQ ID NO: 705007 - DNA, 202 bp, Homo sapiens
gagtactccagacaagtgacgggcgctgtggtcatgcctgtatcccagcaccctgggagtgctgaggtgggcagatcactgaggtcaggagttcaagaccagcctggccaagatggtgaaaccccgtctccactaaaaacacaaaaattatctgtggcatggtgtgtgggcaccttgcaatcccatgctacttgtggaggct

SEQ ID NO: 705008 - DNA, 809 bp, Homo sapiens
ggacgacgccatgttggggtttgtgggtcgggtggtcgcttgctccggcctccgggggcgtgcggagactcaccccttcagggtcagctgcccccagctcagctcttactgcgggccgctccagacggcgggtccatcctgtcagggagtatgcggcgcaaacatctccttcgcacaaaagcaggcgccgtgcaccgggcgacatcgtgggcggtcattggcagcagtggtggtagcgtccagttttgatgagggactatcaccaattctaagagtgccctggaatgtgcaaggctagtgaagaccagactgttgtatggaggtggcccaggatttgggtgagagcacatgtaaggactatgtctatggagtggaacgagatagggctatggttagtatggcctagaaatgtacgtggatttctggttgcaccaagtcaagattcctgttggtcctgagaggtaatgggcggaatcatgaatgtcgttggagaggctattgatgaaagaggtccctagtctaaagcaaacaatttgctcccattcgatgtctagaggctcgcagagttcatggaaatgagtgttagagcaggaaattctggtgactggtatcaaggttgtcgatctgtagcttcctatgccaagggtggcaaaaatgggctttggggatggtgctggagttggcaagactgtactgatcatggagttaatcaacaatgtcagcaaagcccatggtggttactctgatgttagctggtagtaggtgaagagggacccgggaagggaatgatttattccatgaaatgaatg

SEQ ID NO: 705009 - DNA, 1449 bp, Homo sapiens
  misc_feature (980)..(980): n is a, c, g, or t
  misc_feature (999)..(999): n is a, c, g, or t
  misc_feature (1051)..(1051): n is a, c, g, or t
  misc_feature (1070)..(1070): n is a, c, g, or t
ctgtcttttttgtgggcgttctcttcccccccccccccccaccagcgttgtggtcgtcttttgtataactttgtagtgtcgccccaccatgggatttgtgaattgtggatatatattgcgcccgtcgtccacaacagttgtcttttctccgcgacgtccgtcgtgtcttttttcggggcgtacgctttgtcactgcggccccccaagcaggtgttgtgggcggtgcggatagggggggcccccccccccctcgggttttggtgtttgggcgccccacgcggtgggatggaggaccgtttgcgcccccccgtctgtgtttccctggaagtgagtcctttttacaagcatccccgggctggcgctttttaaatgtgcttccgctccccccaacagggggcgtcccaccacaaccaaacggggtccccccaactagtgcgcccccttcgtgtttgcgccggcgtgggggttgcccccccaagcaggcagcccccgttggtaagtctcggccccctcctttatcatcccttctgggggggtgtcaccacaggcggggcccccaacgccaccaacggcgccgccttcgtgttgttggggtggtttgttttccttccgccctcatgaagaaaaaatatggcgtgtgtctatggaagtgccccccgtcccccccccgtcctttttggtggttaaacccccccgtccgttaagaaagagttttgttgggtacgcacctcggttgcccccctcttcggcccaccagagcgggacaacttgtgtggggaaacacaacaaggttgggtgtgttgtgatctgttgttggtgggttgttagaatatttccttcttttcctccccactactggttttttgcggaggagagtttggagaggagatattgcccccccgtgagccaccccctctcacgggggtctctgtctccggttgtgtgcgcctctgtacacagccctctcgcccacccacagngtgggggtacacacacccnccgtggcgcacagcacaccacagtgtgttccgtgtgtgtctccgctctgttntgtgggggaccccgctgtngtgtagacacacacgtggacccacctcgtgggggttctgagactctttctgtctttctaacaccgctgcgctcttgcctcgagaagttgttcgaagtcccacgtccctcttgttgcctcgttggctcgttgctcgttgctcgttgctcgttggcactcttgctgcgtaaatcctcgagggctggtagcacgaaatgcaccacttggaagctctccacccccactaattgtttcttcacaaagtggagaggtctcccctgagtccacgacccaagtgggaggaagcccctgggggccggggacctggagctgcccagcccccagcgtgattcctgctgccctgtattctctattcccataaagccgagtttgacccccgt

SEQ ID NO: 705010 - DNA, 165 bp, Homo sapiens
tgaggcagctggcgcggatggacgaagaggttcagagcatcagacgagatggcccgccacttgcaggagtaccaggacctgctcaatgtcaagctggccctggacaatcgagatcgcacacctacaggaagctgctagagggcgaggaagaaccggatcaccatt

SEQ ID NO: 705011 - DNA, 753 bp, Homo sapiens
aggctgtacggtctggaattttgggatacgggacttctgcccagtggcagagagggcggcgtcctgtcatgtgcccctggtgtgtacagattctgctgtggctgtccactgcccaagtgtggggcctgacccgcctgatgctggacaggactgggggccgatgctgggactgcggctggcttccagtaggcgtgtagccggctgcggctggtgggcatggagctgtgttggcatggtgtgggtaggactggtgaacagatggcataaagggcttggggggtaggctgctctgcagaagggtactgaggggtagaggatgacacgatggactggtgaacaagtggcataaaagggcttggggggtaggctgctctgcagaaggggtactgaggggtaggaggatgacacgatggcctggggatagggtgcccgacgtcagcatgcgtagtgtttgctctgaagcattgggggccaaacaccgggtgtgaagggggtagatgagccatgtggctgcatcatggctggctggcctggggaacttctgagggtagaaggggattgtaggaaagaataggggctgttgtaagcaccagaggcgggccaggcagacgcgggaggacttgcattccatcggcaggggctgatgctggctggatgttggtccgaggcgctgcgggaggaacgggagccttttgctaccccgagtacttgacctgcatgccagggcactgtaattggatacagggacatatg

SEQ ID NO: 705012 - DNA, 846 bp, Homo sapiens
gtaaattaaaaaaaaaaaatttctttttgagacagggtcttgctgtcacccaggctggagggcagtgacacaatcttggctcactgcaacctctgcctcctgggctcaagtgaccctcccacctcagccacccaagtagctgggaccacaggcgcaagccaccatgcctggcttatttttggtatttttggtagagacagagttttggtcatattgcccaggctggtcttgaactcctgagctcaagtgatccacacaccttaacctctgaaagtgcagggattatagacatgagccaccatgcccagcctacttgtgctttttttaagttgggaatcctttgactcctttttgggctgccagaatcctactcgtaatctaaggtttatgtactgggactatgtgggtaggctatgtggatcagaacatagaattttgcccctcaaatgcaggcttccgggagactggagtcgaaggccgtgagttcagcataatggcaggtgaagaaacttattgaagactatccagtaaaattcccgagtttttgtcagcgtttgagattcctgggtgctgggatgaaatgctgagaaccaagatgtctgttctagaatgaattgttgccgaagtcgatccttgaacagccagagtgttggttctgcttccaataatccagtgtgggttttgggcaccaggtatccaggaatccgaaggatggaggacggtctttgaacggcgaacagacaaagggggcgggacaggcctcatgaaagctgggcagaaaaaaaaattgcccgcaatacaaggcacaaaaatgacaaagggtcaaaggggaaattaaatagctgt

SEQ ID NO: 705013 - DNA, 144 bp, Homo sapiens
ccatgctgcttggtcagttaggctgtcaaatgagtttgtcccagaataatagcttgtctttttttgtcttctattttgtactacgtgctcagactacgacagttctcttttatcttgccttatttttttctttttttttagcac

SEQ ID NO: 705014 - DNA, 129 bp, Homo sapiens
ctcaggctcgctccgttcgcctgctgcgggtatgttgtgttgctcgcttactgaacccgcttactgatgctccgcttactgatgctccgcttactgaacgcttactgatgctgtatgatgctccgctta

SEQ ID NO: 705015 - DNA, 1366 bp, Homo sapiens
  misc_feature (56)..(56): n is a, c, g, or t
  misc_feature (86)..(86): n is a, c, g, or t
  misc_feature (100)..(100): n is a, c, g, or t
  misc_feature (119)..(119): n is a, c, g, or t
  misc_feature (185)..(185): n is a, c, g, or t
  misc_feature (281)..(281): n is a, c, g, or t
  misc_feature (319)..(319): n is a, c, g, or t
  misc_feature (345)..(345): n is a, c, g, or t
  misc_feature (347)..(347): n is a, c, g, or t
  misc_feature (376)..(376): n is a, c, g, or t
  misc_feature (382)..(382): n is a, c, g, or t
  misc_feature (394)..(394): n is a, c, g, or t
  misc_feature (428)..(429): n is a, c, g, or t
  misc_feature (450)..(450): n is a, c, g, or t
  misc_feature (493)..(493): n is a, c, g, or t
  misc_feature (567)..(567): n is a, c, g, or t
  misc_feature (572)..(572): n is a, c, g, or t
  misc_feature (640)..(640): n is a, c, g, or t
  misc_feature (659)..(660): n is a, c, g, or t
  misc_feature (676)..(676): n is a, c, g, or t
  misc_feature (702)..(702): n is a, c, g, or t
  misc_feature (917)..(917): n is a, c, g, or t
aaagcgagaggacgggagcctgagcgcctaagtaaggtaagcttcccggagtgagngcttatcggagtcagaggcagtcagcctanccatataccatagnatgcgccctgcgaacgtgnaagtcgtccgagcgttctgctgagctagcttacctggacctttcagcgtactccagcagtagtgtntcacttgtcctagtcttgagtgcaatcaggcatcacacgtgagcctcatgcaagctagggccggctagctgtgcacagtctgacgcatcttggctntctgcgagatcccttccttctggtcagctgcacttcgnatcagtttgatgccatctccagagananacgtctcggtccaggagtgaagggctgcncctgcngtcaggtctggncgatggccccttaccctgctgccctggctttggnnttgaagcaattcctgagttgngggtactgggcctgccgcatcctgtcctgtccactgcccaccnccgtgtgctggctccctcacttctggctgcagtgggagccgccagtctgacccttgtcaccgcacgctctgccnccacnccgttgcaagaggtcacaccatgtcagcagccttgcactgaccgcagccggcccccaggcctcagagntctggatgcttccgtgcgnntccaacaggcatcgtnttcccttccgcaggtggaggggccgnttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgnctgcaggcgcagtgactgctgaacataaaagaactactgtcaacaaaggccgcgcctgcctttcccatctgactatctatctggctggcagggaaggaaagaacttgcatgctgctgaaggaagaagcgggctggaagaagccctgcggcaccaccaggtaaatttagcggaaaaccatgcctggcccagcctgtcctccatggctgctttgcactcctactcagctgtgactcttctcaagcggtgcaatacctctcaatctattggaatcacctggagtctgtacttaccctattaaaaagttccgaaactcagctcccccacctcactcactctgtcagccccgtacacccacggtcgcccctcccttactcattctatttgagcccccctctatggtttaatagttcgtcattattatcttccgtatcccaatctatccctcaat

SEQ ID NO: 705016 - DNA, 365 bp, Homo sapiens
cgggtggatcacgaggtcaggagatcgatatcatcctggctaacagagggaaaccccatctctactaaaaatagaaaaaattagccgggcatggtggtgggcacctgtagtcccaactactcgggaggctgaggcaggagaatggcggaaacctgggaggcagaggttgcagtgagctgagatcacaccattgcactcgagcctgggcaacaagagcgaaactgcttcttgaaaaaaaaaagaaagaaagttttatctaatggttttagttggaatttctttaattactaatgaaattagacattggcatattggttatttcctctttcatgagcggtcttggtctttggccggtggagtacaag

SEQ ID NO: 705017 - DNA, 432 bp, Homo sapiens
ggctttatcaggctcactggtgtaagcttttttgacctctgaagtcaggatgaaatgatctccaaggaaaggctaggcaaagggcggtgagcccatatgtgtgtttctcactatcagggtcctggggagctggagggtccttgtcctagacccatccccttgcctcctggccaggccaagcttagcttcctagtaagacagtgaggcttccccctgagtgcttggaagaggctcacctaagaggctctggaagactcaggacatttgcaaaaagccaagctctgggcagagactttggggacaagaggcagaaacatcgctttctgaccatgtcagtgtgatggcatctggggcatgcacacatgtgtgtactgaacttgacagtccacatccatgcccagcttggccatggcacaagccaccctccactcc

SEQ ID NO: 705018 - DNA, 315 bp, Homo sapiens
tggggtacccttctctgatatctcaaaatacgttgtgtgtatctcttttacctgtagtgattagaaactcccttataaatcaagaccatgattcccagacaaaattatcagaagagtataaaagaagtcttctttgagtgtgaaatatctcatggaatatagcacatgggctcttcacgaagaaactactagaagagaagaagacaagctggaagaggccagggaaagggggttagtactattttacagtgaggctgggctcatacagtggctcacctgtaatcccagcactttgggcgtacggggagggtaccg

SEQ ID NO: 705019 - DNA, 579 bp, Homo sapiens
  misc_feature (413)..(413): n is a, c, g, or t
tggcaaacgccaccgccgaggaaaaccggtgtactattagccagtggtcaaccccaccggtgttcttcgacattgccgtcaacggggagccctggggccgcgtctccttggagctgttggcagacaaggtcccaaagacagcagaaaattttcgtgctctgagcactggagagaaaggattgggttataagggtcccgtgctttcacagaattattccagggttaatgtgtcagggttggtgacttcacacgccataatgggcacgggggtggcaagttccactcatatgtggggacgaacatttgtgacagactgaagaatttcactcctataaacgcattacggggctccgtggcactcttgtgtctccagtggccaaattgcttggacccaaccacaaatgggttcccangttttcacattctgtgcactgtgccaagacgtgaggtggtgggagtggcaacgcagtggtgggtgttgggcacaaggtgaaagaaggcatctgaactactgggtggacggccatgtggagccgcttggggctccaggacagtggcaacgaccagcaaagaaagatc

SEQ ID NO: 705020 - DNA, 1557 bp, Homo sapiens
  misc_feature (283)..(283): n is a, c, g, or t
  misc_feature (355)..(355): n is a, c, g, or t
  misc_feature (376)..(376): n is a, c, g, or t
  misc_feature (1204)..(1204): n is a, c, g, or t
ttctcatcaaaggggcgctgcttgtgtggtagaaaaagaggggggtagatatagaaggcgccgcgcggtgtaaatgttgtttggtgtgatgaagaccgcccctaacaaagtggtgtgtgggctccccccccaagggtgtgattcgtttgtgggagaggagtgttattaatggggagaggtcggggggggggcatcaactccaagttgtcttacaagggagaggtgccgctgttgctgaagtatccccccctgtgggagcgccactagtcgtttggtggggggngcccacccatctcaccaccacggggggggcgcctcattgtggttagccagccatctagtgtttgccccatcncagcggcggccgcctcctctntcatggggggggataaaactcctcttgtgggcgctgtgtcccccccccccccatgttgcgtcatgctggccgctgtgtctgatgggcagatcatggtcgtgtaggcattgttggctagctgggccgactacctcctagttggggggccgactcggttggtgctcgtcacaaaaaggagccgtttgtggcgcgccgagaaaaagggcgcttgtgttttctcccccggagagggggcgccacataggagaacacccacaggggggcgcccctcctttgttgctctgctcactagaagaggggatatactctacgcccccaacagagggtctcttctctctggggtgtctggggctctacatattattatagagagagggttttttttttgggggagaattgggtgagagagagagatattcctctctggagccccacactctcctttggggtgggacacaaacacacagggctcccttcggggacctctgctcactctgtgtgtgagacacagagagggttagagcacacacacacttggagtagtgtcccgcacgcaccctctcaatactctctctttgtccgcgctctgtgtggtacaatagagagagtgtgtctctgtgtgttctataagagagccgcacatgagagatcccaaaaggggccctcccacgaggaacacccctcttggggtggtgtgtgtctctctctctgttggaaagcgcacactggagaccacgccacactctgttgaactcttggtcaccgcgcggggttgttgttgtgtgttgttttcttatatttgctctgtggcggaacctctctctttgnggagaggagacctgtataaaggcggggtgtgttgaactctggttgtttgttaaagagagtggtggtggaaagtggggtgtgttgtgaagaagttttgtggagcaactgctgtataataacacacatcggccaatgccaatacgcctcaattttaaaacacacctaaccggaattctgagattgagagaaggaacacatatagtttttttttttataccacataaactgaaattatattttaattttcttaatggtaacctgagaaatgtatgcccaatagattagttgaagtaagttttttaaattaaaaattaaattaaattatttggaagggaaaaaaaataaaaaataaa

SEQ ID NO: 705021 - DNA, 108 bp, Homo sapiens
tttttgggtgctccctggccccagggtggggtctggttaccatggctgtgtgtgtccatgtctgcaagcagtttttcaataaatggcctgcctcccccaaaaaaaaaa

SEQ ID NO: 705022 - DNA, 679 bp, Homo sapiens
  misc_feature (28)..(28): n is a, c, g, or t
  misc_feature (245)..(245): n is a, c, g, or t
  misc_feature (270)..(270): n is a, c, g, or t
  misc_feature (287)..(287): n is a, c, g, or t
  misc_feature (344)..(344): n is a, c, g, or t
gctactctttctggtgttagatcgagcnaccctctaaaagcagtttagagtggtaaaaaaaaaaaaaaacacaccaaaggctcgcagccacaaaggggatgaaatttcttcgggacatcctccggcttctcccggttactggatcgtctggctccctagagtccttcgtggaagctttttattcctaagaggagaaaatcagtcaccgggcgaaatcggtggctggattacagggagctggggcntgggaattggggagactggactggnctatgaattggctaaanttaaaagcaagctgggttctcggggatataaataagctgggactgggaggaaacagntggccaaattggcaggggactggggtgccagggttcataccttggtgggtagactggcagcaaccgagaagatatttacaggctctgcaaagaacggtgaagggcagaaatgggagatgtcagtattgtagtaaataagggcggggtagtctatacattcagattgtgttggctacacaagatccttccggattggacccggactttgggagaggttaaagtggtgaccttgggcgccatttttcgtcgggagcttaacaaggggggcgttttttcttctcccccgtgggcgccacatgtgggaccgcgaaggaattaacccgttgcccaattgg

SEQ ID NO: 705023 - DNA, 664 bp, Homo sapiens
  misc_feature (282)..(282): n is a, c, g, or t
  misc_feature (655)..(655): n is a, c, g, or t
tttttttttttagggggggggggggggggttttccttttttcccccaccccccgggggggggggggggggggtttatattttttttttgtttggggggggggggggcccccttttggggggtgaggaaaaaaaaaaaatgtttttaaaaaaaaaaaaaaaaaaaaaaaggatggtggttctcctccccccccccgggggcaagggagatgggggttgaggggggggttttcccccccccccccccccacacaaaaaaaaggagaggaggggggggggggggnccccccattgggtgccccctttttaaaaaaaaagggggggggggggggggggggaaaaaaaaaattttttttcttcctccccaaaaaatttttgtttggggggggggaggggggggccgcgcccccctctttttttttaaaaaccagtttttttttttaaaaaccccccccccacaattttttttttaacccccctcccttttttttttaaaaccctttttttttccaaaagaaaaaaaaaaatttgtggttactcttttcaaggggtttaaaaagaaaagccccccctttttagacccccctttgtgcaatgtttttgccaattttttccaatggatttcatggtatttgccccgtgtcctttgaccggcangaagctcgt

SEQ ID NO: 705024 - DNA, 298 bp, Homo sapiens
caagccaatgacgcacagatatgctcatgatgtacatttacaaagcttatcagacaatagtctctctctgtatatgtatttctcagagtgtatgtatatatgtgtgtcggaagcaaatatgtaaaaccatgacctggaagaatacaccacaaaccaagattgtgactgcctctgggaggggactgcacattgggaggaggtccaaggcggtatccagccacaggggtcatttccattagtgacaaaaatgtctaaggcaaaatatgcaaaaaatcatttgcatccgcacaacttctag

SEQ ID NO: 705025 - DNA, 207 bp, Homo sapiens
  misc_feature (143)..(143): n is a, c, g, or t
caccatcatttggtctgaaacaggagataaagttccaagtaaaacggtagctgctaaaaagggaaaccgtcttcagatacagtcctaagcccaagagagccccaaacagaggacagtagtagaggctgtaaactctgactcgnattcagaatttggcattccaaagaagactacaacaccaaaaggtaaaggccgagggcaaagaaa

SEQ ID NO: 705026 - DNA, 229 bp, Homo sapiens
tgcccacaagataccaatcacaaggggtgctggtacgctagctgactttgtgacaatcaaatcacaaggacgaataagaaagtcaaaactaattcggacatgaaggctgtcaaggctcattggcaaagtttgtttgtcccaaaccagcaatgtcaacgaattgttgcacagtaatcttttgaccctgacaatgctttggtaacagtacctgacttcaagtgggctgggt

SEQ ID NO: 705027 - DNA, 90 bp, Homo sapiens
gtggacacaggcacatattactgtgcacacaggacggtttcgtacggtgcctacaaagcagaccattacttcgatctctggggccgtggc

SEQ ID NO: 705028 - DNA, 376 bp, Homo sapiens
gatggaccccggattataccagatacaggcgttatacggtaggaaaggcgccatccgttcggtggttcttgcttggtcgtgactgtgactctcctgcgcggcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccgggtaccgagct

SEQ ID NO: 705029 - DNA, 549 bp, Homo sapiens
taccgtctacggacaggcgacaggtgcagaacaaaaacagcaggacaaacccacgagtttgaatgttggaaagacactgacaaatcgccgcacgggccgggcagttggcaagtggtgcaaccagcccgattacaaccccgggcagccatcctctcatggtgtcgagatttggggcgatgcctggaaggatctgggggaatgcggtggcttccagggtaaccgtctgaccctgaacttcagcacgttaagcggccgggggccgatcagccagccaaccccgggcgtggcgcgggccgatcaggtagtcactggcgtattgcgctgcaaagccgcaggagatcccgatcagtgccaagtccggcgaaaccattcacctcgataacctgaaggcctgcgactaccaacgtggtgatgaaccccgctggtgggtttgtgcccttgaacacaccgcgtatcgtttccttccagcgagaggagggtgaggaacaggcggtcaccactgaagtatcgccaccgtgcagacattcgtgctaaggatcctctaagtac

SEQ ID NO: 705030 - DNA, 86 bp, Homo sapiens
gaactgctggaccatgtactgctgccgaccctgcagagttataagccccaaacaggtcatgctccaataaaaatgattctacctac

SEQ ID NO: 705031 - DNA, 995 bp, Homo sapiens
  misc_feature (23)..(23): n is a, c, g, or t
  misc_feature (73)..(73): n is a, c, g, or t
  misc_feature (82)..(82): n is a, c, g, or t
  misc_feature (100)..(101): n is a, c, g, or t
  misc_feature (104)..(104): n is a, c, g, or t
  misc_feature (109)..(109): n is a, c, g, or t
  misc_feature (111)..(111): n is a, c, g, or t
  misc_feature (115)..(115): n is a, c, g, or t
  misc_feature (118)..(118): n is a, c, g, or t
  misc_feature (120)..(120): n is a, c, g, or t
  misc_feature (124)..(124): n is a, c, g, or t
  misc_feature (129)..(129): n is a, c, g, or t
  misc_feature (140)..(140): n is a, c, g, or t
  misc_feature (142)..(142): n is a, c, g, or t
  misc_feature (170)..(170): n is a, c, g, or t
  misc_feature (174)..(174): n is a, c, g, or t
  misc_feature (197)..(197): n is a, c, g, or t
  misc_feature (204)..(204): n is a, c, g, or t
  misc_feature (222)..(222): n is a, c, g, or t
  misc_feature (226)..(226): n is a, c, g, or t
  misc_feature (234)..(234): n is a, c, g, or t
  misc_feature (251)..(251): n is a, c, g, or t
  misc_feature (253)..(253): n is a, c, g, or t
  misc_feature (264)..(264): n is a, c, g, or t
  misc_feature (268)..(268): n is a, c, g, or t
  misc_feature (287)..(287): n is a, c, g, or t
  misc_feature (292)..(292): n is a, c, g, or t
  misc_feature (303)..(303): n is a, c, g, or t
  misc_feature (312)..(312): n is a, c, g, or t
  misc_feature (435)..(435): n is a, c, g, or t
  misc_feature (458)..(458): n is a, c, g, or t
  misc_feature (477)..(477): n is a, c, g, or t
  misc_feature (495)..(495): n is a, c, g, or t
  misc_feature (528)..(528): n is a, c, g, or t
  misc_feature (550)..(550): n is a, c, g, or t
  misc_feature (564)..(564): n is a, c, g, or t
  misc_feature (793)..(793): n is a, c, g, or t
  misc_feature (838)..(838): n is a, c, g, or t
  misc_feature (864)..(864): n is a, c, g, or t
  misc_feature (921)..(921): n is a, c, g, or t
  misc_feature (927)..(927): n is a, c, g, or t
  misc_feature (962)..(962): n is a, c, g, or t
aagggggggtgggggaagagggncagggggggggggggggggggggggggggggggggggggggggggggggnggggggcgngaggggcgggcggaggcnnagnggtgngngcgngantngggnggganggggtgggagngngagcgccggaaggggagaggcaggcgcntgcnatgcctggggcacggggcctctncaggganagagcgagctccagtgtntgcngagagggnacgagaatgacccaaanangcgatgtccanagcnagtgccttgggatattcanagcanatgcggccagnggacgagcngcgacaccacgtgaggagcacctgtgagcggccacgaggcgtcagctccagagcgggcccgcagcccatcctgctgggggagacccttgctccaggcttcctcacagggcgctggtcaaaggnaccaagtcgacaccccccatgcnagaggatccccctgtggcnccgggaagggctgcgaantggagctgtctcaggttcccgttgaggcccagngccgctgagtgccatgactccntgggggacagagcncaggagggaaaaggggaatggacttctacaggatggggtgggggacggcctgtcccggggacaccctggttctttctacgcgatggccgctctggcctgggagagaagctggcaaggagagggcaccgggtaaggatggggtgctgcatgacccagctctgcccaaggtggccagggagaccactatgaaggctgcctggtgtgagcgggaccctggtggggtgcagantgaggccctgtgtggggactcagggagggatgctgggcgggaganaggcccagggtgtcccctcacccatncaggtccctgggtgtgatcatggaggactggtaaagctgctgctgcccagtggcgancatcancagggtcaggagtaggggagtgagtgcagaaaccnagggaagggcccacttccaaggacgtttaatgt

SEQ ID NO: 705032 - DNA, 134 bp, Homo sapiens
ggcacgagcaacagcttttcagaagcttgaggaagcttagaaggcagcagatgagagttagagaggcatgaaagtcatttagagtcgagcccaaaaagatgaagaaaaaatggaaattcatgagtatccaactt

SEQ ID NO: 705033 - DNA, 157 bp, Homo sapiens
caagggcagatgccttgcacttcgagacaggagtatgcaggggcctcagcctaccttcccaatgcagtgctcaggataacgtaagaatggctttgtggtgctcaaaggccggacatatgagatcgtcgagatgtctacttacgaagacgggcaaaca

SEQ ID NO: 705034 - DNA, 944 bp, Homo sapiens
gggaaagaggagaaactcctgtttggagaagggttttctcctttgcttccagttcagactatcgaggaggaagaaatccagcctggggaggaaatgccacacttaggctgagacccatcaaatgtggagagccctccctttggaagagtggccctctccctggctcccatcgtttcaaagaggaatcgatctcactcctgtggaggattcgtcccaatctcccaccccaatgacccaagaagtcctacagttgggcttaggtccccaacccggctgtgtctcggaagatgcttgtgattcaacacacgggatgaggagggatgaggagcctggtctcaggaggaaacagcatcatacgtgcatcactctgtgtggatcagccggagctgctcttctcagaggggcccagtacttcaccagctgggccgctgagctccctgttccgcagcgagacgtacctcttgaccctgtcgtcccaggatcgagcgtaacgtcccaaggaatgtgggaggacctattcacagacatccctattaacgaaacgcgtgccacatctcctcgcaccccgagcaaattctgtcctccccagaacgcccatgaatcctggaggctcacgcccccaggccaaagtacgggggactggatttcagcccagtacaaaccccccaggttgcctctgagcccttgtcctgaacccctgtgggctgatggatctcaggaccactcccttgcaaagtgctcccccccttgaatcaccgcaaaggctcctcaagttcagaacccttagacctcatctccgtcccctttggcaactcttcttcgctcagatatagacgtccccaagccaggctccccggaggcacaaggtttctggcctgggaggccaatcgtctcctgacagaaagcctggtccctggagccatgaatgacagcctcaggagatc

SEQ ID NO: 705035 - DNA, 435 bp, Homo sapiens
  misc_feature (26)..(26): n is a, c, g, or t
  misc_feature (33)..(33): n is a, c, g, or t
  misc_feature (35)..(35): n is a, c, g, or t
  misc_feature (37)..(37): n is a, c, g, or t
  misc_feature (53)..(53): n is a, c, g, or t
  misc_feature (55)..(55): n is a, c, g, or t
  misc_feature (57)..(57): n is a, c, g, or t
  misc_feature (66)..(66): n is a, c, g, or t
  misc_feature (73)..(73): n is a, c, g, or t
  misc_feature (85)..(85): n is a, c, g, or t
  misc_feature (94)..(94): n is a, c, g, or t
  misc_feature (290)..(290): n is a, c, g, or t
  misc_feature (295)..(295): n is a, c, g, or t
  misc_feature (301)..(301): n is a, c, g, or t
  misc_feature (364)..(364): n is a, c, g, or t
  misc_feature (407)..(407): n is a, c, g, or t
atgcttatcaaagaacccaggggagnggggggncntnaaaatgctccaaaccncncnttcatcaancggtccnaggtggaaaaantggattttnccggctggttgtgtaaaaccctgcggttgaaccagcccggcacacccacgcgcacccccgtgtgacagtggccgggctccctgggtcctgctggtgacctgccccccgtccctgtccatgccccgcccttccagttgaggacaggctggggcctcccccccccctcctgcctcacccctgcggaaagccccgtggnggggngacagngcatgcaggaacgggggtttcctttcctgcccgtcctggccggggtgcctttggggacgggcnacccttctgtgtgtggtttcaaaggctttgcttccttaggttncaaaacaaaacagggaaagaaaaagcca

SEQ ID NO: 705036 - DNA, 117 bp, Homo sapiens
aaaattacgggctaaggtagcgaggcctgggctgtagggcctgggcctggttcgggagctcaggcagccaagaggaggaggaggagccgggactggtcgagggtgacccgggggacg

SEQ ID NO: 705037 - DNA, 739 bp, Homo sapiens
gactccggaccctacagtggtatggctgagccgactagtgatttcgagactcctatcgtggtggcatgcgtctcccgaggctgactcccacgttagggtcccctgagacgacactgccccgccgcgggacaggtggatgttactgggcaatgctgccgacaccgccaccaccacttacgtcctcgacttcccgcagccgggatcaaagccttcctctgagtcagcagccgccccatggatgcccagatctctccccggggcatccgaccaccacttcgacagcccagatacttcccggggacgcaaacaccccattcgaagcccagtctcaccacttgattctcagcccatcaacccagcggccagactatggaattaccatgctatccaacatcgatggtattggaagacagacattctgatagagtaacactcggacatcaagaagtccttcaacccatgccagtataaaaatccattattatccacgaacaggtatgactgcaaaaatatcacagaactccaggacgtaaccccatccccaagggtaggagaagagcaagaacgaaaaagagaagaaccacaaagagaagccagaaaggcacgagagcaggacacgggaggcgggcagcgcagagagagagaagaaagcaagccgagacaaacgcccagcgagcccgacaaagagaagcagacgaaacagtagatacacaggagaaacaacgagcagaggcccccg

SEQ ID NO: 705038 - DNA, 764 bp, Homo sapiens
agcggctggaggacggagcacggaaacaggagcccgatgccataaatgtgaatacccagcagaactggattgcgccgtggggaaggctcctcaggataaaccctttgtagggaagaagaatactagcagagatgcccaagctgcaggtgtgaactctgtgataggaggacaaagcagtgggggctggaaaccaaggaaggccccagccgacatcttacttctcgggcatatgcctgcgagctctgcgccaagcagttccagagcccttccacactcaaatatgcacatgagatgtcacaccagtgtggagaatgccactaccagttgcaacgacctgcgtgactggctgcattttcgggtgcacaggaaacttagcaggaagagcatgaagcgcatccatcctggagcttgaacggagttgcgtctgatcagtattgcataacaatggcattgcaccgttgacatgagaccctcaaaattccagtgaacagaatccatactggcagaacaagcgttacctactgtcagttctgcgtttcacgagattgtccgtatctctccagcaagaaggaatcagcgagcagaggcatattcgtggagcataatgggaagggctatgcctgcttccatgtgccccagtaatttgcataagcgagctgctggccgtggaatgcagccaaaagaaagcacttattcatagagcccaagtcagcaggagaaaataggtgacgtgtgccaggaaaaagtcaaatccttggagaatc

SEQ ID NO: 705039 - DNA, 387 bp, Homo sapiens
tgagtgagatctagaggatcccttcatgtcgagacatggtgggtagaactatgtaagaaaaggccattcactaaggacgcaatgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttatgggtgggaatgcaaaaattctctgctaagactttttcaggtgaacataacagacttggccaagctagcatcttagcggaagctgatctccaatgctcttcagtagggcatgaaagccctcgata

SEQ ID NO: 705040 - DNA, 276 bp, Homo sapiens
agcctagaccactgatactgagatctacgggtcatgtagactgtgtatccaggagcagaaacttgtattctacaggatccaggatctacccagacaccaaagatgtataaacagagagaacagacctagaaatgggcctgtctggcatttcagagtcaggcaaagcaggcagggccaggaagcatctgtgggtctacacaagaaggtacctgtgagggctatcagtagtaagccttctagacaagctaggaaacttaggcgcctaccgccaaagcc

SEQ ID NO: 705041 - DNA, 119 bp, Homo sapiens
  misc_feature (7)..(7): n is a, c, g, or t
  misc_feature (15)..(15): n is a, c, g, or t
  misc_feature (34)..(34): n is a, c, g, or t
tacacancaggagtnggtctatgccagtcccctnatgcatatgaggcaggctgtgctcgaagccctgagctgggatgtctgagagtctgggacatccaggggctgcatcttcatcctca

SEQ ID NO: 705042 - DNA, 101 bp, Homo sapiens
cggatcacccatttcaccagcccattgtgcctagtggtccggctggtgtccacgcccgaggattggaagggggctctggaagggcaggtccatggtgccat

SEQ ID NO: 705043 - DNA, 278 bp, Homo sapiens
  misc_feature (20)..(20): n is a, c, g, or t
  misc_feature (31)..(31): n is a, c, g, or t
  misc_feature (128)..(128): n is a, c, g, or t
  misc_feature (227)..(227): n is a, c, g, or t
  misc_feature (235)..(235): n is a, c, g, or t
  misc_feature (266)..(266): n is a, c, g, or t
caattggccttcctctgatnacaaatatgtncccttacaacatatgtcatggatttgcatacaaagattcttgtcattccttaataaactgtggcacttggtatttgaatgtgtgtggaaataagggnagtcaagaggttaaatgctggacttattaatgggataggaataataaggaggctgaggctggagaattgcttggacccgggaggcggaggttgcagtgngccgaggncgtgccactgggctccagcctgggcatcagngcaagattctgt

SEQ ID NO: 705044 - DNA, 175 bp, Homo sapiens
tgggtcagtctagaggatccctaatgtgatactatcacacaatcaggatgactgtgttaaaaagtcaaaaataacagatgtgattaggttgtggagaaaagggaatgctgatgggaatggtatattagttcagcctctatgggaagcagtttggaggtttctcaaataacttaaa

SEQ ID NO: 705045 - DNA, 1893 bp, Homo sapiens
  misc_feature (412)..(412): n is a, c, g, or t
  misc_feature (1311)..(1311): n is a, c, g, or t
  misc_feature (1465)..(1465): n is a, c, g, or t
ggccgcgtccgcgacggcggcacgtgctctgcgaggttgtacggaccccgccgcacggacactagcgaatcgatggcggttgagctgttctgtgctgctgcaattcgcgctgctgggcccccacgggatcctccggcgcgactggcccgggcgatggatcttcattactccgacgaaaccatccttgggcgtcccgaggatacctgctctcagactgccgtcccttgcagttgagcatgcgccggcagtacggtcatcacgggctagcgcgccctgggccgttgcaccgcggggaggacgattgggttgccgttcaagcgatgcgaccggccgctcgtcgcacgggtcgcgaggtagatacctcgggatgttgtcccaagggtagcgcagcgttcccgaagcttatctcaanctggtggaggatgagggtatcgtacccttgtctgtgctgtccctacgcacacagtatggtccccgagttggcattcacccgcggcaccaaatcaatttcgcaacgttgctacccgcaagtgggacgccttacctcatagaggcatgtagaggaggtcctgtttcgaataagctcagagtcagggcagacccagcgaattgagaggcagacgcgcgaggcaatgacccggagttgcctactgaccttggtgcatctcgaacaagaaagcttgaggcaagattgccaccggacgtccaacgaatccccttggggttactaagctttggaagcttcggagaggaccccataggggggattagcctacaaccgacacttccgactcgtggggaaatcttcaattggcaagaggcaaccagaagaggacctgctttccaatttggaaacaactttggggttccctccgacaaccgaaaagcccttatgcggttgtccgtgtttcccgcctcgacagtggtattcccacgttccggcctacgggtgacctcgtgttctccaagaaggcctcaatatacaaattttggaatgcacaaccccattgaaagacctatttgtgtaagggcccccgtgaatacccctgagacacccaagttaaccacggaggttggccaaaaacgggagaaccacaaggtacttaaccacaagggggcctctcctgaaaccccaagaggtcaccatctccctttccagatggcttccgcgcgatttgcacgccagactcagcttattgagccgggcccctagctgtagggtcgcctattagctatggcgaggcaaaattcgatgggtcctatgataaggctgcattatggttgacgtttcggcctaacgcagttcagatnctgtgcacatcactacgcaaaggaaaggcgcccgaggaaaatgccccagaaaggaacggtgacccctgtggaaattaagtgaactgaaaaggaccgagaactatcttggcagccccctgttaaaaaggaagagggtcgacagacaccaatgaanattatcaaaatggcgagcaactgatccgccgaagagtgaacattatcctgtaggaccagaggtgacacctaaaggaaaggaccccatgagaccaatggtattagcaccgaccgacgggagatacagcacacacacagggatgaggaaagatcaacagcgttcacagctcatgaagaaaaatacgcacggagtggaaatgcacgatcgaatgacagtctattcttagaaaaagtgaggtgtctcacaacgagaaatgaagcagtgagattagtacgaagaagaaagcaccaaagttaagctgcgcagagaataattagtagatcgatggagacgacaatcagacagatatcgatagatcagtcggtgtgtctgttatttctccgcggtactcgtctctgtagaaagaaagaagaggaaggaggaaaaca

SEQ ID NO: 705046 - DNA, 1335 bp, Homo sapiens
tgcaaaacaccaaatggctggatgactgccggtgcatgcgtgtgggggccctgggggccctgtgtgtgccctgtggatggggaaccgcggtgggcttccgcggagtgtttcggcatgttgtgcatcctgtgggcctgttggtctgcaggccggtggactggggcctgtgtgtgccgattgcctgctggatgctctgctgtgatgtgcatatggccggaggactaacggatgtggattgcccgtcaccagagttgggccggttggtcaattgaccattgaagatcaatgtcccttggatggaggatctagtctcgttcttcccatggcctacttaagcgcgaaactcatgaataattcacttgacgtttcattacgcttggtggggcctcgtctcagattggactgagggtttctgacacgatctaattgcccatggttgcaatgagaggccatggaccccggttgccggtgtccaaggggccagccagtgtttcaaatgggccgatttctggttaggcctagtactggctgcggaactttatcaatatttgggcccaactcgtccgcgacatatgggaggatggttaaaatgtttgccttccccagatcggtgcacggggtagtggccagcccgtggacgtagttccacttgtttggtcgtagccgaagtcgacgtccacttgtggcgcaaaaggctttctacccaggttccggttcaccgccctgtttgttctgcccagtaaggtggcatttagcttgctgctgtgtgcaagcctcgacagcggcaggtccggcgctcgctaatgtcttcccgctcactactctttggttctcccgttttggcgtcgtgtgggtgtgagccacgggtgccggtctttggctgctgctatcctttggttgtgcttggggttatgcggctcctttcgaattcctccgttgatcagactgcctatgttggtgttccatcgtttgggtcgtcttccgggttcgttaccgggtcgcgcctttggtttggccgccattatatagtaaacgagggacgtttcagtctaccgagttagagcagttagtgccgtagggggtaagtcttcgggagtttcggaccctttgagctatagcaggcgcgcatttcaagggctccgcggggggtagccgttagtacacacggtgtgcctccaacccacatttggttggacagtaacgctttatctgcggccaagaagttggtcgcaggacgcttttagtcgtgagttgcgcacaattattccgttaaggtcgaccgcctaaacgcggggctataactctttgagccccaccgagaaagccatcttgtgg

SEQ ID NO: 705047 - DNA, 950 bp, Homo sapiens
ctcggacgacgcgagcgccgcgcttcgcttcagctgctaggctggcccaaggtgaggcgaccgcggagggatggctgaggggcgagcaggagccggagccccggggccgggccggatccggaccgccagggagggcagaccatttcagagatgtcttccagacgtaccaaagatttacttcagagagtacagtggggatcgaatgtcctagtaactccaaatccgaaactacattagaaaaattcacagggagaaattgcacacttacagacatcagtggctgaaactcacaagtggcgacaacggcaagctgactgataaccgagagacacagaccttttggacgtttatgtctagaacacttcgacgtccttgcaggctgagacggagacgacatgctatatcaagctcacagataacggaacaaaggaaatacagccgactgacgcagaccaacctgaccggccacgactactcgtacttaccgccattgcttgacaccacgctggcacgagacaacgagacgaacggacgcacacacggacgggagcaagagtgtcgaaaagcccttaatctgaaaggagacacagacggtattgaaacgcaacagattgtctgcttgcaaccgtcacgaacttgctgaaactttgaaaagccaaaccaacttacactcacggatctatatcacgagaaccttgtggctccccacactggcatttcaacgctcatttcacacattaccagtaagattagtttcccgctgcaaccatcggggacaccatacccacagcgctggacaacgaaattgcatcgctggggcaacaaaaccacacttccaggaccaacgtgggactccgaagggttcattggcatatcacggacgaagcccgcgcagcaacagatcactaacggataacacaggggcacctatttgaaggccacaaaagaat

SEQ ID NO: 705048 - DNA, 107 bp, Homo sapiens
ggcaacatcagtgaatataagcatctatggatggcaaatacagctcctattgataggacatagtggaagtgagctacaacgtactacgtgtcgtgtagtacgatgtc

SEQ ID NO: 705049 - DNA, 458 bp, Homo sapiens
gccaggaaggcagtgttgtaaggtgtcctcagccacataaagatgaaggtccgcacgtcacaggccttccggcggccgaagacactgagtcttcggagtcagctcgaatatcctgggaagagcgctcccgggagggtcaagcttgtcactagtgctatcatcaagtttgcgctgtccactgagtgtgccatgtagaagatagaagacggcagcacacttgtgttcagtgtggatgttaaagccacctggcaccagattaagcgggctgtgaagtacctgtatggcattcatgtggggaaggtcagcgccctgattgggcctgatggatagaagaaggtatatggtcgttgggctcctggttacgaggctttgggctgttgtcctcactcccccctcccccctcctcaatgtagtggccttggatatcctgtttgttaataaagacaattctcccagca

SEQ ID NO: 705050 - DNA, 1104 bp, Homo sapiens
  misc_feature (330)..(330): n is a, c, g, or t
  misc_feature (854)..(854): n is a, c, g, or t
  misc_feature (875)..(875): n is a, c, g, or t
  misc_feature (896)..(896): n is a, c, g, or t
  misc_feature (948)..(948): n is a, c, g, or t
gagcattgataggcttcggtctgagcacgtccgcaagttcctcctgaccttcagggagcctgacttagagaagaagtactccaagcaggtagacgaccgatttggtgcctatgtggcgtgtgcctcgctcgtcttcctcttcatctgctttgtccagatcaccatcgtgccccactccatattcatgctcagcttctacctgacctgttccctgctgctgaccttggtggtgtttgtgtctgtgatctactcctgcgtaaagctcttcccctccccactgcagaccctctccaggaagatcgtgcggtccaagatgaacagcaccctggnggggtgttcaccatcaccctggtgttcctggcggcttttgtcaacatgttcacgtgcaactccagggacctgctgggctgcttggcacaggagcacaacatcagcgcgagccaggtcaacgcgtgtcacgtggcggagtcggccgtcaactacagcctgggcgatgagcagggcttctgtggcagcccctggcccaactgcaacttccccgagtacttcacctacagcgtgctgctcagcctgctggcctgctccgtgttcctgcagatcagctgcatcgggaagctggtgctcatgctggccatcgagctcatctacgtgctcatcgtggaggtgccaggtgtcacgctcttcgacaacgccgacctgctggtcaccgccaacgccatagacttcttcaacaacgggacctcccagtgccctgagcatgcaaccaaggtggcattgaaggtggtgacgcccatcatcatctcagtctttgtgctggccctgtacctgcacgcccagcaggtggagtccactgnccgcctcgacttcctctgganactgcaggccacagaggaganagaggagatggaggagctgcaggcctacaaccggcggctgctgcacaacatnctgcccaaggacgtggccgctcacttactggcccgcgaggcgcacatgatgagctctactatcagtcctgtgagtgtgtggcggtcatgttcgcctccatcgccaccttctccgagttctacgttgagctagaggcaacaacgagggtatcgagtg

SEQ ID NO: 705051 - DNA, 412 bp, Homo sapiens
  misc_feature (270)..(270): n is a, c, g, or t
  misc_feature (287)..(287): n is a, c, g, or t
  misc_feature (298)..(298): n is a, c, g, or t
  misc_feature (363)..(363): n is a, c, g, or t
aaaaaaaaaggagaacaggacaaaagggggaaaaaccaaagaaaagaaaggcaacacaaaaaacgggaggccagagaggaaaaagaggccgaaggacgagggaaggagagaaaacacccagaaaagaaacgaggaaacaccccccaccccctccctgaccccacgagacttcgaaaaaccccgtcccggtaaactccccaatctgaaagtcacgacggacggaccacctgaccgaagactgcccccaaactcctcccacaaccagcgagncaggggcccgctccctncgaagatcggnacaccccgcgtcggggcgcgagactgagggtggggtgggtgacggaacccgggaccggaaggggncagcgggacagactgtggagggcgggaaggcggggcccgggacgctgga

SEQ ID NO: 705052 - DNA, 867 bp, Homo sapiens
  misc_feature (330)..(330): n is a, c, g, or t
gagcattgataggcttcggtctgagcacgtccgcaagttcctcctgaccttcagggagcctgacttagagaagaagtactccaagcaggtagacgaccgatttggtgcctatgtggcgtgtgcctcgctcgtcttcctcttcatctgctttgtccagatcaccatcgtgccccactccatattcatgctcagcttctacctgacctgttccctgctgctgaccttggtggtgtttgtgtctgtgatctactcctgcgtaaagctcttcccctccccactgcagaccctctccaggaagatcgtgcggtccaagatgaacagcaccctggnggggtgttcaccatcaccctggtgttcctggcggcttttgtcaacatgttcacgtgcaactccagggacctgctgggctgcttggcacaggagcacaacatcagcgcgagccaggtcaacgcgtgtcacgtggcggagtcggccgtcaactacagcctgggcgatgagcagggcttctgtggcagcccctggcccaactgcaacttccccgagtacttcacctacagcgtgctgctcagcctgctggcctgctccgtgttcctgcagatcagctgcatcgggaagctggtgctcatgctggccatcgagctcatctacgtgctcatcgtggaggtgccaggtgtcacgctcttcgacaacgccgacctgctggtcaccgccaacgccatagacttcttcaacaacgggacctcccagtggtgagttgatgctcctcggatagggtcgctccctgccctcagcacagagcagacagggagggcagctggtgcccaggtgggaggggccttggtggcgaggtgggaggagaggaagtgt

SEQ ID NO: 705053 - DNA, 747 bp, Homo sapiens
gcagacctccgtggcacccaggttgcctctgtagtgaacttctttgtaacctaccaggccagttgtatatacagtgtgtcaggtttatccgggtttcagttgtgaggcagtttattcaaagtgagacagaagtgccacggaaaagaggcaggagtgtgttaggtggtgggtccattaagactctgctgtgacattgacatattcagctctgcagagcactggacttcctttacaaactctaccgagatgctggattacgacacaatgaggagaagctcatcgggccatcagacagatgctcctagagggtcctgatgtttttgtacgctccaggtcaggtggatcgctggttttcccagttccctttgctcatgcttacttagaggaagaacagacaaggggggtacctctttccaagtaccttctaagatgaaacactcaagggagagtgctactcacggcaaactttgcttggatcctaaacatggactggtcttggggtgtgtaactcccggtgaacgttcatagacatccgccaacagttcgagcgtgaccagacacggaagtacacagaaggtgtaaagactggcacaagcggcacagggaagcaaatgcacacgcggctacagagactacaagtctcggggacaacaccgagtacgcacagaacgactggcggaacatggacctctgagagactgcctcgaaccatcagccactggaacatagggccacacagagcaaact

SEQ ID NO: 705054 - DNA, 145 bp, Homo sapiens
gggtcgatcgagctcggtaccggctcgtagtgtggccgtcgaggggcaccttgcgtggctcgtggtgggcggcttgctcctgctgggccttgcctcgaacctgagcaatctcagcattggccctgtccagtttctcctccacgtg

SEQ ID NO: 705055 - DNA, 977 bp, Homo sapiens
  misc_feature (330)..(330): n is a, c, g, or t
gagcattgataggcttcggtctgagcacgtccgcaagttcctcctgaccttcagggagcctgacttagagaagaagtactccaagcaggtagacgaccgatttggtgcctatgtggcgtgtgcctcgctcgtcttcctcttcatctgctttgtccagatcaccatcgtgccccactccatattcatgctcagcttctacctgacctgttccctgctgctgaccttggtggtgtttgtgtctgtgatctactcctgcgtaaagctcttcccctccccactgcagaccctctccaggaagatcgtgcggtccaagatgaacagcaccctggnggggtgttcaccatcaccctggtgttcctggcggcttttgtcaacatgttcacgtgcaactccagggacctgctgggctgcttggcacaggagcacaacatcagcgcgagccaggtcaacgcgtgtcacgtggcggagtcggccgtcaactacagcctgggcgatgagcagggcttctgtggcagcccctggcccaactgcaacttccccgagtacttcacctacagcgtgctgctcagcctgctggcctgctccgtgttcctgcagatcagctgcatcgggaagctggtgctcatgctggccatcgagctcatctacgtgctcatcgtggaggtgccaggtgtcacgctcttcgacaacgccgacctgctggtcaccgccaacgccatagacttcttcaacaacgggacctcccagtgccctgagcatgcaaccaaggtggcattgaaggtggtgacgcccatcatcatctcagtctttgtgctgtgcaggtgcagtgctagctcttcgttccctctaaagggtgtgcactctttttattcctactcttgcaaaaacagatacgattatgatttcccatggaaattgaaaagtctatttaaataatttaactattaaacactttcactggtaaaaaaaaaagtcga

SEQ ID NO: 705056 - DNA, 269 bp, Homo sapiens
  misc_feature (171)..(171): n is a, c, g, or t
  misc_feature (244)..(244): n is a, c, g, or t
tacagatctaatcagtgcatgtggggatgtgatgtaggctgggcagaacctacaacgcgaggtgctcaaggtctggggaacccaagagtgatgagatgaatgttaaggttgttggatttgtgagcattttctgcccatgctgcagacagtggccaagaacaaggaccaggncacctatgatggattatgtcgaatggactctcgggtgtcttgacaacggaaggaaatcggcaccgtccatggngtgctagaaataccggcatgttctt

SEQ ID NO: 705057 - DNA, 99 bp, Homo sapiens
ttcgtaacagcgccatcgagcgggtcatgctgctgtgaggtgcagttgcagcaagcagatcactgcagatagcaatacaaaggcattataagactgcgt

SEQ ID NO: 705058 - DNA, 213 bp, Homo sapiens
ttccccccccccccaggggggggttttaagggcccttttaaaaagaggggggggtttccaaaaacctttccttccccccccctgttgggggggccccccccccaccccagccccttttttggggtttgggggggggggttccccccccccccctggggcttttttttttttagggtttttccgggggcccaaaaaccgccccccgttttttta

SEQ ID NO: 705059 - DNA, 445 bp, Homo sapiens
  misc_feature (195)..(195): n is a, c, g, or t
  misc_feature (216)..(216): n is a, c, g, or t
  misc_feature (237)..(237): n is a, c, g, or t
  misc_feature (289)..(289): n is a, c, g, or t
cagggccagcagtggctggggtcgggtcctcagagcccgttgttaggagccacggcggtcctcaggcctgtccaccacctgccccacagcccctgagcatgcaaccaaggtggcattgaaggtggtgacgcccatcatcatctcagtctttgtgctggccctgtacctgcacgcccagcaggtggagtccactgnccgcctcgacttcctctgganactgcaggccacagaggaganagaggagatggaggagctgcaggcctacaaccggcggctgctgcacaacatnctgcccaaggacgtggccgctcacttactggcccgcgaggcgcacatgatgagctctactatcagtcctgtgagtgtgtggcggtcatgttcgcctccatcgccaccttctccgagttctacgttgagctagaggcaacaacgagggtatcgagtg

SEQ ID NO: 705060 - DNA, 213 bp, Homo sapiens
ggaggcctcgctggacatcaggcgcatggaaggtcagctggatggccacttcggcagggtcggagccctggccgccatactcgaactggaatccatcggtcatgctctcgccgataccagacatgcctcttgtccttgcgggttcttgctagatgtaccatgttcttctggcgccacagctgccgctagagtggggtacacgctgcgtctcac

SEQ ID NO: 705061 - DNA, 1390 bp, Homo sapiens
  misc_feature (60)..(60): n is a, c, g, or t
  misc_feature (662)..(662): n is a, c, g, or t
tgtgtgtgtgttcatgctgtggaactggtctcacacaggatgtgtttccctcatttcagntttggcagttttgggttttccaaggtaccaccagagcagtgggtgtgtgcttttggggtaccatatgctcagattaagtaggaggatgcatggacacactgccccatcttttctgacacacgcacacgtatgtacacacatgcacacaccctccttcccctaagcaaaacgcagatggaataagaaaacaaaaagctgctttcccatcccaggccgagctggaaccaagggaagcaatctcatcctgcgacaggcagtgtggtgccctccacaccctgagatttcagacgtttgcggcttacagaggcagcgcccacagattccagagtgcttacagaaggccaggtgctttgcaggctgggacgaggaagccaagcctccctggcctactcagttggccaaggtgcaggtggctcttcctggagatgttcactcagactgggggatgcaatgtgcagccttcaggtttgcggaaagggagtggccttgacctccaccggcaaaccaggcagaggaatgggtagagcccagctttagagtccacagggaaagctagcaggaattttgttttagtgggagggggcagttaaacataccaaganaaaaatactatttttataacctatgaggaagacatttggaaaatgatactctagcacagaattcagtggaatccttagggcccatgcccaaatctttccattgcttctcaggttagaatgatcttcacctccaacatgagcttggaggtgatgaggcagtggctctgtgccagctgccacaatgtgactttgatgtccacctgtaccacctctcactgggctctagcaccaccctcccctccccgcacaccaactgaacacagctctgagaagcaaagtgtgtggacccaaaactgccaagcctgagtctgtcccgtgcttctgctgctccatcctttgagttctgcattgccatcctgacgtcggccacaggaggcctgctttcttccagctgttgttctcaagttccctgcccctccacatcgcccgccagtggtgttgggttttcgttctgcttccaacctgagtaaagtgtgtgtgctgagttcatcccatgttctcccatggtcatggcttcccggccccatggggacccctctcccatcccagcagtgactggtgacagtgtgcaggtgcagtgctagctcttcgttccctctaaagggtgtgcactctttttattcctactcttgcaaaaacagatacgattatgatttcccatggaaattgaaaagtctatttaaataatttaactattaaacactttcactggtaaaaaaaaaagtcga

SEQ ID NO: 705062 - DNA, 264 bp, Homo sapiens
cgacataatagcagcaaggaaaatcaggagaaacacaagacggcagagggacgcagaacgaacaaggaccacacataaatcaatcaccgaggggccgaagaagagaggacagcagataagaacacaagcagggccgaccgccacgcacaacagcctaaaaaggtagacaagaaaaggaagtaagaggccaaacaagaaccccaaacagagcaagaagtaaaagaacagggagacaaagaacacaaaaagatatacaactaaaag

SEQ ID NO: 705063 - DNA, 544 bp, Homo sapiens
tgtgtgtgtgttcatgctgtggaactggtctcacacaggatgtgtttccctcccctccccgcacaccaactgaacacagctctgagaagcaaagtgtgtggacccaaaactgccaagcctgagtctgtcccgtgcttctgctgctccatcctttgagttctgcattgccatcctgacgtcggccacaggaggcctgctttcttccagctgttgttctcaagttccctgcccctccacatcgcccgccagtggtgttgggttttcgttctgcttccaacctgagtaaagtgtgtgtgctgagttcatcccatgttctcccatggtcatggcttcccggccccatggggacccctctcccatcccagcagtgactggtgacagtgtgcaggtgcagtgctagctcttcgttccctctaaagggtgtgcactctttttattcctactcttgcaaaaacagatacgattatgatttcccatggaaattgaaaagtctatttaaataatttaactattaaacactttcactggtaaaaaaaaaagtcga

SEQ ID NO: 705064 - DNA, 1167 bp, Homo sapiens
  misc_feature (60)..(60): n is a, c, g, or t
  misc_feature (662)..(662): n is a, c, g, or t
tgtgtgtgtgttcatgctgtggaactggtctcacacaggatgtgtttccctcatttcagntttggcagttttgggttttccaaggtaccaccagagcagtgggtgtgtgcttttggggtaccatatgctcagattaagtaggaggatgcatggacacactgccccatcttttctgacacacgcacacgtatgtacacacatgcacacaccctccttcccctaagcaaaacgcagatggaataagaaaacaaaaagctgctttcccatcccaggccgagctggaaccaagggaagcaatctcatcctgcgacaggcagtgtggtgccctccacaccctgagatttcagacgtttgcggcttacagaggcagcgcccacagattccagagtgcttacagaaggccaggtgctttgcaggctgggacgaggaagccaagcctccctggcctactcagttggccaaggtgcaggtggctcttcctggagatgttcactcagactgggggatgcaatgtgcagccttcaggtttgcggaaagggagtggccttgacctccaccggcaaaccaggcagaggaatgggtagagcccagctttagagtccacagggaaagctagcaggaattttgttttagtgggagggggcagttaaacataccaaganaaaaatactatttttataacctatgaggaagacatttggaaaatgatactctagcacagaattcagtggaatcctaagcctgagtctgtcccgtgcttctgctgctccatcctttgagttctgcattgccatcctgacgtcggccacaggaggcctgctttcttccagctgttgttctcaagttccctgcccctccacatcgcccgccagtggtgttgggttttcgttctgcttccaacctgagtaaagtgtgtgtgctgagttcatcccatgttctcccatggtcatggcttcccggccccatggggacccctctcccatcccagcagtgactggtgacagtgtgcaggtgcagtgctagctcttcgttccctctaaagggtgtgcactctttttattcctactcttgcaaaaacagatacgattatgatttcccatggaaattgaaaagtctatttaaataatttaactattaaacactttcactggtaaaaaaaaaagtcga

SEQ ID NO: 705065 - DNA, 111 bp, Homo sapiens
tggccccgtccatgtacactgcttttgctgccgcatttgcgactgctgaactgtggaatggctgttggtccgtggcatgaggaggcgtgctcatagttcccgggttgttgt

SEQ ID NO: 705066 - DNA, 380 bp, Homo sapiens
  misc_feature (1)..(1): n is a, c, g, or t
nctttaacaggaaacagaggaggtgtggcaccgagtttccacattgttatttacctcaccgccactatttgggattggccttccttgttgaagcaaagcctcttgcaactcatatcttgtaggccacaacacccccaggtctggagtgccagctgtctttgtctgaacgagccctatagcccacctccaataatggacgtgtgggacaggcactcaggctggaacgctctcttctctcttcttgtcaaggggtcaatgaccgcgggcacaaagaaccctctctctacattgtcgttcacaccttgggacttatctagaatagcacacaatagtagcaataatacatgtctcatggttataagtgtgtggaatctccctgg

SEQ ID NO: 705067 - DNA, 928 bp, Homo sapiens
aggatcgcgacgggaactggagcccgaggtccccgcgcggcccgggcctggcgccctgaggggaagagcggcccggcccgagggtgctggggtggagagttttactccaatacctttcctagccatgacggacgggatcctagggaaggcagccacaatggagatccctatccacgggaacggcgaagccaggcagcttcctgaagatgatgggctggcagcaggacctccagcaggtgatggtgtcaggacccaacctcaatgaaaccagcattgtgtctggtggctatgggcggctctggctgatgcgactcatccccacagggctctggccgccatccatctcacagcaccactccttctggccctggagatgcacgtggctcggcggccattcgctggagcaaaagtcacgacatcgtcaacgaacactggcggcatcaacacctactaagtgcacaaagcaactgtcactcagcaacgactctcgcgccgacggctcccggcactgtggacctggcagctagcagctgccagcacttgagcttgcctgcgctgagcacgaagcgccacgtatgacggagtgtcctgcagcctggcgccggcgcactgacagcccacctctacagactgctgccagacccagcatgcactgggtgactgcctttgctgacctcagccagaagtccacagagcttcaggaggaattggctacaatgcagagaccccgaaactactatgccagaatgggcgaaacgccgccaggacccgcgcactcccccgcctctcaccatcacacactggacacccagaccacgcgagacacctcctgactgtcaaacggctgcacgcgccggcggacacgagcctccggacaaacaagaggacgcgatctggccccggggcggacagagccgccgcggggccg

SEQ ID NO: 705068 - DNA, 89 bp, Homo sapiens
gatggtactccgtttatttttttctactctatttcaggcgcactcttgataaatggttacctcagaataaaggtgactatgatatattg

SEQ ID NO: 705069 - DNA, 565 bp, Homo sapiens
cgaatgccaatccaaggttcccaaatcagcccgcacatccacaagcacataaacaagcacataaactttgggcggtgtgatgtttgtaacagaagcgactatgatctattatagtgtttcgcgttctgtttacgcgaattccctaacgctaatgaaatgagtagttgttaaaggtcacttgcgatgccgtttcgttttttaacgctgaatcgttggatgacgcgcgatctaggtacccttttctaagataaccgattcctgtcgagctatacgagcttacacttctctacgccttgtcccttgacgcccgggcgtttggtttcgctaataaagaatgagccttaggagcggtaggagaggtaccagtgctcgagctacgactaagccaacggactaactatatgcgaaggggttaaggacgcgcgataagctatacctcttgggagtacctttcccggccctccgttcgtaaagtacgaatctttctagactcggaaatagggagtaggtgcggtggcggccgtaggcccgcctcgcaaggactttttttacgctttaggcgagg

SEQ ID NO: 705070 - DNA, 1650 bp, Homo sapiens
gagcggggggaccgcggggagctctagctgcggcatgtctgcgtctctactgctctgggaggaggaagagaaggaggaagaggaggaggaggaggagggggaggaagaggagacaggcgcaggggatgggaagctgtatgccgaaagctgacacagcaagaaagttctccccacatcattaccgcttacacatactctcaaggtacacaatagaaagcgtaaggatactgacgacaggagctgcaagacagagtgaccagaagcagaagtagagaacaacagatcccaggggaataggaggagagggaactcagacagcatatggaagaagtacaaagagaaatgtgtatacatgagagagagaatggagcgaataagagataaacgtgattaaaattgggaaggtacaatcagagatgaagaattcagaatgaattaaggtgcgatatagaagagagtagaactggaagaacataataaaaataggggtaatgagaacagtcaaaacaaatgaaatataaatatatgaaaaaaaatcgtaacacagcgaaataaaccattaacacatgtgtaaaagatacatatcaagataatataaatacaccaataaaagacataaatccgcgaggagaatcaataaaattatacaaaggatgaaaacacattcaatggactaggtatgcttggcacagtagtaaaatacacaagaaacacacaagaaagtacaaaccatggagaagaagacacagcaaaagagacatcacagggagagaaccaacaaaaaggacaaaaatcacaataaaactgaaagccatagcagaacacatcagagaaccagagaaaacccataaggaagacaatcatccaaagagacagcacgaaaaagataacacgaaatacaacagccaacaaggaaaaccaagtaacgaacacggaaaaagaacaacactatgcgcaaaagaggacaaagcaacgccaagacacaaacagatgagaacgagcgaaaaagatacacaaaaagagcacaagagaagaaccagacgaaaccaaaaagaagaaacgaaaacacgacggcagcgacaccatgagcaaacgagcacaacgaacagacacacgagaccaaggtaggaaggagcaaaaccagagcgtcaacaagaagcgactacagacaagacagaaaagagaacagccctagaccaaccgacacagagagcaaggaagagaaacacagaaaagtggcaacgtacggaaaaggcctacaacgataccaggcacacacagagaagtagaaaaaaccgagacaggaaccgaaagagcagctgaggagagcgagaagaccaagcaggagacgggacgcatgaggaacaagacagggaagaagacaaagaaagaaccacaggagcaagagagcagaaggagagacaagaaagcaagggagacagagacgagagagagaagaagagaaaggccacgagacagaacagaacagacgacgaaacgcgacaggaggagaaaggggaagaagagaagacacgggaacacaggacgagagaaacaagaggaacgaagaagaaggaaggaagcaagggagaagagaacgcagagggagacagggaagagacagggcagaggacggaggagcacaccgaa

SEQ ID NO: 705071 - DNA, 821 bp, Homo sapiens
  misc_feature (755)..(755): n is a, c, g, or t
  misc_feature (771)..(771): n is a, c, g, or t
  misc_feature (807)..(807): n is a, c, g, or t
gtgaaatgaatgacagcaatattataagtcatccggttccaagatggccgaataggaacagctccagtttacagctcccagtgtgagtgacgcagaagacagttgatttctgcatttccaactgacgtaccaggttcatctcactggggcttgttggacagtgggtgcagcccatggagtgtaagccgaagcaggacgaggcatcacctcacctgggaagtgcaagaggtcagggaattccctttcctagccaagggaagcgtgacagatggtacctggaaaattgggacactcccaccctaatactgtgcttttccaactgtcttagcaaacggcacaccaggagattatatcccgcgcctggcttggagggtcccacatccacggagccttgctcactgctagcacagtagtctgagatcaaactgcaaggcagcagtgaggctgggggaggggcatccaccattgctgaggcttgagtaggtaaacaaagcggctgggaagctcgaactgggtggagcccaccacagctcaaggaggcctgcctgcttccgtagactccacctctaggggcagggcatagcagaacaaaaggcaacagaaacttctgcagacttaaacatccctgacagctttgaagagagtagtggttctcccagtacagagtttcagatcttgagaacagacaggcttgcctcttttaaatgggtcccttgacccccaagtagcctaactggagaagacacctccaatangggctgactgatcctnatacagcttgggtgcccctttgaaacaaactttcanaggaaggatcaggc

SEQ ID NO: 705072 - DNA, 117 bp, Homo sapiens
atcacttctgtagtattatccataacaattttgttgtgtgtgtttgagacaaggcctctgtcacccagactgtagtgcagtagtaccatcatgtcttactgcagcctctgactctca

SEQ ID NO: 705073 - DNA, 759 bp, Homo sapiens
  misc_feature (154)..(154): n is a, c, g, or t
  misc_feature (470)..(470): n is a, c, g, or t
gaggacagccgttattccccttctttttctctgcagctcggcttataccaggggtgtgttctcgcgacatgcacacaggagtgaggttgctcatcggttacatgattgaggagatgacacttgcaaagccttggtgatgattgcctctgctcantatcttcaccagtgttcatttgatgatcatgccaaattcctgaatgaagcatctgaattctgaacatcatgtcgttgctgatgagtcagctgataatggagacagatcactgcgtacccttttgggcgacaaatgatgcactgctgcaactcttcgtgaatcctatggtgaagtggccgactgctgtgcaaatcatgatcctgagagatatgactgcttgttgcatcacaaagatgacaacccaatcctccccttattgatgagaccagaggttgatgtgatgggcactgcttctcatgacgatgaggagacattntcgaaatactacttatatgaagctgccagacgacatccttactattatgccccagaactccttttctctgctaagaggtatacagctgcttttacagaatgttgccaagctgctgatgaagctgcctgcctgttgacaaagcttgatgatcttccggatgagaggaatgcttcctctgccaaactatactcaagtgcgccagtctccaaacatttggaggagctttcacagcgtgggcaggagctctgctgaaccagatatttaccattgcttattttgcagatttcct

SEQ ID NO: 705074 - DNA, 651 bp, Homo sapiens
ggagcgcccccgacccccgtcccgtggcgcccgcccgccgcctgaccatgcccttcatccaacagccacaacgcactgaagctgcgcattcccgagccgaggacaagttccaccgaccttgagcgcccacaacaaccacaatggccaaggttgctgaccccgcgaagctgtacgtcggacgctgcgcgccatagactcacgccgagcggcattcacgcatggacgactgctcattccagacctaggcgttggacaaccctgggccacccgtacactcactgaccgtggagctgcgctggccgggggacgtaggagctcctatcgaaagtgttcaacggcatctctatcgtaccaccatcatcgaggacccgcgcaccggtacgggctacgacgccccagcgactgagcacaacgcaccgacgctcaaccccgacagaccttgccaggctcgcgagacgacctggaccccaagctacgtgctgaagctcgccgggtgcgcaacggggccgcagcatccgtgcgcttctgactacccccgcactgaggcccggggaggcgccgcgccatcgagaagctcgcggtggaatgcccttgtccaggcctgacggcgacctggcgggccgatactacggcggctcaagagcatttacg

SEQ ID NO: 705075 - DNA, 835 bp, Homo sapiens
ctttctctcaccttacctggtgataagttccaaatatgttaagggctattaatacaaaaagcaaagaatgtcagtgtaggatgaaaaaagccttagggcaggaaagaatctcttgagacataaagtagtaatcataaaggacaagatggtgaagtcaattctgttaaaactcaaggcttatattaagcaaacacttgaagtgagaagatgatccacaacttgagaagacattctataaatacaacataactgatgaaggattcataaatcacaaaatatagagaactcctattgagcaaactagaacacatcgtgaagacaaccacaagaggaaatagggctttgaaactaactagatgttctgtaagcattggtcagggaaatatgaagtaaggaccacaatgagatcccattttataatccataagattgcaaaggttgggtctgacagtaaccagtggtgagatctgtagggacttgtaacaaccatttgtggatgtgtaaacaggcagcaatgtttaaaaacacaatttatcccttacagaacttgaaacatttgcagaccgtaaatgatcttgtatcaatcccaacctgtatgtcagcaaactctaggcatgtggccactaggaaggcactgtgtacgaactgtcatagttaaacatattacataatagatcaatagcgtgacaaaagtgaaaggatgtctggtgtacagagaacaatgtggataatagataattaatacaaacaagggacaaatacaagaggaaatgactgaacaaggaaaaacacaagaacaaagaaatagaaacaaacgaaaaaagataaagacagg

SEQ ID NO: 705076 - DNA, 1299 bp, Homo sapiens
gtgtgggtgctgtcgtgtattgtgatacgcggccgcgcgtcgggaggaagggcgggagcgcagaatcagagaggacagcgagagaagaaagatcgctggtggtctgcttctggtatgacttctctttggctgtggcgtgtgttcagtcgcgccagtgcttgtttgtatcactgctctgccgtcagggatgcttgcttgtgcgctgcgtccatgcgattatttctcccgcggtggtgtgtgtgtgcacaaattgttcgcgcgcggcgcgctcgcgcttcttgtgggtggtctctcctctccgcgaagtgtgtgtgggttcgcaaggattggtcgtgtcgggacgcgtgttctccccccctcggtgttttttggcggggccctttcttcctggggttgcggggcgtatattgtctgctccccgtggccgcgcgttggagtccactcttgtaggaggggtcttcgtcccggcaaggggcgccgctgcgtgctgttttctcgcttggacgcgctctctttttcttggggtccgcccgcggtggttcctataaaggcccctgctgttttgacgacgtgagttccggactgtggtgtggctgtctgccccccggtgggtgcattcgccctgtggtggagatgagcgtcgccccttgttggcgtctccacgtaggaccaacgccgtgagagggtggggtcccccaagagcaaatgaggtcacgcgcgcccttgggctttggaggcacacccgggaaggaaattgtttatatagactctgataattgtgctgggggatagtagtcgcccccttcaatgagagcaattgtgggccgctcaagcttcttttgagagaacactcgctctggaaatgtgtgaggcactctattgtaggttcgagaagacattttaccagactatccctcggtagagcacccgcgggcacacagcagggacacacaaaatttctctttcatagagcgaacacactgggggctagagtactagtcaccacacatagacgcgaccacacgattatgtcaggaaatgtcagcgtttatacgccacccgcgaatagggggtcattattgctggggagcaggtcaccacacacatagtcgtgagagagagatttgtgacatcagagtctccaccccctatttaatattgattcgtaaaatcaatcttcccctccatctgattcacatgcttcgttactccaccccctctatttcatgtaataagccctttattattatccatagaacaccttgccataaaccttcgaaacaaacaatgaacaaaaaa

SEQ ID NO: 705077 - DNA, 1082 bp, Homo sapiens
  misc_feature (570)..(570): n is a, c, g, or t
ttacataatatattatactagcatttaccatctcactctgctaggaactactaggtatatcgctcacacctcatatcctccctactatgcctagagaggaagtaatactatcgctgttcatgatagactactctcataaaccctcgaacagcccagtccctcttagcgcaatattgtgcctattgccatactagtcttgtgcctgctgcgaagcgagacgagtgggcctagccctatctatgtctcaatctccaacacgatatggcctagacatacgatatcataaacctaatatctactccgaatgctaaaagctaatcgtcccaaagcaagagttatattactaccaatctggacatgactttccaaatacaatcacataggtttgaatcaacgacaagcacccacatgtctaatatattagcatcgatccctctagctactttttgtaactcaagattcaacaaacaaacctgagtttagactggtttcccacagaacgctttttccactccggaagcacccttgaaacagaacaccgctttgcgctatagttacatatatcgtaancgtgaacttacctgagccccgtcatcgagatacactagagaaagagcacaaacagcctactttatccgatgtggaaccaaagcttatcggcgcaaagacatgagacatcctataccgtcctcttatgacattaaagtcctccacgtaacgaaaattcttcccttggcgattcactaaacagttaccatcatgtggcatcggagaacttggtatccataattaggcaatagtcggtgtcttgtcggaataccaaggggtgtaattcccccacccgtgggggatatctcattcgaccccgtagtggaaggctgaaaccagcccaagaaagcggccatggaaatggcacggcctcaatagcaatagcgataattgcctagacagcccttaagtaagggcttcgccttatcaccactaagttcattcgggaggtagttaatcacttcgagaaaagaccctaaggggccacaattaacagcattcctagttactacaggtctgcactggccaaggaa

SEQ ID NO: 705078 - DNA, 157 bp, Homo sapiens
ctctagaggtcccgaatgagtcactctgaagataaacctgaagaatgttactgggagctgctattttatattatgactgctttttcagagattttgtttatggatctgatcaatctagatctctaatatttttaagcccaagcccctttgcgagtcg

SEQ ID NO: 705079 - DNA, 127 bp, Homo sapiens
  misc_feature (11)..(11): n is a, c, g, or t
ttcgtcgacanaacaacgagctagtgtcagcacccgcttctcaaccatggtgcactctacgtcgtcgtcgactcagggaccacgtccttctatgagaggccttgagtgtgcgaagtactctccgtct

SEQ ID NO: 705080 - DNA, 329 bp, Homo sapiens
  misc_feature (41)..(41): n is a, c, g, or t
tttgcatttaagaaaacaattttgaatttatataggagaancatctccttaaaagtgcccataaccaattaacaccaaattcttagagccaatcattgattcttcttgtctgaaaagttttaggaactccttaacacctacctttgaacacatccacactcaatatttactgaatgaatgatcgaaatgaacgagcaaatgaataattagaatgaataatggtttaaaatccctagcaggcctttccatatctgaacttctttgctttctattataatttaataataagccttttggaaattaactcaaatatataccacttgaactac

SEQ ID NO: 705081 - DNA, 362 bp, Homo sapiens
actctaataggtgcgccccgcacatcagaacgagtaagattgaagccacctgtcccgaagggtatgcgctgtgcgcccccaacgtaatggatagatgtgtctcaaatgctgttcagtagagcctaattcaaaaagtaagctcggacggtttcttgggacacgccccatcagtagggcaccaccaatgtgggttcgtgtgatcgcacaagccaaagtcaggaattcgcgcgcgtattcacaacagcctcctgctcttaaccacacggtctggtgcgaaagcccactcctctggtacacctcccatagttctctaaaggtcgcctcaagagtccgcctaaggtgatcctcccctaaaacattcc

SEQ ID NO: 705082 - DNA, 303 bp, Homo sapiens
  misc_feature (184)..(184): n is a, c, g, or t
  misc_feature (195)..(195): n is a, c, g, or t
  misc_feature (199)..(199): n is a, c, g, or t
  misc_feature (219)..(219): n is a, c, g, or t
atacatggggattttgaatagttttttggttatataatactggaacatctctcaatattatggaaaatggttaaaattgtgtttgctgtttatgtctaacattaatttgtctagattatcatcttaatgacaaagggataatgaactagaaccagcaagtgaagtgtttatttcctattttctnaaacagttgtntttntacctatttccttaaaagcnctggtttagaaaaagccataacttaaatagtgttataaaatatatatcaggtttaaacataaatttagcgaatatggtagaagg

SEQ ID NO: 705083 - DNA, 467 bp, Homo sapiens
ggttcgaccagtttcctgataaatgtgtactttctacattgatcacaacctggggtagctgctcagaatgcttcgattcctctcacttaccctgagctctatgtgtgatactatgtgttctacctcttactaatttaggatttttgcaatttttttaaaacaagacaaatataggatagcatccaacagtatatgaacagtaattttacaaggcacatatctcatattctaacgatgcaagactagccatgaattcacttgagtggctcaatttatagaacactctatctctagttctttcttctccttcaactttgaaactcacaagtgatactggagaaacttcctgatcaccagggctctcgtcacactacactgtttctcaagcaattggcttattggagagtccagtgcagtccatgcatagcgtgagcgatataagtctgtgttaacacctatttgcttac

SEQ ID NO: 705084 - DNA, 382 bp, Homo sapiens
cttcaaggggcctaaggccgtttgcctggttttaaaaatcgttgccgccatggttggccagtctaagggaattaagaagttgttgcaggccgagaagcggccagccgaaaaggtgtccgaggcccgaaaaagaaggaaccggaggctgaagcaggccaaggaagaagctaaggctgaaattgaccagaaccgcctgcaaagggagaaggaattcagggccagggaagctgcggaattggaatcccggggaagttgcagcactgaaggggaaaaggggacccaggagaggaggaccatcttccagacatacttccggcagaccagggatgaagccttggcaacctctgggttttggcctgtgacattcggccagaaatccatg

SEQ ID NO: 705085 - DNA, 269 bp, Homo sapiens
  misc_feature (154)..(154): n is a, c, g, or t
  misc_feature (212)..(212): n is a, c, g, or t
tatagatagtatactttaatttataaaaaaaattcaaatttggttctttatttggtgtgtgcctgtgatgtttttctagagtgaattatagtatggacgtgaatcccactgtggtatagattccataatatgcttgaatattatgatatagccnatttaagtaacattgtgatttcattctggtttaagtgaatttgggaaatatggcactngaaggaaatgtaaaacatttagaactagctcggtgttatgggaaaacaaagtgcact

SEQ ID NO: 705086 - DNA, 292 bp, Homo sapiens
cgggctgtaggaatttggaccaagcgcactccagctcgcgttactgaggaagttctcagaccacacctttattaggtgatccttggtgtaagatgtctattattgcgctcggttctggaaggtgcgccatctcttcgttaaggtgaggaactggccacatggcctgtctatggctcgatcttgcgattggagacatgccttgtcctgcaaccatcctagtgccttacccctgcgaagagcaccgggatgagcccacattgcattcacgagctcgggtatctttgctgtccgc

SEQ ID NO: 705087 - DNA, 226 bp, Homo sapiens
cccgctctcagccccggcacacgaatctactctctatctctatagattgcctattctggacatttcattgctctttgtgactgactttttttcacttagcataatatttttaagtatctatgctgcagagtgtatcagtacttcattcttgttatgcccaaataatattccattctataaatataccacattctgtttatctattcatcagttgggagcggtggag

SEQ ID NO: 705088 - DNA, 350 bp, Homo sapiens
gagattgcgccattgcactccagcctgtgcaacaagagcctgtgcaacaagagcgatactccatctcaaaaaaaaaagtagagtttcacaattgtagcccaggtgggtctcgatctctgggatataggtgacccacctcccttgacctcccagagtgctaactacgttacaggcgtcaaccaccacactcggccctccttgcaataaatttacgtcgaacgtgatcatgaatataatgccccaggaaactccgtatctctgctctcaccatagtaggacctaacacactatccttaaccaggatcaggttggcaaactccgccagcagcacagcaagctcaacagataag

SEQ ID NO: 705089 - DNA, 1059 bp, Homo sapiens
gtttgaatggaaggagccaagaggccagcacaggagcggattcgtcagcatttcacggaacatcgagccgaacctctcgcaagtcctgtgagccgttaaggaggcccccagtcccgacccttcgccccaagcccctcggggtccccgggcctggatactccttgccacacgggaggggcgcggaacgccggggcggaggaggagccaacacccggagctgggctgagacccgcagaggaatacgctctagggattaagtcccggactagcgagatggcaaggctgagagacgggaggctgattgagaggcgaagagtgatcgatgaaaactaccccataaaagaccaaaatgggacaaggaaaagacgtcaatatcaacacttgtacgatcattggacacagatagattcgaggcaaagtccacacactactggccatcatgaatctatccacatgcggtgagccattcgacaaaaagaaaccattgacaaatttgagaacggaggcctgctgagtatgggaacaagggcatccctgtcaagtattgccatgagtcttggattccactgacaaagcactgacgcggtgaaccgatggaaatacaccaattgatattcgtcactttgatgcgacaaaaattatcgaagaaggccagggacaggttgcaatactcgttgcacttacatccgactatgaatggaccccgcaaagagtaccaaacaagaaagggcaaacttttagtgttacagagagcacaacacctatgaaaattatcacacagagggacaccaaattcgtacacagggggcattaccaaccttgactagccaatgcgatcacccagtgagaaactaggatagtgaactagaccagagggagtgcaattggggccgcgacaaatattgatcacaaagagcaaggaggatgagatacgctccacacaacagaaaactgggcagagacagaacacaccagaagacagagcatattagaccccgaattacacaaggaggcagatagtacaacacacaactgcgtgtagtgtacgaagacagccaa

SEQ ID NO: 705090 - DNA, 244 bp, Homo sapiens
ggctatagcataaaaaaggaatagccccctatacacttcagagtcacagaggtagccaaggcacccctcagacatccggccgcattcttctcacatgacaaaaactagaacacatctcaaacatataacacatctctccctcaataaacgtaagcatactcctcaatctctcaatataatccaatcatgcaggcagaagaggatgattaaaacaaaaccagatacgcaaaaacttagcatactc

SEQ ID NO: 705091 - DNA, 152 bp, Homo sapiens
attcgcgggcgcgtcgacaacagctcattaaaagactactagcaggaccacaaagtttacatttcagaaatgccaggatagattagtattacgaaaggcattcattacaagtcaccatatgatatggtttcactttaggtacagcacccaaa

SEQ ID NO: 705092 - DNA, 926 bp, Homo sapiens
  misc_feature (143)..(143): n is a, c, g, or t
  misc_feature (183)..(183): n is a, c, g, or t
  misc_feature (274)..(274): n is a, c, g, or t
  misc_feature (288)..(288): n is a, c, g, or t
  misc_feature (300)..(300): n is a, c, g, or t
  misc_feature (341)..(341): n is a, c, g, or t
  misc_feature (361)..(365): n is a, c, g, or t
  misc_feature (367)..(367): n is a, c, g, or t
  misc_feature (369)..(369): n is a, c, g, or t
  misc_feature (377)..(377): n is a, c, g, or t
  misc_feature (394)..(394): n is a, c, g, or t
  misc_feature (397)..(397): n is a, c, g, or t
  misc_feature (400)..(400): n is a, c, g, or t
  misc_feature (450)..(450): n is a, c, g, or t
  misc_feature (452)..(452): n is a, c, g, or t
  misc_feature (468)..(468): n is a, c, g, or t
  misc_feature (474)..(474): n is a, c, g, or t
  misc_feature (478)..(478): n is a, c, g, or t
  misc_feature (480)..(480): n is a, c, g, or t
  misc_feature (486)..(486): n is a, c, g, or t
  misc_feature (509)..(509): n is a, c, g, or t
  misc_feature (515)..(515): n is a, c, g, or t
  misc_feature (517)..(518): n is a, c, g, or t
  misc_feature (521)..(521): n is a, c, g, or t
  misc_feature (531)..(532): n is a, c, g, or t
  misc_feature (537)..(537): n is a, c, g, or t
  misc_feature (546)..(546): n is a, c, g, or t
  misc_feature (552)..(552): n is a, c, g, or t
  misc_feature (554)..(554): n is a, c, g, or t
  misc_feature (556)..(556): n is a, c, g, or t
  misc_feature (561)..(561): n is a, c, g, or t
  misc_feature (579)..(579): n is a, c, g, or t
  misc_feature (584)..(584): n is a, c, g, or t
  misc_feature (596)..(596): n is a, c, g, or t
  misc_feature (606)..(606): n is a, c, g, or t
  misc_feature (614)..(614): n is a, c, g, or t
  misc_feature (627)..(627): n is a, c, g, or t
  misc_feature (632)..(632): n is a, c, g, or t
  misc_feature (635)..(636): n is a, c, g, or t
  misc_feature (653)..(653): n is a, c, g, or t
  misc_feature (697)..(697): n is a, c, g, or t
  misc_feature (738)..(738): n is a, c, g, or t
  misc_feature (752)..(752): n is a, c, g, or t
  misc_feature (803)..(803): n is a, c, g, or t
  misc_feature (830)..(830): n is a, c, g, or t
  misc_feature (842)..(842): n is a, c, g, or t
  misc_feature (854)..(854): n is a, c, g, or t
  misc_feature (903)..(903): n is a, c, g, or t
cctcatcttaatatccactgatccatctcattcaatggtaacagtcaatgttttctaaaggaacataaaaacaaacatgcacacaattgcacagttttcataaaggcctatttcattattgggggggagcgcatttaacagtnaaatacatttaaataatgtataggtgactgcaggactgcngcattggtaactagataaccaactagaaaccagctaacaaagaactgtctaaatacttaaaatacagctcttgttgagatcatcctttgtnttgatcatcttctngggggaaaaaancctgctgctggtcacaatggaaatatattaaggccaaatcntctgacatccattcccaaannnnncncncagctggnttccccctccaactccnggncgngcccaaccttggggcctccagcattaatgctcttcccatctaccagggcngngagtgtaagcttcacnccaggnctcngngtctgngtgtagcctactccaattaagcnagggtngnnganttttgcgganntggtngcggtgggntccaantnanatttngctgcaatgccaaaacgngtgcngttggtacctgntgtccaagcnaggtttantgaagtgtcaagntcttnacnnactttctgataaattgntcctccaaattctgtcccatcattgacattagtgtgtagctggnagttcccagttctgtagcccactgcaaagttattccttgtnagctttgatttggnactgtcaaaggtcatctggtagccagcaagccagccctcataaccaaaganagctgaaccatggattgcaggtccagntaaatcaaagtnaacatcacaacnaaggtttatacactccctcttgtaagaagacttgattttaccacttttntttcctgtgtttggtgagaaggt

SEQ ID NO: 705093 - DNA, 1389 bp, Homo sapiens
gccgcacacgacaccccttttgtcacccttgggtagagagtagggggagaggcctttccttctttgtaaggggaacccagatttactccagggagcggccgcgtttgtttcaggaactgctcgccatccctccaccccacgggtttttcctacttggaccggccccaccaccataggtgggtgtttttgttgttgtccccccaaaaaactccaccgcgggagggggggcgtcccgccttttggagggcaccatcggttgtccaagccggttttgtaccacgccgagcatgtttggggagggatgatgtgctcaaagagccttttttagcctcctgcccctcccccctgtctcactgtatggttgggcccctccccaccccgcgtggtttcgacaccagacacgtcttacaacgggcgttttctcgtcgggggggcccccccccaccacgatgtgtccacagaggttgggacacccgtctctgtgtcccaccagaggatgatatcccgtcgtggaccaacggcccccgtgcgacataatttagtttctacggccccaccagatatccccttctgagtcttctcgcggccggagcacacagcggggccactctgtggggtggtaagaggggcgcccccccgcagccacgaggcgtctcttcccacaccgggggtctcttcactcgggtggcccatctctcaggcgtgtcgcccacacggctgttcacacagggggggcaacttctttttcggcgcgcggctctctccccccagctggtgctctcccactgacacacacccacacactcttctccgcgtcacagcaccacagcggcgcgggctctcacgcgctatatggccccacgcgcacagcgggggtgtataaacactctccacccgcttggggcacggcggggtgtggccggcttctcggcgcacacccacacagggcgcacacagggtctccgcggttgtgacccacacccgctgcgttcttcttgtgtgcgcctctcacacacacacaggagatatcttattgtggcgccctttcacacacaggggcccacagcgggggcgctcccagagatgcgccccccttccacacacatgggagagccacaggagacacatgagaggcttctcccgagaagccacaaggagatttcacgccacagagatgccacaaagagcccctcacgagaaccttgagcactggagaagtccacacaccacctggaacccacggccctccaaaactgctgcgggcccttccacaactcctggtatatttgcaatcggcgagaatggccctttttgcccctgagatccccacagggagatggggagagggaaagtcattaaagttttgttaaaactgattttttcatgcca

SEQ ID NO: 705094 - DNA, 1008 bp, Homo sapiens
gggacaagaccttacagaatgtaatgaatgtggtaacagcttgcaattcgaacaggtcaagagctggatgtaccatcaacaggaaatcacactgaatgagaagccatacaaatgtattgaatgtggcagggcctttgggcggttttcttgcctcaacaaatcaccacgatgattcatgctgataagaaaaaacccttgataaatgtaaagagtgtggcaaatctggttcattagtcgctcaggcctcaataaacaatcgagacaacacacatactgcagaggagtcttacaatcaacaattcagtgtggaaaagcctttagcatgttctcctaacttctgggttcacatctaattcatacttattgatactatgcttgtaattatttagtcacttccgtctgaaatctcatgtggaattgtaaatccccttcattggaggtggggcctggtgccgacgatcgtcttggatcacgggggtgggtttctgagatacatggtataagcaccatccggttttggctctctcctgggatagtgaagttctcggtgagactctgagtgagagccgctcgtaggcgtgtctgggacgcgagtctctctctgtcggcaggatggctatgcatgttggctgccgtgtctatggtcaccttgcaggctctggtttcgaaagctgaagttgattggtccgtggcttgaacttccatgtagtagctgggagggtctatggtggacaccgtgcatgttggttcagatgggtccctctgggccgacctgggggttcgctcgtcggccgggatgggtccatactgagccaagaattgcggctcagtcgcgatctgcgatctgggtggtggcccacccgtggtgttgttgctcaacctggcgacgcggtggggagcgcctccccccagggggggcgcccggggccacccgccccgggcgggtcctccacccgcgggtggtctccttttccttttgtttgcctttttccttcttctttctgttcc

SEQ ID NO: 705095 - DNA, 780 bp, Homo sapiens
gaaggtggatcacgaggccaggagtttgagaccagcctggccaatgtggtgaaatcccatttatactaaaaatacaaaaattagccaggcacagtgacaaaaatttagcccaggacttcaagatcagcctgggcaacatagtgagatcccgtctctttaaaaaacaaacaaaaactgggcgcagacaaggcgcagtggctcacgcctgtaatcccagcacttcgggaggccgaggtgggtggattacttgaggccaggaattacagaccagcctggccaacacgatgaaaccccgtttatacgaaaactaaaaaaattagccaggaactggaggctgaggcaggaggatcacttgaacctgagaggttcagtgagtttgcagtcagctgaggtagcatcactgcactccagcctggacgacagagtgagactctgtctcaaaaaaaacaaaaaaaaaaaaaactgggcgtggtggctcacaccagtaatcccagcactttgggaagccgaggcacgcacatcacgtgaggtcaggagttcgagactagcctgggctaacatggttaaaaaccctgttctttctactaaaagaagaacaacgcacaacgcaggagacgacaacaacgtcgctacaccacaaaccaaggaaaacaaattcgtggcggggcacgggcgccccagaagaggttttaacacaccctcggtgggcgcgcgcccccatgtaacaacggggccccgggcgccagaaacagcgcccacaaagtgggggtttccccaaag

SEQ ID NO: 705096 - DNA, 305 bp, Homo sapiens
  misc_feature (38)..(38): n is a, c, g, or t
tgatatctacacattcacatatccacagacaccacacngcacactacacacaagtacatatgcaactccacacacacaccacacacaatacattacatatcacacatacgtatacacacattcacacatctgcacaccatatacatatacacacacgcacagcatatacacatgtatatatgcacacatgcacacatatacacatgtgcaaaccatatacacacatgcacacccacatgcacacacacatgcatacccctaaacccctcacataacatactccccagcttccacggggatcctct

SEQ ID NO: 705097 - DNA, 131 bp, Homo sapiens
ttcatgtcggtacctctccctatataaaacagaagcatgaaacacatcttagagggttgctgtgaggttcaaaggcaattgtgtgcaaagcatacggctgggcttgcagtgtagtgatacacgtagggaga

SEQ ID NO: 705098 - DNA, 249 bp, Homo sapiens
  misc_feature (176)..(176): n is a, c, g, or t
  misc_feature (228)..(228): n is a, c, g, or t
  misc_feature (239)..(239): n is a, c, g, or t
agccctgtttattttggctttcccccaacaccccggcatcaacttaaaaaaatgtggcttctttccagaagacgggagcacatgggattcccttgaagggtcctttcacaggccccttcattttgcacttaaatggacatttccccccccctctgtaaaaaacccggtgttgctanaaatttagtaaacaaaaaaaaaacgtttccaggggtcggggctttaaggctntgttcccttanccgcccccca

SEQ ID NO: 705099 - DNA, 600 bp, Homo sapiens
  misc_feature (460)..(460): n is a, c, g, or t
  misc_feature (475)..(475): n is a, c, g, or t
  misc_feature (481)..(481): n is a, c, g, or t
  misc_feature (490)..(490): n is a, c, g, or t
  misc_feature (502)..(503): n is a, c, g, or t
  misc_feature (506)..(506): n is a, c, g, or t
  misc_feature (510)..(510): n is a, c, g, or t
  misc_feature (520)..(520): n is a, c, g, or t
  misc_feature (526)..(526): n is a, c, g, or t
  misc_feature (528)..(529): n is a, c, g, or t
  misc_feature (536)..(536): n is a, c, g, or t
  misc_feature (549)..(549): n is a, c, g, or t
  misc_feature (557)..(557): n is a, c, g, or t
  misc_feature (567)..(567): n is a, c, g, or t
agacggagtcttgctccttcgcccaggctggagtgcagtgaggctatctcggttcactgcaagctccgcctcctgggttcacgccattctcccgcctcagcctcccaagtagctgggaccacaggcgcccgctaccatgcccggctaattttttgtatttttaatagagacggggtttcaccgtgttatccaggatggtctcgatctcctgacctcgagatctgcccacctcagcctcccaaagtgctgggattacaggcgtgagccaccgcacctggccaattttttgtatttttagtagagacagggtttcaccgtgttagccaggacggtctcgatctcctgacctcgtgatctgcccacctcagcctcccaaagcgctgggaccacaggcgtgaggcactgcgcccggcctccaacagaacgtgggaaatcacatagacccaaacaatggcccccntgggtgaccactgtnttgccnccagatggnctatcaagaaannatntgcngtgatagctncaaaangnnaagctgngcttggtgctggnttttcggntttaagcccntccaatgggtggagggagaggtaacccaaatcc

SEQ ID NO: 705100 - DNA, 914 bp, Homo sapiens
aagcagtggtatcaacgcagagggcccattagggccggggtgaaatctggcggtttgttttgtacagccgcgtcgcgggtgatggctctcgtatccaggcctccacggtgtgcaccgtgccgtcaggagcgcgcttgtgcgtccacgttcggtacagcatgtggaacattggcatcagtgagctgtgtcatcgtttccagataccagaacatgtcaccgtggcctgagagatctcctgggatcactctgaggagttactaaaagatgtacctgaactgcagatccttggtgaaatatcttttcaacaaatctctatatgagggcctgaatgcagagaaccacaagaatacagatcactgttgtcttcctgaagatgagaagtaccatgtctttgctatcatcattaaatggcagcgtgggtgggccttctgttgtgctcgtgatctggttcatcctgtcacagtgtggcgtttttaaaccgaagatatcacaattgaacttggagagcatcaggaaggcccagctgagaatcagagaatctgtcgagggaagagaattaggccctgctaatccacgtggggagaggctatcagccagttctgggactggagacccagatccttggattaacttgttcccttcaggttgcatcaagagcgcagggaccgctggtcggactactagttaacccatccttggtccccaaggttcggtgctgtggcacagtaacttggtcacttgtgtatcatacttacctttctggcgacgaaacacacacaaactgtgtgcgctccccgaacttaacactgggcgcgcctgacagagccgtcgagcccagcggtgctccaaagcgggcggtgaacggaggtcgtcacagacgacacgcgctggccagcacgaaaacaaaggccggg

SEQ ID NO: 705101 - DNA, 335 bp, Homo sapiens
gggggttaagggaaaccaaaaccgggcgccccccgctttttgtgggttcccggggggtttaaataaccacacccccccgggaaaaacgggcgcccccggtttttttttttggcccaaaagggcgcgggaattttttttttgggggggggggaaattttaaaatccccccctttgggggggttttttttggggaatttttggggggggccccaaattggggcccccccctttttttttggggggggggcgggggagggggggggttttttttttttaaaattttttttttgggaaagcccattttttgggttccccccaaaaccccgggggtggga

SEQ ID NO: 705102 - DNA, 284 bp, Homo sapiens
ttgctcagtcggatacaacatcctagatgcgggctagtgtagatttatcacacaattcctgaggtggagatgtagtgatggtgatgtcagatccattctgaaatggggcttatgtcagcttgctggaatacaacaacatttgagggcatgattcttcttagtgaaattatccaggagggggtatccgttctttcaacaaactcatccccattggcagggattagttttttggttgtcatgggggggacaaagaaaaagggtttttttttttttcaaaagagggg

SEQ ID NO: 705103 - DNA, 289 bp, Homo sapiens
tcatatagaggtaaaggctctaagactcctgagccaactttcatgtaactggctttcctaggctggggcgttgaactgctgtaaagcaagccaaggcagttcagatctagatagcagagtaagtaagtctcatactcaaaacattgcaactactggttagagtccaccccaatgaagctgtaacagatctgtgtatctatggactagagttctataatgtatatattggttcagacgtaaaacaaatgtggctagctatggttggcttgtgctgtctacagtaggacat

SEQ ID NO: 705104 - DNA, 445 bp, Homo sapiens
gaacggctaaccacgatcactgctcagctgagggagaagcttcacggagcgaagagggacttgagctttcgctctgcaaagcagagttctgtgcattggggtgaagagggtactccagcgaactgtgtcaagatgtggcgtcactaagtggacatctttgggtggaagcagaggtccctgtgagggagagaccttggcagaggtagggctgcagggagaagcacagagggctaactgcgcaatccccccaactgcagttcattgtgtcctagctgatggtgtaacttagaaaaaggagcagggaagacaggagttggggtcccagggctgtggagctggagcagccaactctccctttgtaaacacacaccaggcacactcagacacagagatgcccctagagctccagtcacacagatttgcacacacacccagccaggctcag

SEQ ID NO: 705105 - DNA, 1255 bp, Homo sapiens
gctcactcgacagccgtcccttccttctttctccctccgacctcctcggaggcgaccagcgcgctacgtgcaggcgggccactccagggataccctacgccgctcgtccggcacagcatgatcgcaggttgcgcacgggacggaagttgataggggactgacggtagacgggaaggggagagccgggaccgacataagccagagagatgccggagaacgggcgtctggtgggtggaccgcagagggacgcgaagcgaccgcgccgacaccctgatgataggagcccatagcgggtgctagaccaaacagtgcacaccgcagccgaaagcccagtgtaaagggaagctgatgttactgtagagagcactgaaggacaggcgtaatggctcatgcggaggagaagagagtgaacacattgggaagatgtgtactgtagaagaaaaaaagaaacaaagaagaggagaaagcacagagggggaaaagagaaagagacagaggtggggagaccacagagagcagatcaaatagacatgcagaaggagcaagagggtgacacaaaagcacagacaaacaccggatgaacccgacgaagataacgcagaaaaacaacacgggggggaaacacaccgcaccaaagaacacacacaaaaagaaagacaccacaaaaaagaaaagtaaacagcaaaacgagccacagagaaaaacacgtgggcacataaaaagagacaacacggcgaaaaagaagagacgcaagacagaagacacaacaagaacaggacacaaaacaacgaaaaaagacaacaaagggaaagaaagcaagacgaacaagaaaacaacacgaagaaaaaaatacaaacaacagagagagagagaaaaaaaagaaaaccaaaaaacaaggaagcaaagaagaaccaacagaagaaccaccagaaaaaaaacacgtgagaaaagaaaacaaaaaacaggaaaaacaacacaaaacaaccaaaaaaagaaccggagcaaaaaaccgacaaacaaagggacaaaccaacgagaaaaaggaaacacaacgagcagctcaagcgccacaaagaaaaaaagaaaaaaagacaccacgaaaagaagagcacaaaaaaagacacaccaagaaacagaagagaaaaacgcagagagggagacaaaacagaggaaaacaaacagcagaacaacaaaaacaaaaaaagacagaggacagaaaaacgccgcacacgccagcagaaagaaaaagagaaaa

SEQ ID NO: 705106 - DNA, 947 bp, Homo sapiens
ggaggagcaggctcattgttcctgggagccgtcaccacagtaggtccctcggtcagtcggcccagcccctctcagtcctccccaacccccacaaggcgccgcgcggctctgagacgcggcccgggcggcgggtggagcagtgcgatcatacctccaccctccagccatggaagagctggaccaggctcctctggtctcgtcctcggatagccaccccggccgcagcccgcgttccaagtaccagttcgtgagggagcccgaggacgagcaggaacaagaggaaggaggaagagggaggcacgaggcacgaagactgtcggagcttggaggtgctggagaggaagcccgcccgcgtcctgtcccgaggccccctagtgccccaactgggcacttgctcggccgggtgtgccccctgagtgggacttgtcgggccagttgactttcgtgcccggcggggggccccgggggggaccacgttgcggggacgggtaccccgcagtttgcgacgcaggagggggagccaggttcttgggggaccccgcaggccgcggcggtgtccggcggaactgggtgccacggtgcatatcccgggtttgtatggtggccgcagttctcagctctttccagggcttccttgaaggaacgaaaggaggccttccgggaccggggccagtacgcacttgtcgaccacgcgggtacaacgcgtaggacccatatgaagaaatcttgttgttgggcaccgccgcaaagaggagagggtgtcctagcctggcgccctgcctgcccggccaggaaggtagagcggaccacttgatagcacggaacatgagcagctaaaatagaaggagggcacgcggaaaggacacggggcccaaaaaggggtaaagcgcgaaaacaacgagcaagttggaagaactgaaatctacaatagagaggcgcgggaacta

SEQ ID NO: 705107 - DNA, 624 bp, Homo sapiens
ggttggtcctctctctgtggggctgaattgccagggcgaggacctctcctctttggtggcatggaaggggctctggacctaggtggcctgatagggcggtgggtatgcgataccagcacggtgactctgtttcagctcccgctgtggccgcagcctctccctgcactccctcctggactctgtgggtctctggagagaggaaccaggagaagggctggggccggggcatgaggtgcccttttccagcctcgagagctagctccgatcactgaactctgttccacacttctgtgtcatctccgggtctatgtcgagatgctggtgggcacaagagcccgtttgcaatgagggagcgactagggccctggacccggctgcctgcgagccatgggtgccttgccgaatccattctcggaaacacctgtgaggcagaggctgttcgaaacagagcctctggcgctgcttcccaggctggaccatccacaaggccttgcctgagctgtatgacaggtagggtgggtgggatgaagatttgagaataacttgggtgtcctgctaatagtagccgaggtgtactcgtcatgaagattaggataatgccaagtgtcggaattcagaaccccg

SEQ ID NO: 705108 - DNA, 232 bp, Homo sapiens
aggcgacgtctcgaggatttccacagtctgcgttccaatcaggcacgtgttgaaggagccagggtggaaaaagaaaagtgcccacttggcgacaggggagggccccagcatggcagaccccccaagccacatcagaggagttttcacttgtcttccgtgggctgcattatctgggaacggccttcaaagaacttcggttacacactcagtggcgagtgcacggacacggaag

SEQ ID NO: 705109 - DNA, 345 bp, Homo sapiens
tccccaccccccccttcctatttcctgaagggccctcccaagggtcctcccccccccccagttttccctgagagggatcacctccttgagttcaccacaggcagatgtgatagcaagggccccgggccccctggcaggggtggggttttcatgagggaggggccccaagcccttgtgggcgggcctccctgagcctgtttgaggggccagcccttagtgccttcagggttaggcccctgggcagggatgccccccctgctccttcggggggcgtgccctcccccctccctggtcccctgggttggggctccccccgtttgccccgttaaagcctttttgccgcca

SEQ ID NO: 705110 - DNA, 294 bp, Homo sapiens
ttccccgctggggggggccaagggccaaggaaaagggggggttttaaaaaggccgcccctttttgtcccctggggggaatgggcttgccccagaggtaaaggggaggcccaaagcccctggttttttatttcccctaaatggttggaggaaaaaaaaacccaaaaaaattttttttaatttttggggttttgaaatggttaaaaatcccttccccctgccccgaagcccgggggggacccctgaagaaaactggggttccttttaaaatggttatttaatggttggaacctgga

SEQ ID NO: 705111 - DNA, 169 bp, Homo sapiens
tcttatcatactactggtctgcttctagacatgaacagacctgaattctcaccgctccactgctaacacccatccaagccagcacaatcacttgctgggcactgaagcagattccaatcagtctctcttctcttttccttccttcctttggtaggtatgatgaaggacg

SEQ ID NO: 705112 - DNA, 179 bp, Homo sapiens
gtagggaggagtgaagcagaactacactataacccaacagggcaactggaacccctgtctgaccttacccagagaagcatgggccactgctctgtgccgctcctgaaatccagcatgccccaagtgagctctgaagctccctcctcaatcccttgatggcctcccaccctgtaagaggc

SEQ ID NO: 705113 - DNA, 635 bp, Homo sapiens
  misc_feature (538)..(538): n is a, c, g, or t
cggcacgagcgcaaacccactctacattactatcagacaaccttatacaaaccatatacccacataaagtgtatgcgatagaaattgagacctgtggcaatagatatagtaccgcaagggaaagatgattatataccaagcatatatatatcaaggactatacaccctatatccttctggataatgagattaactagaaataactttgcaaagagaaagcgcagacacttgtgccgaattcgggacgagaggccactgggcagaccagacatttgcttggacttgtgcgccttgctttgcttttccttcgcaaccatgtctgacaaacccgatatggctgagaacgagaaattcgataagtcgaaactgtagaagacacgagacacacgaggatcgtaatgaggcgtgcgccgccaatatgcactgtgcattctcacaagcattgtgcttttatattacactttttagactggtaactctgtgagatgcgcaaagggtggatcaagagtatatgactgtgctgtccctcttacatatnagaactactgtgaacgaaaggcgcgcctgtgttttccatatgtgtatatatatgggtgtgcagggaagagagaaatttcatgttggtgaagggtggt

SEQ ID NO: 705114 - DNA, 439 bp, Homo sapiens
gatctattatgtgtgatcagagtgatgaacaattatcacaggaacacgaaaatcgcgaaaaaaagccctgcctgacgcatttccggccgttaattttgagagggaacagtccgatttacctgaattttgtgaattatggccaattcatcgcgatctgcaacagacacgcctgaagaatactgttttaccatccggtttactgtttgtggcacacaaatatgatccgacaactccctggataaatgcccgtaaaatggcagataaattttcagctccgttactgactattaacggtgacgggcatacgctggcgcttgctggcactaatttatgtgtggatgaggctgtcgttcgtcacctcctgtttccggggaaatctgacgatctaacgtgtcagggaagtggtaccggagacactaacctgatatcccataaaact

SEQ ID NO: 705115 - DNA, 1005 bp, Homo sapiens
  misc_feature (20)..(20): n is a, c, g, or t
acgaggcagatcaggtcctngctattaattcgacgagggtggtatccggagtcggatttgctggggctgccgcagctgcagtgtagtgtttatttttagagttggccgtctttacacatctgccggttcatctccccccgccttgtgaggcctcatgagctcggacgttgtatctatccgctctagagaatatgagccgcggcacgcatggaccgcagagtagggctgaggggtcaaatcccggtattgtggagactctttagcgtggcttcttctctctgctgagaccccgagagctttcccagttctcctcccaggaccaccggggttcctgaagatcgggacttttctgcgcccctccaccaacagcccatctcctgtctatgaagaaagacccttcgtagaaacaacttccccgctgctgacgcgttttcccgtcccgtccccgaagtagtctactatgacctcgttgtgagcctctgaacgattttgacactttcccgaggcctagggtattatatcctaaccttactaaagaccacagaggtgcttgccattatgggcaatcagcttgctggcattgctccctcccagatcctttctgtagagagttatttttcagatattcatgagtttgactatgataaaagcctgggagtactcggttttttaaagttgctcgagccgaagcacgagaagggcctggtcgttgtgcaaggtttttgcattcaggaatcccacattggctttacccagtaataacaagagcttgagtgactgaaaattcgggttactctggcagaatgttacttccgaagcgtcgacaggttgaacagcggaaggcctaagcggttgggcgacaatctatatgggttaccgggctttaattcattagaaggggtgtccgctctacggggccgccatggtctctggcccggagtggccgagggtcgtaggacgctaagccatttggagcgacaggaggaaccccatcgcgtttccact

SEQ ID NO: 705116 - DNA, 2131 bp, Homo sapiens
gttgactattctctacaaaccacaaagacataggaacactatacctattatcggcgcatgagctggagtcctaggcacagctctaagcctccattattcgagccgagctgggccagacaggcaaactactaggtaacagaccacaatctacaacgttatcgtcacgagcccatgccattatgtaataatctaatcttcatagtaatacccatcatacatcggcgggctatatggcaacacatagactagaattccccgtactaatacgtgtgcccccgatatggagtaacccccgaccataaaccaacagtaagcattctgacgtctgaccatcccatcgtcataccatactcctggctcggcatctgcttatagtggaggccggaagcagggacacaggtatgaacagcactacacctcccttagcagggcacgtactacccaccctggaggcctgccgtagacccataagacactcttacacacatctaacaccatagacaggggtgtcgtacactaatcatatagggggccatacacattaccatcccccaacaattcatcaaatatacaacccccctgccacaaaaccaaataacgagacgccccatattaggactgatcctgtcctaagtcacagcagtcctacatctcctaacacatccccagacctacgctgctggtcaatcacctaatacgtactaaccacggaccggcgaccaaccagaagcaccagtcgtcgaccccgacagggaagcaggaacccccatctaaccgcaccccgacaggaacgcaggcaaccggaaatgagaaacgcaccaacaggcaccggaaaaacacacatggaacaaaacaggaacaggaccaagcgccacgcggcaccaacacacgggtccggcaaaggaccaaccatgagcgaacagaagacgaggcagaacaaagccaacacgctcgcgcaccaacgaggccactcggcagcacacactgacaaaggacaacgacgagcagagaacgcagctagagaaaacgaaaacacggaggaaaaggaaacggacgagaaagagacgaaagacagacaaaaagaacgaacaacgaagcgaaagacagaggaggcagacagaaaaagagagcaaacagaaagacgaacacacggacaagacagaagaagaacaacaacaaagcaagaaaaaaagaggaagagcagaaaacaaaaatgagcacagaaccaacgagaagagcagcgaaaagaagcgcaagaggaggaggaagagcagacagaggagaagaaaaaaaaagcacgagagaccgacaagcagagagggagacgatgagaagcgagagaggacgacgacggcaggagaagcagcggaggggaagagaggaagagcagaaggaggagaagggaaaaagagaaggcgaagaacagaaggaagtcgaaagatcagcagaaaaaaagacagacgaagaagaacgagagagaaagcggagggagacaaggagcaagggaagagcggagagataaagacgaacagagagaagcacacagcacacgacgagaagacagtaggagcaagagaagagcaaggaacaagaagcaaacgcaagacaagacagaagacacagtgcaccaaaaagacaacagagcaaagagacaagacgagcagacgacgacaacagaaggcgagaaaaagagagcacaagaacagaagaaagacgagcagacgaaggcgagcacggagacaaacaaacacaacaacacaaggaggaaaagcagaacgaagaggagcaggaagcacgacaacgagagacaaagagcaaggaaggagaagaggcaagcacgacgagcacacaacaagcagcgaaccgcagacacgaacagaacggcgcaagaggagacacgcgcaacaacgacgaagaaagcggagggagagagcacggggaggacgacagaaaaacagagcagaacgcaagcggaacaaccgcacacgggcgagaccacgcaaggtcgaacacaacaacaacgaatacagaagcaggcgagcagacacagcagagaacgagcacgaccgagcgacaggaagcgcgaggagcagcgagaacagtgacatcacagcaactaggccacaggaca

SEQ ID NO: 705117 - DNA, 1063 bp, Homo sapiens
agcgagtgataaatcaggaagaattgcggcggttaatgaaggagaagcagcgtctgagcgaccagtcggaaacggatagaatctccattcgctgaagtacaaccgtttggggcatgctgagttgtgccctgtgtaacactccgtgttaatgagctgagctcctgtggcatgactcactgtcctggtgaaatgcatgcacctgagagaacagtggcctgagctgaaatgtgcgctgaaggaagccagccatgggttctgtcctgccagttcagacgccatcagtcctgtcaagacggacaagcgcctggaccgcagaccgaccatagatgtcaagcagagcgcaaggccaccgttggtgcctcagtgtacacgaccatccacgatctgcgtggaccaccaactattgacaaaactaggaaaggagttcattagagcgaatcccagtaagccttcaggactcactttactccccgattatgaagatgaggaggaggaggaagaggaggaggaaggagatggagaaagaaaaaggggggacgccagcaagccagctctccgacgcacagtgacaaggagcactcagatatcctcattcacgggaggtaacaaagtagatgtgctggcaaaagattcatatagatactactcctcccaaggaccccaataattcctcattcaggggtcaatttgcagaaagcagcaaatacatgaaaagtggtggaaacggagagaaaacaccgagagaagggtaacgggaaagataaaagaagacatgaggtagattgaaaagtagaagagtatgaatgtcaaaagataaaatggaaaaaaatggaaaaataaaaaagcttgagagtgtaaaataataagaaaaagagcaaaaagaaacagaagaagacaccaatggaaataaacaaaaggacaagatggaagaagtgccagcgaaataaaaaaagaatggtataaaagaaagaacgaaaaaaaaggaacgatgacaggagaaaagaacgacaaaaaaagcgaaaaacaagagaaaagaaagtaagatagttgtattatgtgcgaa

SEQ ID NO: 705118 - DNA, 410 bp, Homo sapiens
ggtcgacataaattcagaactgtgagtaatttgacaaggttagagcactgcatacccatagggaatttcatgaggtaactttgggtggataagcaggatctcaattttgcggtaacttatatgccattttaaagagcttggataagtagcttcgtcagcttttgtattgtggcagcagtatggcaggtatacactgagtgtggtagctcatgcctgtaatcccagcagttttgggaggacatggctggcggattgcctgaacccaggagctccagaccagcctaggcaatatagtgagacctcgtctctacaaaaaataaaaacattagcggggcatggtggtgtgtacctgcagccccagctattagggaggctgaggtgggagcattgcttgaacccaggagactgag

SEQ ID NO: 705119 - DNA, 285 bp, Homo sapiens
ataagagctactccagcctggtgcatagagctactccagcctgagtcactaagagctactccagcctgggcaataagagtctagactccgtctcaaaagtactgttggctgtgcggtggatcacgcgtgtcatcccagcactttgggaggccaaggcgggcagatcatgaggtcaggagttcaagaccagcttgacctatatggttaaaccccatctctactagaaatacaaaaattaaccgggcatggtgacacatgcctgtaatttcagctcttattgcccag

SEQ ID NO: 705120 - DNA, 442 bp, Homo sapiens
gtatgttctcgatacgtgatcggaattaatcagacaaagtcgctcgaccgactaagaacggccatgcagccatcagccacggaatcgagaaagagctatcaatctgtcaatcctgtccgtgtccgggccgggtgaggtttcccgtgttgcccaggctggagctttttattcttcgtgtttgcacagtggctgtagctatgtgtagtgacagcagagacaggcctgagaggggcagccacgttccccctgggcaggatctgtctgctacgggaccgcaagctgcgactttttccttctaagtgtgcggagaggagcccctgcctagggacggggagccgtagcctgctgttttggtgacaagcatcttgggcgagggggcactgggctgtgctgcatagatggtgagcactggactcacccccagccccaagtcaaacgaatg

SEQ ID NO: 705121 - DNA, 867 bp, Homo sapiens
agcgggggaagtcaatgtgagaagagatgaagatatgggtaactaggagtatcattagtgatcttcaccagagatagttcagtggaatagatctgaagtaggattctactggattgagtactgaaaggaagaagaggaaatgtggttatcctgaggtgggtctattatttctaatgactgcttgactgtaattgggcagagagggacacaagagtaagtacggagagtggacatttcgtagtgcaggttgatatatgattaatggtagagagttagtgtaagtgtgacttactaagagcaaacgtagcaatggtaggagcttatagaccgagatgagagtgacgagggagaagtatcaatgaaacgaagtacctcagagaataagaaagaatggtgggcatagctggaaattggcagaactgagtgctctagcacaggtattatggtactggtaactttggtgaaagtgttccagtcaacagcggagaatagggaaggatcctccagtgtggaacacttcctggaaatccggtgagggaggccggagaccccgttgaagggggaggggcaaattaaaaattcgaagtggagttgctcttgtaccgcgcaggtggcgtttgcttccccaaaggctagtgtggagccagggactcccccggggtgaagaatgaggcaatacaagtgggaaattgacacctctgttttggaaacttctcttggcaacttgcgagagacacctttaggaccaagaaaacgcgtttatttgccccttgggcaatcttaagagggcgcggttgtcccaaccataggaagaatttttcccccttatccgggttacctcgggggaaaattttacgtccctctcca

SEQ ID NO: 705122 - DNA, 178 bp, Homo sapiens
cgtggacgtgcacatgcagcggtgcgatctcaggtctgagatttttttatggatagatcaagcaatgcacggacagatagattgttggtcacgacagcagaagatttagctctctgtaattgcaggaggaatatccagtgctcagaattataactgggatttcgcccctattggaggc

SEQ ID NO: 705123 - DNA, 396 bp, Homo sapiens
  misc_feature (26)..(26): n is a, c, g, or t
  misc_feature (47)..(47): n is a, c, g, or t
  misc_feature (61)..(61): n is a, c, g, or t
  misc_feature (296)..(296): n is a, c, g, or t
agctaatgcctaaactttcacatggnctaggcctgttctcctcctcnagacctagtaatcnaagttattaccacatagtacttttatgttacccatcatcttttaaaaaattataggctgggcatgcgtggttacgcctgtaatcccaagactttgggaggccaagacgggcgggtcatgaggtcaggagatcgagaccatcctggctaacacggtgaaaacccatgtctacttaaaataaaaaaaaataaccaggtgtggtggcgggcgcctgtagttccagctactcaggaggntgaggcaggagaatggtgtgaacccgggaggcagggcttgcagtgagccgagattgcaccactgcactccagcctgggcggaagggcaagactccatctc

SEQ ID NO: 705124 - DNA, 136 bp, Homo sapiens
  misc_feature (114)..(114): n is a, c, g, or t
tagagctccggcgtgtgagagggacaggtcctaccaccacatctatctcgggtgagaacctgcgtggacaggctcgctcaggatgggctagtttggctaacctcagaaaactgnggctggcacaactcttggtttc

SEQ ID NO: 705125 - DNA, 182 bp, Homo sapiens
attgagatctaacagctcaccatccagagtcaacctgctgagattcccgaagagctgcggtatctggcctagctgttgcaacagatacaggtctgtgcacaccagctgggtggctgtccttctgactcaatagcacagtagaggcaataactggcacaggaggcttcgtcgggatgcagagc

SEQ ID NO: 705126 - DNA, 220 bp, Homo sapiens
tccacgatccccggacacgtttatagtatgaattctggaacatggccttgttcaacctgagcttagaatatgtgtacagcacgttttttgctgtaccacaaaattttaggttaggcaaattcacaaatacggaatccatgaataacgaggatcaactgtacttaactatattttaaagctgtgacatttatctacctggcttatggaatagaattcattg

SEQ ID NO: 705127 - DNA, 537 bp, Homo sapiens
  misc_feature (261)..(261): n is a, c, g, or t
  misc_feature (472)..(472): n is a, c, g, or t
tccagccgtggcattctttgggggctgactctgtgccagccaacacagaaaacgaagtggagccggtggatgcccgcccgttgctgccgaccgaggactgaccactcgaccaggttcggggttgacaaatatcaagagggaggagatctctgaagtgaagatggatgcagaattccgacatgactcaggatatgaagttcatcatcaaaaatgggggtccttggcagaagatgtgggtccaaacaaaggtgcaatcatggnactcagggggggcggtgtggtcatagcgacagtgatcgtcatcacctgggtgatgctgaagaagaaacagtacacatccattcatcaggggggggggcaggtggacgccgttgtcaccccagaggagcgccacctgtccaagatgcagcagaagggctacgaaaatccaaacctacaagttctttgagcagatgcagaaatagacccccgncaaagcagcctctgaagtgggacagcaaaagcattgtttcactacccatcggggtccattcatag

SEQ ID NO: 705128 - DNA, 193 bp, Homo sapiens
  misc_feature (7)..(7): n is a, c, g, or t
ctcttangatcacatctgcaggtgtggtggctcatgctgtaatcccagtgactcaggagactgaggcagagaatcacctgaggccaggggtttaagaccagaccaggcaacatagcaagaccctagtctctgtaaaaaaatcaaacatttgtgacgagcgcatggtggctcatgcctgttatcccagcacctt

SEQ ID NO: 705129 - DNA, 340 bp, Homo sapiens
  misc_feature (252)..(252): n is a, c, g, or t
gtgactctaaggatccgtacgggattctaaggaggaagaagagtgtgtgtgtgtgtgtgtgtgtgtgtgtgtgtacgtgtgctacactcaggcatgtgtaatattttcctttagtttaggtcaaattctactattctaattatttcctatagacgagcttacattttttcttttgtctcctctattataagagtgcctcagcgtctctactcatcaggtttttctacggtctttcgagaaacattcttattnacttaatctttatccgtgtggacagttgcttatacataaagcgtctgctaacttctaaagtgtcattactttaacctccagacaattt

SEQ ID NO: 705130 - DNA, 126 bp, Homo sapiens
  misc_feature (76)..(76): n is a, c, g, or t
gtatcaccttcaccattttacagtataagaagcactacctccatgagaattcacgtgtggtagtggtatagggtgntatggggtatagggtggtatggtggtatagctcggtggtatagggtggta

SEQ ID NO: 705131 - DNA, 198 bp, Homo sapiens
ggcggacattgaccaggtcctgctgacagaccctgcacatcagtctccctgatgacaccctcactgattagaccctcatgagcaggcccactaagaagggcccccactgccaggcacacaatgacgaggactccactgaccaggaccttacgtgacaaggcctcactgacaaggactcatggactaagtccttactga

SEQ ID NO: 705132 - DNA, 771 bp, Homo sapiens
tggttttggtccaaaattttataaaggggtcttaaaaaagcaacttccaaactccaaaatacagctgccaaggaaacccgtgttatgctgggggaacgggttggggcttggcaggcggctcgggtcttccccacccttctggtcctggagatggggggtgggtggggcagtatctcatctgtgggtgtcccacaatggctcacgtggtcaggcgggggcttctggagggccaatcttaccagtgggtgtcccaagggcacgctttgatacttcatccttgatcgcccagcacaccctgttctgagcacacacgtgtggcgcacaggccaggttgctcaacgatagtatagtgaacacaggggtctcctccggcgtggtgagatctcatctcagggccaactccaaaaaccttctcatgggatttaaagcccttcgtgctccttcgagagtttctcccaagaacaccaacaaaccttcgacagccttgtgggccccacttcctccatgtgattagacccgcagccaccacccaatagcggggccccctccgacacagaagagacccctcctataggaaagctgtgtgatacacgcagaagaacctcgtgccgtgggacaagggtgccaccacagaaccttcatagtggggcccccctttttcaggcattaatagcctcataacagtgtgcccttcgggaaaggcccaaacccttctttcgggaacatactagcaagatccagtccccgaaatccggccgggccttttctacc

SEQ ID NO: 705133 - DNA, 899 bp, Homo sapiens
  misc_feature (899)..(899): n is a, c, g, or t
ggccgcccgcccgcccggggccgccgccgtgacgccccaatgagttcgtacttcgtgaacccgctgtactccaagtacaaggcggcggtgcggcggggggcggggggaggccatcaatcccacttactacgactgtcacttcgcgcccgaggtcggcggccgtcacgccgccgccgcagcaagccctgcagctctatggcaacagcgccgccggttcccgcacgcgcccccgaggcgcacgcgcacccgaacccgtccccgcgcctccgggactgggttgcgggggtagggaaggccggggccaggagtacttccaccccggcggggcagcccggcgttgctaccagggcgccccccttctcttcgtatcctcagctccgcggcaactcccccctgggggggtattgctgtcaccggggagccgcgaagttttacggatacgattaatttacagagacagccgatttacgaccccagaagaggccgagctgatccaatatctgactgtcaatcgtccagtggtaatatggcgaggaccaagaccattaactaggagtcgtctccttctatcggctgcccggatgagaccaaacgctcgtatagacggaagacgcagaaagatcctaaagttggcctccacatctgatgtggacaagaagctcttcaaccctaactgccaggaacggcagaatgggcttccaagaccatacctccgtccacggtcaactcggctccccacccgagccgccaccgcacaccggccactccggccgcagagtcggaccggaaacatcaaccaaggcgacagcgcagcccacgcccaagaacactgattcctgccatggaaacgtgcacgagaacctgcgagaacacagcgcgccctgctctgcgctcggccn

SEQ ID NO: 705134 - DNA, 289 bp, Homo sapiens
gggggtttttttcccccttttattttggggccccttggggccggggggcccccgggcccccaaggccccttttttttttgggggttaaaggaaaacccccccctttccccccccggggggttcggggggggtttaggtgtttaaacgttcccccccaaaagattttttttttttttcccggggggttttttttggttgggggccccgaaaccccccccttttggggtttttaaagggaaatttccccttcccccttttttttttttttttttttttcccccccccttta

SEQ ID NO: 705135 - DNA, 579 bp, Homo sapiens
ccttcaccgcgttcacccggcgccggaagaccagcctggcctccgtgccgttcccgcctctcctccgggcccatgattatcgccagtcgaaccagaaaaatggagaccaccagccccgaggagcccctgctgaatgtgccgaggataccgcctggaaccctgggattatcccctgcctcaccggagcaccaaggagagggcccagggccaccccccgtcttatggatgcccagaacccgcgggtggcccttatggggctggtgaggccctggggacccttattgatgaaagaaacccctcttttgcgttacaccccgagtctgcctctcggagccgggagctcacccttccgcgacgtgtttctgagggtctgcatcttaggggggagggctggggccaatctgccaccctgtgcctcttcctcctgtgccctcgctgcgccccaccacccccaactccgagggcccacccctggggaaaacgggaagcgctcgctccctttccccccatagtgctctctctgcctggatcccggccgaagctatgaaagggaataaagagaaaagaagtaccccggga

SEQ ID NO: 705136 - DNA, 437 bp, Homo sapiens
caagactccgtctcaaaaaaaaaaaaaaaggaaaagaaaaaagaaaatcacctaagttctagtccgggctgggatttggagaatgggagaaacctcgggcaagtacggaatcccttgggccctcagtatcccttatgaataaccaataggcgggactagatgatcttaaaggggtcacgtctggtatcctaatacccgggggtccatcactaaagcattattttcccctttccttttcatttcctctcccttctccttttctcacttagcagctctctcgtgggatccatggaatggtttaaacccaggttggcagatatctaagtgcataaaacttagacttctcaagagatatatgggtctcctagaccttaacgtggtcatcacacccacttgtactagggtgtatttccctttgcttagcaaaccctatggaa

SEQ ID NO: 705137 - DNA, 681 bp, Homo sapiens
ccatcctgccggctataacagcttctgcgcggagctatctatatctcttcagccccgccttgcagcggtgttatgcccgtgtttgaagtcttcgccgccgcgcctcatcggttgttgagaaccagcaacttcgtcttctcctgaatagcatcgtcatcctcggcgtcggtggggccgcccttcacacttcatccccatatttggtgctccccataaatccaccaccgcgagccgcgcatgagcatattatcatcgtcagtatgtaatgatctttgtggttcatccagcgggtaattttggttattaatgttttgccgtctgtaaaaccggccgctaccttttccgcgggatataccccgaaccggtgtgctcgcggcccaaggaattcccctcttatctcaaattgatagagaaatatacaccgcccgcctcactcccgccgcgcggtcgagcgcgcgacacaatcacgggtgatggcatcgccccccccccgcccctccccgccggctaactcacaccgcacttttttcgcactgaataccccgaataatacactaatattctctccaccgcctacataggagtactattcctctacccctcccactcactcactcggtgtttcctcaccccaactccacctcgctcccccacgcaattcttcccaccatatacgacaca

SEQ ID NO: 705138 - DNA, 325 bp, Homo sapiens
  misc_feature (262)..(263): n is a, c, g, or t
  misc_feature (288)..(288): n is a, c, g, or t
atccggcgagtgatggtcaatcacagctcatgcagccgcgatctccaggctcaatcaatcctcccacctcagcctcctgggtagctgtgactgcaggcatgtgccaccatgcccggctggttttgtagtttggtagagatggggttgtgctatgttgccaaagatggtctccaactcctgggctaagtgatcctcccacctcagccttccaaaatgctgggattatagacgtgaccgtgcctagcccatgttagctcttcanngtacacccttctctttgcgtgacangcccccgcggctccccaatgctccctgcccaagccct

SEQ ID NO: 705139 - DNA, 613 bp, Homo sapiens
ggatgggtacattccaaaggagcagcctgggggagtgggcaggctcagccagcccttgtgaggctcagagcagctggcccagtgctcctagctcgcctccatgtgtgaagcccgatgcgccctcagaagacgacccatggtccaagtgtcaacgcatgagccgagtgcggtgttgtcacggtctaatgtgaacatctcttcccgtggtcgcccattcctcatgactctgcatgtgcctagcttggacagagttgacggtctcatgtggcttatggtgaccgctgcattacagcattccacaccgtgtcccatgctctgctctatggactgtcctcccactgctggaccctcaccgtgacttcaggggtatggtggacgggagggagcacagtgcctccaaggcccagggagtgctattgcgtcatgaagagcattgtcaggacttcctggcaggccattcacgggctatggagcccctgcctcggtggatccacgctgaacctgcggaccaggatgatcgggcacagcatgtgcctcatgtctgtgcctccttcgtgtgcctcctaccatggtgcccgtttaacgtgtgcctcagtgtgggtatagggaacaa

SEQ ID NO: 705140 - DNA, 96 bp, Homo sapiens
aggtggttgcgtgcaacagtaaagtctgacagttaacgtggtcagggacaagttaatggccaaacaggctctacattagtgggctctggccttgtg

SEQ ID NO: 705141 - DNA, 559 bp, Homo sapiens
  misc_feature (1)..(1): n is a, c, g, or t
  misc_feature (41)..(41): n is a, c, g, or t
  misc_feature (48)..(48): n is a, c, g, or t
  misc_feature (70)..(70): n is a, c, g, or t
  misc_feature (167)..(167): n is a, c, g, or t
ngtttgcccagtaaagtttggtaaagtccaagcaagggttncttaaanaaaaagcccccccttggcattntcctggggacattcttgaaatccccagataaattctcaagggcctcccccagaataaattaaccctttgccaaaggagaaaaaaaaaaaaccattgncagcagattttctcatctgcaagcattgaaagccagaggaccaaggctggcctgggcccaggattctcaaccagagcattcatactgttccccaaccagattaagaaatagattttgagccgggctcagtggcttacgcctgtaatcccagcacttcgggaggctgagatgggtggatcacgaggtcgggagatcgagaccctcctggccaacatggtgaaaccccatttctaaaggtatagaaattagctgggtgtggtggcgcgcgcctgtggtcccggctgcacaggaggctgaggcgggagaatcacttaaacccgggagacagaggttgcagtgggccgggatcgcgccattgcactccggcctgggtgacagagcaagactatctc

SEQ ID NO: 705142 - DNA, 145 bp, Homo sapiens
attgagattgggctagtatcttgtccatgtgcagaagcaagcaggctggatgtcagaggggtgccttgggtaacctctgggactcagaagtgaaagggggctattcctagttttattgctatagccattatgattattaatgatg

SEQ ID NO: 705143 - DNA, 189 bp, Homo sapiens
  misc_feature (139)..(139): n is a, c, g, or t
cctcgccgaacaccaagaacaagcgacgtttgcttttaactgaggttttagcaacttgcccactcgtgcagagagagcgcagaggtgttaccctagtccggactggctctaaagctgttaactcccttgctgtggccgntagtcataaatgtgcgcaggtgagaacagctaaccgcaatcttggtcata

SEQ ID NO: 705144 - DNA, 465 bp, Homo sapiens
acattggtgcgaaagccgggataggggaactccctccggcagactctcctctatcctcccggtaccacgtctcccatgcaagagacttccctcgcctcaggaactcagaccagctccggagcactccggctctgtctatggatataaaatccaacacggtcacggactcttctggggagacagccttccttcaggttggtcaatgcccgggacgccgcctttggcatttgccagccacacaagccaggacctccaatgggacgcccactgaggatcctagtggtgctcttttcctgtgtctctttctttccccccagtctttccttgtgctatcatgggcaatttcccgccttcaatccctctttcttctgtctggctgtgtgtcctcagaaactcaaacctcttcaccttgcaccaatctaaaggctaaaacgtctaatttttttctgtaacacgtcctggccc

SEQ ID NO: 705145 - DNA, 553 bp, Homo sapiens
  misc_feature (13)..(13): n is a, c, g, or t
  misc_feature (85)..(85): n is a, c, g, or t
  misc_feature (167)..(167): n is a, c, g, or t
  misc_feature (240)..(240): n is a, c, g, or t
  misc_feature (250)..(250): n is a, c, g, or t
  misc_feature (256)..(256): n is a, c, g, or t
  misc_feature (260)..(260): n is a, c, g, or t
  misc_feature (274)..(274): n is a, c, g, or t
  misc_feature (301)..(301): n is a, c, g, or t
  misc_feature (345)..(345): n is a, c, g, or t
  misc_feature (354)..(354): n is a, c, g, or t
  misc_feature (367)..(367): n is a, c, g, or t
  misc_feature (370)..(370): n is a, c, g, or t
  misc_feature (385)..(385): n is a, c, g, or t
  misc_feature (403)..(403): n is a, c, g, or t
  misc_feature (439)..(439): n is a, c, g, or t
  misc_feature (449)..(449): n is a, c, g, or t
  misc_feature (470)..(470): n is a, c, g, or t
  misc_feature (480)..(480): n is a, c, g, or t
  misc_feature (483)..(483): n is a, c, g, or t
  misc_feature (493)..(493): n is a, c, g, or t
  misc_feature (541)..(541): n is a, c, g, or t
gggcggcccaggnggggagggccagcccggagcgacgggccaccaagcccagggaggggcaggagaagaaggaggcgagccccgngacagcggagggggcggggcccccccagcgggaggcggccacgaggaggaggaggaaggggccgccacaggcgcggagcacnagggagccaaaggccgcgcaggaaccgcggaggagcaggggccggaaggcagggagcgggacgggaagccccngacgggccgnagcgcncccnggctattcaagaangaaaaacagaaaggaacccaaaaattntagggtggcaatcgccggcggagccaatccaagcaagaaattgncaaccgctnccaaaagccagcnaangaacgcagggaaaanggcgtggaagaaaaacgntaagaaaaggccaaggaagtctgaggcgaaagcaanttaagtggcncttcaagcacccaaacaacanccaaacgtantgngcagcaacangttgggcgaaccaaataaggataaaaagtggggccaacggacgcgcanggacagcacaac

SEQ ID NO: 705146 - DNA, 220 bp, Homo sapiens
attgtccacggtccacatggctgtatcttgagacacgtgtgtagaccccagtgcgagtcatgtttgcccacatgggacgtctccccaggagacgatgccatacagtgtactgttacagaccagggggccccttgagtcaccctcacaggagtctttgccaccctcttttatgccggcacacaacatgttgtcagtatgcgacccgcaaggttacctgtag

SEQ ID NO: 705147 - DNA, 183 bp, Homo sapiens
  misc_feature (37)..(37): n is a, c, g, or t
  misc_feature (62)..(62): n is a, c, g, or t
  misc_feature (96)..(96): n is a, c, g, or t
gtaagcctcaaccaacaacagaaaggctatttaacgngaatacttaaccacttagcgggganctggcgcggcgggggacgctgcggttgggagtgncctcgtgctccgtagcggggccagagctctctcgggcagggggccgcggcgggcggcggccgggaccacgcggacgtcgggcggccc

SEQ ID NO: 705148 - DNA, 776 bp, Homo sapiens
ggaagaaaaaaggaaaccttgaccaggcgtggtggctcagacctgtaatcccagcgctctgggaggccgagtcgcacggatcaattgagtccagggttcgagacccgcttggccaacatggtgaaaccccgtctctacggaaaaaacaaacaattagccgggcgtggtgacgcgtgcctctggtctcagctactcggagggctgaggcccaagaagcgcttgaactcgggagacggagcttacagtgagcccggattgtgcctgtgtactccaacctgggcaacataaacagactccatcacacacctacacacaaaaggaatctcaggaaggtggaaagtataaaggtggttagcagacgctaggaagaaaagggtgggatggagaatgaagacaagtggataatgggtcccaaaatacagaaagatggaataagtgagttctagtgtttgattgtacagtatgaaaattttagttcacaagaatttcttgaatatttccagatgctttggtaagaaacttcctaattttctcattatgctggtttttcaggctcttctcttttctgctcttggaaatcatgctggttatagtgaggttcgttgacgatggagttcgctcttgtttgccaggctggagtgtcatgggtgcagtgttggttcaccggacctctggctcctgggatcaggcgaatctcctggcctccaactcccggtggtgggattcaggcctggcctggttaacaaggggttctcccggcgggcaggggctcaccc

SEQ ID NO: 705149 - DNA, 270 bp, Homo sapiens
gcagtaatttacagaaaataaccaaggagccaataatggactatttggaggtccaggactaagaagatcatgatgcacttagataaaagaatgattaggtataggggagcattatttggcagcagataaatcatggccgttcccctctgtgcggggcagaatcacagtctcacatacggtctggtacggacacatccaaagcatgagggtgtccgaaatcccttgtctattcctgtctgtctaccgtgtctcattatgaccagatctctg

SEQ ID NO: 705150 - DNA, 1270 bp, Homo sapiens
agggtaaaaaaccttggtttttgaaatgctacagaaaatagcttgaggccaggcacagttgctcacacctgtaactccagcactttggaaggctgaggcaggcagatcacttgaggtcaggcgtttgagaccaggctggtcaacatggtgaaaccctgtctctactaaagaattactaaatgaaaaaaaaaaaaaaagaaaatttgacgcgcgggaatgtgggtggacggggtggcctgaaagttcaccaagataaattggggagaggtgtggaggcaaggagagaaatccgtgtgtgaaactccgtggtgaagacagaaggtgtgtgagagtgcgagccaataaacttcgtggccccaatgtggccacatcttccgagcgcggtgggctaagcagagaaaaacaggagggcactctgtgtgtattaaaaaagacaacaaaaaaaatggctgtgggaaaattacccgtttttccccgctttagaaaattcccaaatattgtggggaagtagtgtcaaacccccatttgtggggcctgtcaccacacaggtcgtgtggctcttatgagaaaccggggggtggatattatgacccatctattatgttgtgtgtctttaaacggaacgcaccctgtgggggttttcaaaagaaccagtgtttatatttgaaaaatgtggtctctaaaagattgtcgggggaaatatgttgttcccccgtgaaaaaatttccccatgggcaggccagaactgtgtcaataaaacatcgcgggggaataacatgtacgatgagaatatataacggcgtgatgagccgtggtgtgtgaaataaccaccccatccaggggtgttttacggcactgatgacaccagaacgcgggtgacgaaaccaataaggggggcagaagagggcgattgacacaccacacaatgaggacgggggggcacccaacatagggggggagtcgaacaataattagagagtgtgagaagcaacattgtttgagagcgactggtgttgcttgagacaacacgggggtgctacaaacccaggtaggggtggtgcttcacgaaggtgacaacactcgttgtgatgagacacacattgtgtgcggactgctcagaggaatgatagtggtggggcagaaattatctaaaaaagtggtggggctagcaggcagggacgaatcagacaggtgtcagcttgttatacgagttgaaagagaagaggggcagaagaaaacttataaatatgtgggggggagggaataacag

SEQ ID NO: 705151 - DNA, 191 bp, Homo sapiens
acacattgactgataactcgagcgtagccctggcacaacgccgtcgttggcagcttggcctcacgctgcagcgttttatccaggtccgcaagctgcttccggagcttcgcggcctcttccttcttgtcgatcagacccgcgagtgcaggatcacctcggcgtcggtcagcacggtcaaggccaatgttgga

SEQ ID NO: 705152 - DNA, 584 bp, Homo sapiens
atcgcaaaaaaatttgtgctttgagtgtcggaaagcaaaaacatgagccacacagaggatgattaataattccacaatctcagagcactagactttagcaaaggatcattcttagatatttatgatgatgaatatcactgccaaattgacagtagatttgctaaactgatctgtgttgaatagcatgaggcatgccagcatgacaccttatgctccttcttatgagaaaaaatatagttctttatccaaagtggatagtcttgcgctgtctctctgtagatgcagttgaccaatttgcagagacagcttatatacctgcagggccattttcacatactgtgggtttgggagacactgcatgagtcttttgactgtgagcacttgttcacagacttcgggggtctcccactcacacttgggcacctctgggtaccaggatctgttcccagagcaagtggtactttggggaccaaccacaccatagccagaatcacattggatggtgacattgtcaggctcaacatactgatccttattcacagacaaccttgcattcactaattgtggtttgcgacacagagctt

SEQ ID NO: 705153 - DNA, 1454 bp, Homo sapiens
  misc_feature (548)..(548): n is a, c, g, or t
  misc_feature (671)..(671): n is a, c, g, or t
tgggacagggggtacagatatttattttcctcaaagcagagttggggccttaggccagcggcgtgcccctggttagcctccccttcttgttaagagatgcaaagctttactttcgtggggcacacccattctccagcgtggaggtgcaagcaagaggccacgtggtgtaaggaggcaaaattctccctttacgtgccgtgaagaggattcctccaacaagcatatctcgggagaagctcgtgacgagggaaccatttatacagggtctcccaacgtggaagccgtgaggcttgaggctcaggctccaagtgtgcaggccttcctttccccatcacgaggttctccgagacgcctttccgtggggggcgggaacgccgtgtgtggtggtgggagattggggtgtgtgtacggcctgggagattgagaaatcattctcacaggccggcccatggatcacgtccgtgtgcatatgtgtgcaagaacaaacgcgtgtccgtggggccccagaggctctttctcaaaccacacaaacctcggcgtatgtgtgnggtatcaacgcgcccttcttggggtgtctcaagcctctctcgagccgacgcttcgcgggcgctaaatggccgtgggcttgaagtcctgggggcgcttggacacatgaggcccgtgtgtgcccncatctctgtggggccattctccgagaaaattcccctcgggggtggcaccacgagggaaacggcaacggggcacaggggggcgcctcaatatacatcttacgccagagaacgaacattacccagtgggaactcacgaggagggacgcataggaccacgcggggggaaatgtgcattacacacctggcgggctcggccgacctcgcgggcgcaaccacctcccccctccaaaaatctttacactattcccctggggcacacaaccccttaccaagcaagaaacagcgtccatccccactccctcccgaggaaacagcggcggaccacgggcgtcaacaacagcgcgccgaaaacctctgggtggtgcggtcgcatgcggcaaccccgacagcgtctccgggatgccaaccgcatccccatagggacgggggacccgagaagcaactcaatgggggagacacgtgccgccaccaacgccgccactgtggcgtgtaattagtggtacccccgggcgagcgggagatacgggggggcacgacaacacccccgcagacggtcgactggggggcgacccaacagcatcacgaaactaaggagaagaaaaagacgaggaagacaaccaccgcggtagacacaacaagccgagacagaaacagagaaaaggacaccccagacacagtaacccgccaagacagcatcaggagagcaaagcacactacccactgagacgtgcgagcataagaaagcacagccgagcgacacaccaagccgtgcagtgagccaca

SEQ ID NO: 705154 - DNA, 364 bp, Homo sapiens
ccagtgatgggctagttcagcttgacggattctcagcttcccagaccctcattatatcctttgatactcctgtagaaagcccactaaacaatgcccttagaaggctgggttcagagggtatcctttagagttcactgtctcctgtgctgtcttaattctgagcttggatgaggcaggttcatgtgtggccaaccctgagtgccccacgtgccacgggcccccatctcacccacactcatgagcagcctaccatgcctgctttttgtttgtttgagacgggggctccctctgtcacccaggctggagtgcagtgctgcaatctcggctcactgcaacctctgcctcctggattcaagcaattctc

SEQ ID NO: 705155 - DNA, 1147 bp, Homo sapiens
  misc_feature (594)..(594): n is a, c, g, or t
  misc_feature (635)..(635): n is a, c, g, or t
  misc_feature (759)..(759): n is a, c, g, or t
  misc_feature (1043)..(1043): n is a, c, g, or t
  misc_feature (1053)..(1053): n is a, c, g, or t
  misc_feature (1055)..(1055): n is a, c, g, or t
cactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagctaatgaatgacacctgaaatgcatatggtatttttgggagagttaaggtataatttgaagattggcagaccagtcgcgctgattactcttagagaagaagaaatggaaaaatgaaagaaggcaggaaggaaagaaaggatgcaggaaggaaagaaaggatacaggaagagagggaagcagaaggcagtcatttttctattttccccacaaattatttcaaaaaaaatctgtattttctgggatatgtcattggcaagaggaagaactggtgtttcgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgtngaatttgacatttgtgtgtaatttcatggtggcctagtgtngtggtgcttctggtaatggtaatagaagctcaactatttttttgtggatttcagtttttatcatcagaagtcctagacagtgacatttcttaatggtgggagtccagctcatgcatttctgatnatacaaaacagttggcagtaggttatctgtcatttcagttttttactgaaatttgagctaaacatttttacatgtaaatacttgtatttaccaaagatttaaatcagttgattaattaattaactcaaatactgtgaactatctttaaaacactagaaaaaagaaatgttagtatctcaattacaccaactgtgcaaatgaactttgataacatagaaataatctacattggctttgtgaaatctggggaagagctttaggattctagtagatggatactgaanactcaggccncnttaaattattaatggaaaccttgggtttttgtctttatgctatgccagagaaatgtgataattttttataataaaaattttttatgatgata

SEQ ID NO: 705156 - DNA, 115 bp, Homo sapiens
gatcctgttgagcagctggaggagtcacctcatcgatactacgagtctttctagcttcatgttactggtgtttggaaccttgatgccgaagggagagcttgtttgaattatctca

SEQ ID NO: 705157 - DNA, 188 bp, Homo sapiens
tccgattggtgggcattcaatgaaagaaaaatagtatatatgttacttgaacataccaagcaaaactcaacttttcaagttttagcatgatatatttggcaaacttttcttttcttttcttttcttttttttttttttattttttagggaagggaggtctttttgccaccctgtttggacgctgcagt

SEQ ID NO: 705158 - DNA, 406 bp, Homo sapiens
  misc_feature (348)..(348): n is a, c, g, or t
aaagcagcagaagagaagaagtctctaaaacgaacttttcagcagatacaagaggaggaagatgatgactaccctggaagctactctccccaagacccttctgcaggccctctcttgactgaggagttaatcaaagctttgcaggatctggaaaatgctgcgtcaggggatgctactgtccgacagaagatcgcttccctgcctcaggaagtgcaagacgtgtcgctgctagagaaaattacagacaaagaggcagctgaacgtctttcaaaaacagtagatgaagcatgtctgttactagcggaatataacgggcgcctggcagcggaactggaagaccggcgccantggctcggatgctggtggatacacccagaaccagaaagaggttttgtcaaaaaaaaaa

SEQ ID NO: 705159 - DNA, 410 bp, Homo sapiens
gaatgcaagtccttttagttatcaaagtcagagagccattaaaatgagcacagttatgtttttctcccttttcttcagctatgtatttatctcttgaaactgttcactattgccacaagtagctttaaattagaccaataattccactctggacactaaattccatacccttaaccttgatgtatatgcaatcaattattaaagttatttctttacataagtaaaatttctcacaaccaatttcgtatcagctcattcactgtacctctattatttttttttttttgcctttacaaatccacttgtaagtgctgctaatgaaagtgtagattccagagcaacttgaatattttgtcacaagtaaaaatccataagcttgacacacaaaataaacagtctgaaaatataaa

SEQ ID NO: 705160 - DNA, 534 bp, Homo sapiens
ttacgaatcggaagaaactgaagcaaacagactattatgaagcctcgactgcgcttcagaagagaaggatatctgaaagatagctggaggacattgagtatgtgcagtgcttttactttctcatggaaggcttgtgaatatataaagccaaaagcaaagatccaattgagagaattaatggactaatcaagaggataaagttactttggagaaaagtggactctttccggcactatatacagtgctttaataatagtataatcctcgatgatactagaacaggacaggctcaaatgtcagtagtgctggtactaaaaccaatgaaaaaactgtgatctgatggcaactcttcggtagaaggcaggcttagtcactgaaaggcacacttgctggtgagtaaaagtcccatttgaggttgccttcttgagaccatttccatcacttggccagtaaatgctcttaatcctcacaaccctagggagggctatgctactctcatcatgtggccatttcctgcgatgagccccatgaggc

SEQ ID NO: 705161 - DNA, 385 bp, Homo sapiens
ctcttgacagatgttgcgcctgtccgcgaacatactcctggactcaatcatggcttgtgggctcggcgccagcaacctgaatctcaaacctgtagagtgcctttgagtgccagagcgaggtggcttctgacgctatagagcttcgtgctgaacctgggcaaagacacggacaacctgtgcctggactctaacccttgcgttaacggccacggcgacagccaacaccattgtgtgcaacagcaaggaccgcggggcctgggggaccgagcacgaggaggctgtcttttcctttcaggctggaagagttgcacaagtgtgcatctttgaccaggccaacctgaccgcgaagctgtcacaaggataccaattcaggttcccccgcctc

SEQ ID NO: 705162 - DNA, 408 bp, Homo sapiens
caccatagagattttttgttggtcagtactagccagcttctggaccacccgtccatcctggccacaggggtctggggcgcgagatttccaaccaatatgtaacgctaaagctattgccgttcaccctggtgggtggcacaggcaaatccatctgtgcagagcctatcttcccagtctctccttacagctcatggatatcactttactgccaaaatgacaaccagcaagaaagcgggtggtgcccgtttcctccctggggaccctcagagggccaggccattctcttccttggtgtgactgcggatccagggtaagaagtgtgagactctcgtgtaaacgcctggcttgtccttcagggcacatccacggccccagctcacaattccaggcaaagtcattcggcctttg

SEQ ID NO: 705163 - DNA, 512 bp, Homo sapiens
tcaatcagccacatagccctcgtagtaacagccattctcatccaaaccccctgaagcttcaccggcgcagtctttctcatagactcccgggggcttccatcctcattccttttctccctagcaaacgcaaactccgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacattggggctcactcccccccccctttaacaacataaacccctctttcacccgagaaaacaccctcatgttcatacacctatcccccattctcctcctttccctcacccccgacttctttcccgggttttcctctta

SEQ ID NO: 705164 - DNA, 3518 bp, Homo sapiens
  misc_feature (2321)..(2321): n is a, c, g, or t
  misc_feature (2836)..(2836): n is a, c, g, or t
  misc_feature (2840)..(2840): n is a, c, g, or t
gccagcgcccttcttgtgcgagcgctgctccggcttctggcccctggcgggcttcttgtccgcgcgccgggagccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccaggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatggntttntaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattaaaaaaaaac

SEQ ID NO: 705165 - DNA, 3628 bp, Homo sapiens
  misc_feature (30)..(30): n is a, c, g, or t
  misc_feature (2431)..(2431): n is a, c, g, or t
  misc_feature (2946)..(2946): n is a, c, g, or t
  misc_feature (2950)..(2950): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccaggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatggntttntaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattaaaaaaaaac

SEQ ID NO: 705166 - DNA, 216 bp, Homo sapiens
gccatccaaggcaacacaaacaactgtccaaaaggcttcgtacgggtatcctattattacctagagtttttcttcgcaggattttctaagctttaccactccagcctagccctagccccattaggaggactgccccacaggataccgctaatccctgagtcactctacaatcgtatactgatatgagttatacctagctcatgctatgacacgaca

SEQ ID NO: 705167 - DNA, 574 bp, Homo sapiens
  misc_feature (30)..(30): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaacccacccccatccaggaccggtgactttcaaggaaccaaacgctcacgcaggccaataggagataaattcggtagtccccacccac

SEQ ID NO: 705168 - DNA, 245 bp, Homo sapiens
gcggatctcttgaggtcagtagttcaagaccagactgggcagtagttcaagaccagcctgggcaacatggcgaaaccctgtctctactaaagaatacaaaaattagctgggcattgtgcccatgtgcctgtagtaccagctactctggaggctgaggcaggagaatggcttgaatccagcaaggcggaggttgcagtgagctgagattgtgccccatggactccagcctgtggtgcacagagtgc

SEQ ID NO: 705169 - DNA, 111 bp, Homo sapiens
cagcaggcttactgaatggcttcatttcagatttagttgatttctccaccaaacccatgtcatgtattatccatcggctgtattcccagcagtcaataaataaaaacccgt

SEQ ID NO: 705170 - DNA, 604 bp, Homo sapiens
  misc_feature (30)..(30): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaccccgacagcccacgccggacggttcgccgcccccagaggatgagcgcgggacattacgtagggtgggggtggggggggcgcgccggcgcccgccgggctccccgggggcggccgc

SEQ ID NO: 705171 - DNA, 419 bp, Homo sapiens
ataagtagtataaagacaaaaggttgcattcttttgaatccttcatcagcctttcactgaatacacaatttaatctggctcagtgaaactgcatttttacataaatagggcagaggaagcaatgaggtacgcatttgtctcagatgagcatagggatgactttctgtcccacacctgtgaggataagctatcggtttccattgccagggtgaaattcaacagaacagagcaattctcctgcctcagcttcccaagtagctgggattacaggtgtctgccatcacgcctggctaagttttgtatttttagcagagatggagtttcctcatgtcgctcaggctggtctcgaattcctgacatcaagtgatcggtttgcctcatcctcccaaaatgctgggattacaggcatgagcccgctt

SEQ ID NO: 705172 - DNA, 125 bp, Homo sapiens
gtcgatctcatacacggatccccccctcgaaacccagtggttcgatgagcataagagcccttggtaggctgagttgcatcctggcgcttgcggggctccctgctcacaactatactactcttgtg

SEQ ID NO: 705173 - DNA, 3583 bp, Homo sapiens
  misc_feature (30)..(30): n is a, c, g, or t
  misc_feature (2386)..(2386): n is a, c, g, or t
  misc_feature (2901)..(2901): n is a, c, g, or t
  misc_feature (2905)..(2905): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccaggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatggntttntaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattaaaaaaaaac

SEQ ID NO: 705174 - DNA, 3425 bp, Homo sapiens
  misc_feature (30)..(30): n is a, c, g, or t
  misc_feature (2228)..(2228): n is a, c, g, or t
  misc_feature (2743)..(2743): n is a, c, g, or t
  misc_feature (2747)..(2747): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccaggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatggntttntaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattaaaaaaaaac

SEQ ID NO: 705175 - DNA, 3390 bp, Homo sapiens
  misc_feature (2193)..(2193): n is a, c, g, or t
  misc_feature (2708)..(2708): n is a, c, g, or t
  misc_feature (2712)..(2712): n is a, c, g, or t
cggccaacatagcccctcaagcaaccaaaggtcccggcttcaaactaacacacgaaacgtaatcttgggagggaaaacgagagaccggcccctccggagctcaaccagcctccgccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccaggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatggntttntaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattaaaaaaaaac

SEQ ID NO: 705176 - DNA, 109 bp, Homo sapiens
  misc_feature (101)..(101): n is a, c, g, or t
tatagtagatcgaattaaggtgatatgatcgggagattgcatgatgacatcgattgatccatatatagggccgggtataatacctcggtcgacgtttatgncattcgaa

SEQ ID NO: 705177 - DNA, 3391 bp, Homo sapiens
  misc_feature (30)..(30): n is a, c, g, or t
  misc_feature (2194)..(2194): n is a, c, g, or t
  misc_feature (2709)..(2709): n is a, c, g, or t
  misc_feature (2713)..(2713): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgcgtctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcagcccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctcagcttcaccccgggttctggttgtgcctctgggagcctaggcacaacccggggaatggaggactacggcaggacctctctagggacactgcctcgccgctccccccaccctgttgccgtgatgttcccagggcctcattttgtaatccacaagtagctgccgccggtccccccaaagccaatgggggctcaggtgggacaggtggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggccngatctctgctgattccagtattgggggtgcagagaaggcacaggacagtttttgttgaagccgttgcagcctccacttggggaagctgaggccaggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatggntttntaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccgtgagccaattaaacctcttatctttgtaaattaaaaaaaaac

SEQ ID NO: 705178 - DNA, 440 bp, Homo sapiens
  misc_feature (195)..(195): n is a, c, g, or t
  misc_feature (225)..(225): n is a, c, g, or t
atgtgtctctgtgaacagctcaattccctaggaggccctgatcattttggcttagcctggcactggagtcctgtgatcgacagctcactagaattgcacagagtgccggaagaacagttcccacaaaagaatggatgctgggaaggacacagaaataagaaaagtctacatattctaattattggctgtctaacnaatacacttgcccttctttccatacacacnatttgaaaatatttatctgatataatgcaaataactactgcacagagaaagaaccctctcctcaattggttccaggcaccacattcagagaggaaggcttgaggcttccatttcctaggtatcatcaagtgatggccatgattcctgtatttctgtgctatgctttatggataaaatgatacattatagtgtaccaacacatcttatatgcaaaa

SEQ ID NO: 705179 - DNA, 449 bp, Homo sapiens
ctagtcaacatcaccaaaacacaatccaacttctgtagcaatgaacaagccccaagagtgttcaaactgaatcagtcaaggtattatcctctctccatcagtttggcttgtttaacctgcaaactgatatgcctttgggatttcccaaatggagaggaaccattcccactgtctagtacccataaaagacactcacctttccgtacatagacgtcaaatttcaaaggctgttcttcctaggcaatcaggaacatggttggggttggcagaagtgggcccaaatggggagagacgaaaatccacctctggccaaaatggtcaggtagctgcttagagggcttttgaaactctcccagctcatggcagctgagtcacaatcaatgcattcacagtcaggaaaccaaaatttgttaccaaaacaccagaagtttggtctcattgctcactgc

SEQ ID NO: 705180 - DNA, 546 bp, Homo sapiens
  misc_feature (30)..(30): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcacttcttcccttcttgcccccggcggccgc

SEQ ID NO: 705181 - DNA, 293 bp, Homo sapiens
  misc_feature (30)..(30): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgccggccgacacgctcacttgcggcccttgggcactttggggacgctgggcttggccgccttcttcacttcttcccttcttgcccccggcggccgc

SEQ ID NO: 705182 - DNA, 115 bp, Homo sapiens
  misc_feature (73)..(73): n is a, c, g, or t
  misc_feature (106)..(106): n is a, c, g, or t
gattcctacaaggctggtggaaatcaaaaggacattaaggaatatgtcaaatggattgatgtactggattatntttgcactttttcaccacaagccaggaagaccntcacagaca

SEQ ID NO: 705183 - DNA, 412 bp, Homo sapiens
ccgtaatgcattagactgcttagggaagaaagagctaatttttaaaaatcaaggttattacatccatgtatcttcctgtgtatgcttttaaagtccttgtaacattgagttacagggctttaactcctgtgtctgaaaaatcacaaacactgatgacaatcaaagcctcatcttaaggccccgtagaagatgccaatcaaaataaactgcattcctgaggcactaggcaagaaattaaagctattcaactcctcaaggcccagggactattgcggaagaggtgggcgcgtaagattgtaagggccgattttgaaagatccagtaagttcagtttctctatgaactaatcattcaagtcaaaggcacactgatgcaaaatcagtatatggaccccggtgtctaaatgcaatca

SEQ ID NO: 705184 - DNA, 307 bp, Homo sapiens
cccgcgaaacagtatgactcacataagtctacatatcataggtgacaaattattctgctagtgcaactatggcaaagaaaaaaatcaagattatacagcgaactaagttaaactagatatgagttagagaatagacttacctcagaaaaaaacccactatattttgattatgggctttctgtctgtgaagaaccagaatcactgcagttaacccaatatgttcgactatcatggtgtattttttcaggcaggttgcctgcacaagccagttcattttctttatttgccatgtcctagctgtatcctg

SEQ ID NO: 705185 - DNA, 904 bp, Homo sapiens
gcggcagccagcggctggggcaaaccggctgctcctgctcttgctgatggcggtagcagcgcccagtcgagcccggggcagcggctggcgggccggagactggtgcgcagagggggtggggcggaacggtcgagagtggcgtaggcctgtggcactggtggggctgctgctggagccactcatttgagatcgatgacagtgccaacttccggaaatgcggggctcactgctctggagcaccagcattgatgtgtaccgttgtccctgtcacagcggctagctcatgcgaggaggagctggggccgactccgggatgtggcagccctgagtgggctgtaccgggtccggatcccaaggctgacccgggggccctggatgtggctggaagctggtgtctatgtctcctcctttgtccctgcgtgctccctggtggatgtcgcacctgtcgtgaccagctgaccctgcgacgtgtgagtgtggcggcatacgtggtgggcgtgtcggtggtgactgccaccctgggggctgccggggcactgaggtggcaggacgtggacctggagctgttcagcacctcggttgcagtgcggcgtccaccatggcctcgggcctgagacggtggctcatttgagctgccttggtgatgtaacaggcccctgaagggcaggaaccccccaggagcagaagtccttcttcgggaactactgtgtgtacattatttcccgtggtcatgtcctcatgagttcggagcgcgaggaacgtgggccagggttggcggtggatgagttggagttgtgaggagttattgcgtgtcagggcagtgtggcaggatcgtattcaaccaggggactatgggggtcctgtgtcaaatccagagagataggtcgcgattccgggagatggt

SEQ ID NO: 705186 - DNA, 840 bp, Homo sapiens
tgggacgtacgtacgggggaaacgtggtctccacgggcctcatgaagaacagctcccccctcacgctttggccccaccgttttcgccttcggggcccacacgagacgtttcgggggcgagacggcgagggtgaatagagtggaatcttttgttgacaactatgtctatttaccaacttcgcctaatgttgtttctggaacaggatacacagcttggggacatagtggggaccacagaggccattgtgctctctggtcccctcacaccgcgctttgctccgttctattctacttcaacagaagacagtttcattgagcaccttctgctgcccaggcagtatgcactaggcccaaccagcgtatagttgtgctgatgggggagtctcctacgcacagctcagtcagtgctcctcctgtgcccagtccttcaccggtgccttatggggggatctgtacggaaggtgggaccttcatgtggcggttctggggatctccaggaagcccgaccaagctgtccgccgttcccctgtgccaacccatcgtcctacgagccaccgctgcgatgatcaccatgctggctgggggcagctcccaggatatcctgccttccaactgatcttctgaagccccatcctcgctaacaatggcgacttccggaggtcaaggaccttagggctctcccacagggtctaacggttaaggggacccacataccagtgccaacgggggatgtcaagtggtgatagtcgattgtgctcccctccccacagagcgggtgggcggggggtgaatatggttggcctgcatcaggtggccataaccacgaagggccttctctgta

SEQ ID NO: 705187 - DNA, 1276 bp, Homo sapiens
  misc_feature (1276)..(1276): n is a, c, g, or t
gaggccctttgccaggagcacagcagcagctcgcctacctctgagcccaggccccctccctgccctcagacccccagtcctcccatccatcttcccatgggagtactcaatccatctcccagggccgtccattgcatccttcgattcacacgctgggaggtcccacgaattccaattgctgtaataaaggaggaagtgagtttccaggagcgtgccatggctgtcgtgcatgtaaagtgtattgtctagcatgaacaacgcctcgagaccatgcacccatgagaccaaggcatcggataccagaatgcgatggagctggcgctaaggatcccatcgtgatccaacatggagaccattagacactgacgctagccaattgacccatagccatcaccacatggacacaagacacacagaccatcagaaaggaggacccatacagaaactcgtccgaggaagaccccatcctacgactagccaaaggcaacatgatgggcaccccaacgcccacgaatcacacgcaacatggaatacatcacacatcaccaaaccaacaatcccacacgggaaccttgcaggaaagctgacgcactacccctcctgcgctggcaccaccacgggacccctacgcagccactgccacaccgctcactcaccatcaacagagagatacactcatcacagagagccaccacaccaaagaacagacatcacaacgaggcgaccaccaataggagacccaggccccacatcacaactgcgagaaacacatccccaggacccagaacaaacaacaacccacacacacagagggggacaaggcacactatggcacggcgaccaccacggagtccgcaacgcgagtggggtacgcgagggacccacaacgcacccggcacccacgcacccctggggacgccccagcagcgtagccctggcacacacagaagatccacacagccatgagcccactagacgaaagcgccgactaccccctcgacagcacaaggcaagcctacccatggacagaccacacacgaccaccagagcgaatccaccgctcaactccaccaatggccatgaccggaccaacaagcaggagagacacgttcactagcagcacaaacaacgacagtcacaaacagatagcaccatagcaacacacgaggcaaagcaacggcccacacacaagcaaccaaaacacaacacagcaaaaggacaccgacaacacgacaccacccacccacgccacaccaaagaccaaagcgccacgacn

SEQ ID NO: 705188 - DNA, 93 bp, Homo sapiens
tgaatgttctcattgagggtcatgtttctaacaaaattagttgttacccaaagcctgtttttcaactcccatttgcgtcatactttgccccca

SEQ ID NO: 705189 - DNA, 174 bp, Homo sapiens
ctattggatggtgctctcacgatggaatgacaggcgggatcaggcaggacacatggtcccaggcctccttctgtctctgctgttggctgctgcagagtgaagtggacaactgagaacccaccctgtctctaccacaggctcaatgtatccaataccccatggccatgcatggtc

SEQ ID NO: 705190 - DNA, 760 bp, Homo sapiens
ctatcatatagtaaaacccagcccgatgaccccgtaacaggggccctctcagccctcctaatgacctccggcctagccatgtgatttcagcttcgcactccatagaggctcctcatactaggcctactaagccaacagactaaccatataccagtgatggcgcgatgtaacacgagaaagcacataccaaggccacagacaccactggacaaaaaggcgttcgatacgggataagtcctattgtattgcctcagaagttttgtcttcgcaggattctcatgagcctttgagcactccagcctgagcgccgtagcacgttcaaattcaggaggggcactggcccaccaaataggcgatcaaccggctaaggtccactagagagtcccacttcatagacacatgcagtgatgactcgcatcaaggagtatcaagtcactgagctcagcatagtctaatagaaaagaagcagaaacgaaagtaatcaacgcaacagctttttaacagatgacaacgtggggtctcgtataaataaccttgactaaaggccttaagagaaaccttcagaagtcagccttcaacgattgccagagggacatctaacggggtcaacatctttgggtagacaaaggcttacaagggagttgcagcgtgattatggcttaaagtgtgcatcaatattgatacatacgacaatgagtagttcagttgacagtcaagacataatttggtttcgaaggcggcgcatgatatgcatagtact

SEQ ID NO: 705191 - DNA, 907 bp, Homo sapiens
tatagtgagtgggtacgtctgcgtacggagagtgtacgttgtggtgccagtaatagagaggtgaattatgtatgatgttaggtagagacaggcagatgatattattgaattggttgtgtaagctgacgaagaccagttcggtaagggagggaggcacagcgaatgagtgagagatatactatgcactgcgtctcgtcggacgaaagatcgggtcccgcgtgcatggtttttcttagacggccgtcagaacaagaaggaatcgatttgtcgggagaataggatagatggagttgatgtgtaggatcgaatcgaagtaatttcctgcatggaacatgatcttatgtctggtctgcataagaaggaaggaagagcagggctgactagctagtcttatctcaagcctagtaatgagtgatttattggtcggtgccctgctttatttcattaccagacatgtctgttgactgatttatgtgtgtcatccttccttaggatctattcatcaagactgcgttcgtgtcatgactgactgactgtatgtttggtcgggctgcttgataataagataggacttggtgtgttgttgaatgtgtacaggtcagtgaattgaatctagttactccctcccagtcagtgcattcctgatgaccctcccacagatatgattgaactgcgtcgtaggtacgccaccccaacagagaggtgcgccacacaactggagggggtggttttagactgatactgcaggggaggattataacgcgggggctctgcttttaccacccagcaccctctgttgcgtccttgctccccaagggggaaaaaaggcgtatggggacacccacacaacccgcagaagcgcccgacccggggggatgaaaccccacaaaaaggcgggacagggcga

SEQ ID NO: 705192 - DNA, 876 bp, Homo sapiens
  misc_feature (600)..(600): n is a, c, g, or t
tttgtataaaggggtaaaatcttacaatagaggggacccctttataatatgggagacgccgtgggacaaaaactgtgaacgggaagcacataagtaactgcccagcgaactttcatgtttgcccattggctgtaaaaaaatggggtgtgcgtgatcgcccgtttaatagtctttttgggggctttttcccacatgtgccgggagactcccctccggaaagtcggttgccggcgtaactttttgcggagttatatgcggccccggctaatttcccggaggtagcgggtcggcgccacacaaccggttcacgagataggtaatccatgggccacacgcgcgtgtggttgtaagcggacacctgggctgcccacagattcttctcttgtgggcgtggcaccccgcccccccgcccacacctgggggctagaacatacaccaggctccctttggcggtccttcgccccgggtaataaaagtatctgtgcggtgccacctaccctgtaacataaattagccacgcgggggcccttcctttattaaatacccgccttggcgtccaccagaatatggcgaggcctatgtctgacaagcgtgacaagntattcatcaggacaaaaatgcgatttatttcaggtgtaaacggagctctccgaggatagaaaattgcatttttcaaccaccttgctttggcgcgacgtcaaagattaacaacctgagatgggcagaagacattttcacaccagaggatgtttgggggcccgacgagggtgaaaaaatgcagtggggcttcacccctccctcgaagggggtggccccccgtgcggtaccccctataaacgaggggatcacaatatttggacaaacaggccacaaaca

SEQ ID NO: 705193 - DNA, 387 bp, Homo sapiens
agaatctctatatcctgggcctgacagtttcagaatgctaaggcgagcaggagttgaatccagtgtcaagaggattacagagttctcatacattgctggtgggaatgtaacatggtgccgctgttttggaaagcagtccagcagttactcaaaatgctaaacatagaattacacagtaactctgagtaacatcccacttcaaggattgaaagagaattgaaagcatatgtctacacaaaaacgtgtacatcaatgcccataggagcattattcataatagccaaaaagtggaaacaaacctaaatgcccatcgatggacaaatggataaacaaaatgtggtatatgcatatgatggaatattattcagccaaacattcaagccgtca

SEQ ID NO: 705194 - DNA, 523 bp, Homo sapiens
  misc_feature (205)..(206): n is a, c, g, or t
  misc_feature (218)..(221): n is a, c, g, or t
  misc_feature (224)..(224): n is a, c, g, or t
  misc_feature (229)..(229): n is a, c, g, or t
  misc_feature (237)..(237): n is a, c, g, or t
  misc_feature (263)..(263): n is a, c, g, or t
  misc_feature (265)..(265): n is a, c, g, or t
  misc_feature (286)..(286): n is a, c, g, or t
  misc_feature (304)..(304): n is a, c, g, or t
  misc_feature (306)..(306): n is a, c, g, or t
  misc_feature (314)..(314): n is a, c, g, or t
  misc_feature (398)..(401): n is a, c, g, or t
  misc_feature (403)..(404): n is a, c, g, or t
  misc_feature (409)..(409): n is a, c, g, or t
  misc_feature (413)..(414): n is a, c, g, or t
  misc_feature (416)..(416): n is a, c, g, or t
  misc_feature (419)..(421): n is a, c, g, or t
  misc_feature (453)..(453): n is a, c, g, or t
  misc_feature (455)..(455): n is a, c, g, or t
  misc_feature (457)..(457): n is a, c, g, or t
  misc_feature (469)..(469): n is a, c, g, or t
  misc_feature (489)..(489): n is a, c, g, or t
  misc_feature (498)..(498): n is a, c, g, or t
  misc_feature (507)..(507): n is a, c, g, or t
  misc_feature (510)..(510): n is a, c, g, or t
  misc_feature (512)..(512): n is a, c, g, or t
  misc_feature (515)..(515): n is a, c, g, or t
  misc_feature (523)..(523): n is a, c, g, or t
catgttcagttgtaagatgttaactaaatttctgtgaccaatatgctttttttttaatacccagaacattatagagttaatgcagagtcctaaggataatctgtagtcactaagtttttcttaagtcttcactttagatgctgttatttctagcacaattaagcaggcagagtctttcatatgctcaaacactggaatctttggnngctaccatatcnnnnggnttgcngacaagangccaaccattttaagaatgttttaantnaacaacttgcaaaccccaggnatggaaaaaccctaagantncccaattntcagcatttaacaaccatcacaactgtggctgaagactgttcatgccgttcttctgaaatgagatctcaaagcagtatagttcnnnncnnagggntttnngnggnnnttgggttttgcgcaatttctccaccaattttngngngtgaaccatttngttaactgtttccacttganaaagtgcgntagaaaacnggncnccntgtttcan

SEQ ID NO: 705195 - DNA, 792 bp, Homo sapiens
gtcggtctgtctgctcggcgacggtcaaatctgagctgcgttcactataaggatagagtgactcttcggtgttgccttcattccctatgttggacgagacagtaacgttgtcagactgtgtttccggagaagacggatggcgctctgggccaactcttggcgcgggagtgtctcgagacaatggagagttcctatgcatggctggtatagcacatgagggtccgacatgtcgtcagagttgcaggataatgagtgcccctagataggttaatagggtcggggtgtcaagattggagatacacatgagcggggatcacatgaaaggcacagacagggataactcacagtgattaatttcctgcaatttttgacactgcggagaccgacactttttaccctcactatacaagagctacacatattaaatagggatcatctattgatgacaatttccttttggtcttgctttacgcatactattgccaaacattttaggataatgtaagaataacgggatgtttttaaaactagagttggttttcgaggtcataggggaagtaccttctatggtgtctgtttccatggcaacgtgtcaatagcggagagtcaatctcattaggctaagtcctagagactatgtttgggggcgccccaaggtagataactatacggtgcacgtgagggacgatgggcttttgccatggtgcctttttctgtgcctacgtaggcgaaatcattgcaattgggtgaaacctcatgatgcaagtggtaccacagaaggttcgccttatg

SEQ ID NO: 705196 - DNA, 181 bp, Homo sapiens
tttggggaacatttccagcaacgagggagagggtgaagattctctacaaaaagattgaagatctgatcaagtacctgggctctaaagttggaggtcaggttacctgaggtttgcaatttgcaacacccaccctcccgcgaatcagtgttcttatttcagtgacaataaaccatagagatga

SEQ ID NO: 705197 - DNA, 251 bp, Homo sapiens
  misc_feature (30)..(30): n is a, c, g, or t
cgcacccccccttagtgtccccggagtttnttgtttttttttgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggtaattgtcttttgggggaaagtgggccgctcgcgatctagaactagt

SEQ ID NO: 705198 - DNA, 191 bp, Homo sapiens
tgaatgggtgtagcctccaatggtacggcgtgtagctgacaggtatactttttaatggagtctttccttcactaggagttgaggttggtatgctgataccttcagcagttgtaggagatgaacgtggcttcagccagaacgtggtcccagctgggtgcagcattgtcgaggcatcctactacgagtcgacc

SEQ ID NO: 705199 - DNA, 950 bp, Homo sapiens
tttaacgcgtcgcggtacctaaccgtatcaaaggtatcataatcacttgtgccttaatgagggacctgtatgaatgtgctccacgaaggttcagactgtctcttacttttaaccagtgaaattgacctgcccgtgaagaggcgggcataacacagcaagacgagaatgaccctatggagctttaatcttattaagtgcaccacagtagcctaataaagccacaggatcctaaagctaccaatacctgctgttaaaaatgtcgggttggggcgacctcggagcagagacccaacctccgagcagatacatgctaagacttcaccagtcaaagcgaactagtatactcatattgatccaataacttgagcaagcggaatcaagttaccctatggataacagcgcaatccctattctagagtccatatcacacaatagggtttacgacctcgatgtatggatcaggacatcccaatggtgcaggcgctattaaaggttcgtttgttcaaccgattaaagtcctacgtgatctgagttgcagaccggagtactccaggtcggttactatctacttcaaatgcctccctgtacgaaaggacagagacataagggctacttcagaaagcgcttcgcccgtgaactgatatcatctcaacgttagtatatactcagagccaccccaaggagagggttttccccggaacacagaaccccttcgacacaccgaccgaggaaacaacgaggaaggcgggaaaaaaagacacatcaggcgagggacaaaccaaacagagcacaggacggataacaggaccctcagaaaagtacgagaaaacgaagacgcacatcaacaccgagcaaggaaacaaccgggaagggcaaaacacatcagaagaaggaaaaacacacaaagaccgaacaaaagaatggacgatcacggagagaattaaaaataa

SEQ ID NO: 705200 - DNA, 152 bp, Homo sapiens
tctgagtatccacgcaggttgtgggtgcagcggctgcgcggtcggcggcggaggcagcagtcttagaatgagtagcaagtatccacgcgaaccatctctgcctaagcgcgtctccgtcctcctccttcgctcctcttcctcattcttcgttc

SEQ ID NO: 705201 - DNA, 252 bp, Homo sapiens
  misc_feature (52)..(52): n is a, c, g, or t
  misc_feature (101)..(101): n is a, c, g, or t
  misc_feature (104)..(104): n is a, c, g, or t
  misc_feature (161)..(162): n is a, c, g, or t
  misc_feature (171)..(171): n is a, c, g, or t
accactacaatctctaggaacaacatatgacgcactctcccctgaactctanacaacatattttgtcaccaagaccctacttctaacctccctgttcttanganttcgaacagcatacccccgattccgctgcgaccaactcatacacctcctatgaaaanncttcctccngctcacggtatgattacgtcccattatatatctccaaacccataacaatctccagcggtccgtatcggttttggggggggg

SEQ ID NO: 705202 - DNA, 229 bp, Homo sapiens
tgaacaatacctatgtccagaatctgggcgagtgttaaagtatccgactttgttctcatcaaccttccctagtacaaattgaattacatcatcttacgtgaacacgtactgcacttgactgcaatctcattccttgattcgatgttcacccttccatacaaatcaccagtcagaaaaacgtcatgcaagttttttcacatacagccaagatgctggcttctcacctgtg

SEQ ID NO: 705203 - DNA, 1483 bp, Homo sapiens
  misc_feature (425)..(425): n is a, c, g, or t
  misc_feature (540)..(540): n is a, c, g, or t
  misc_feature (542)..(542): n is a, c, g, or t
  misc_feature (621)..(621): n is a, c, g, or t
  misc_feature (631)..(631): n is a, c, g, or t
  misc_feature (644)..(644): n is a, c, g, or t
  misc_feature (660)..(660): n is a, c, g, or t
  misc_feature (675)..(675): n is a, c, g, or t
  misc_feature (693)..(693): n is a, c, g, or t
  misc_feature (737)..(737): n is a, c, g, or t
  misc_feature (744)..(744): n is a, c, g, or t
  misc_feature (756)..(756): n is a, c, g, or t
  misc_feature (762)..(762): n is a, c, g, or t
  misc_feature (770)..(770): n is a, c, g, or t
  misc_feature (778)..(778): n is a, c, g, or t
  misc_feature (780)..(780): n is a, c, g, or t
  misc_feature (783)..(783): n is a, c, g, or t
  misc_feature (825)..(825): n is a, c, g, or t
  misc_feature (955)..(955): n is a, c, g, or t
  misc_feature (961)..(961): n is a, c, g, or t
  misc_feature (980)..(980): n is a, c, g, or t
  misc_feature (1049)..(1049): n is a, c, g, or t
  misc_feature (1172)..(1172): n is a, c, g, or t
  misc_feature (1175)..(1175): n is a, c, g, or t
  misc_feature (1212)..(1212): n is a, c, g, or t
  misc_feature (1225)..(1225): n is a, c, g, or t
gctcggagtctcatctgtcggcgtgagaccataggagagtgctggtattccgcgctacggcactattcagttatgctccaagcaggctagcgaaactgagtacacacagaggacatctataatcggattcacatgtgataagtgcatgactcagtcgctgtctctaaagtggacaccgcaacttgcttggcggaagagtgtgacgttgagaaagggtggtgatccaggaacagctgattttaagagtgataagccatggagagggcttcaccttgacaattattgtccagagtacagttgacgctcgtagcatagtgtggcagtgcgaaggacgacgtagtatctggtaacaggcacgtagagaaatgaacgcggaagggtcatacggtgggaacaataagaggagtgtcagtctgacgctgtgnctgtgagcgtgcagtgaaaccagaagtgaacgagagcagagatggctgtgactgctgggggcagtactgttggacagcaggtgctacgaaaccgcacttataggttgcatgaggnanggcgacaactaattgcgtaaatcatagaggcagtgtggacggtacacgtgagggaagggtgacaggtgtagagtgtcancggagctcanatgtgttgaaganggatattgcgatgtcngctgtcgggagcccncgagaagaggtgcgctcntaaggaaggatggcggagagatgggtgtaacctcccccggtcgntagtcgntgagatcacgantccacntaaagcangtgctcgnanctntttggtgaggctccccgtatcccgttagcagagaacagcctnccccgggagggcccaatatgtcgcactttgcagcgtgtcacccatctcaacggagcgaatctacaacagggggggttgggttacatcaatcctcggatataagcgagtatgcttgggtcgcggatcgcancctgcntaagttcgattatacactngtattaccaagggtttggaatttggtagagattgcgcagcccacagaatatgagaggtaggcgccaccnccctaatttatattaggtcgccgacaccttgttggagaggaaacatagtatggcccctcctataggtgggtggagatgcctcaaccagtatataaagacagcgtgtataatttactattgtgngcncgtgggacagcaggattgttgtttatcatggagaaancctctccgttgtnaccacttatgacagagggactgggttgttttgtataagccacctctcatccaatggcaagtgcttgcgttaacacgaactccatttggcttggacatttgggttccagcacaatcaacgtgggcggcggtagagaagactgcggtggctacatattataacacggagagaattttattgcacacgagtagtcatggcacaatatagtgatccgacagcagagtatagtatttaacttgcagtgcacgagcattagctc

SEQ ID NO: 705204 - DNA, 111 bp, Homo sapiens
  misc_feature (66)..(66): n is a, c, g, or t
  misc_feature (103)..(103): n is a, c, g, or t
acagcagaactggcaggtgtcactcactcagttgctggcttccacttcgggcttctttcacagggnctatcggtggtgctaatagagatatttctattctcanaaccacgg

SEQ ID NO: 705205 - DNA, 773 bp, Homo sapiens
acaattgtgacagtgcccgcaggtgctgcccccgggcctgaggagcacacggccaccattgaggtggctgccatggcagaggaccacgagcggaagtagccgacaggagggcgatggcccctgagaacggaacagggctgggctgtctcgtcagccgcggcagcagtgcagcgtggcagtaggccgccagtcctggctcggtctaggtgcggtccacgtgttctgcagaaccaaagagaggaatcgccaaaacaaatcacggagtaagagagaaggggacagaactagcgagagcaacctggaaaatcggtcttcaggtcccacgtttcctcccccttttctcttgggaaactatattttcccatctgtggccttataactacctgtttacaccatttgggccttgatcaggagccaggtgggcgcgcgggcatagggggagcctgggtgcaggcagagacagaggacagcatgagcccaggtgccggagcggcgacccctgcagggttgcttggaccgcggttgccagccaggtcacgagggcccccattgtctgcgccccagccaggttccctgggggacgtttactaacctctatgacttgggagctaaggcccatgttgtgaaccctcctggatcctatggactttgggtttccttcccaacaagttttcgtgtaggtctcacgtgtggctggcgccccgttcttcgtccgagtttgggacctttgccccggagcttggggtgccaattctggatggggtgcctgctcc

SEQ ID NO: 705206 - DNA, 231 bp, Homo sapiens
cctagtgaagtcagtatacatcgtaatgagggatagctgaagagctgtggagcgcgcgtccggcgataagggacgctggagcgtttaatttgggcgttgaggaaatcagcttgcggagaatcagcagtcgtttcccgagcgtcggtcgtgctgggagctgtggcgaaggccccggcggtaacgccgattcccgcctggaacaagcgaagggaagcggttgtcccggttccc

SEQ ID NO: 705207 - DNA, 325 bp, Homo sapiens
  misc_feature (222)..(222): n is a, c, g, or t
  misc_feature (226)..(226): n is a, c, g, or t
  misc_feature (262)..(262): n is a, c, g, or t
cctgaggtgggaggattgccttgagcccccccggaggttgaggcctgccagtgatccccatgatggtgtccacctgcacctcccagccccggatgacagagtgagacctttgtgtaaaaaaaaacaaaacaaaacaacaacaacctaagttatagatatgatgcccccggatattgtgtatttcctaaaaccaaggatattcttctgtgtaactttagtgtncttnccaaaatcagcaaatcacagtgataaaatactatgntctaatcagcagacctctttcagattttgccagttgttcacataatggcctttatagcaaaaa

SEQ ID NO: 705208 - DNA, 624 bp, Homo sapiens
ctgtcgggcggtgaaaaggcactgactgcggatgcgctggtgttgcgatgttccagctgaatccggccccgttctgcttgctcgacgaggtggatgccccgctggacgacgccaacaccgagcgctacgccaacatggtcaagcgcatgtctgacaagacccaattcgtttttatttctcacaacaagattgcgatggaaatggcgcaacagctcatcggtgtgaccatgcaggaacaaggtgtgtcccggatcgtggcggtggacatggatgccgcgctgaccatggcggaggcggcgtaaatgcaggacaacaacctggtgatgggcctgctgggcgcaggcgtggtgtttgtgctcgtgattgttgtctacaaccagtggcaaatccgcaaggcgcgccggcccgaggtatataacccggccgtcgacgagacgccccgcggcgaaggctggaccgagcgcgccgaatccgccctgggcggagagcgcgacgagacgggccgcgtcgaaccgcgtcttgagcccggtttctcggcgaagacgcacacgcccgccacgggcagcgccgaaccgaagccggcgtgatcggagcgaacttacgccgtcgggcgacgatgctgcg

SEQ ID NO: 705209 - DNA, 187 bp, Homo sapiens
tactttccacagggagagtctttgaggaaagagccaagcagagaagaccgctgcgtggagtgtgacacctacatgtgcatttctcacagccctagcgtgaccctgctgtcaggctatataccaggtaattttaacgatactgtctcctggccctcgctcgttctaccttgccttgggttcaggaact

SEQ ID NO: 705210 - DNA, 908 bp, Homo sapiens
  misc_feature (127)..(127): n is a, c, g, or t
  misc_feature (155)..(155): n is a, c, g, or t
  misc_feature (459)..(459): n is a, c, g, or t
  misc_feature (621)..(622): n is a, c, g, or t
  misc_feature (625)..(625): n is a, c, g, or t
  misc_feature (636)..(637): n is a, c, g, or t
  misc_feature (640)..(640): n is a, c, g, or t
  misc_feature (650)..(650): n is a, c, g, or t
ggcgcggcgtggagcggcagccggtctggacgcgcggccggggctgggggctgggagcgcggcgcgcaagatctccccgcgcgagagcggcccttgccaccgggcgaggcctgcgccgcgatggcangagatgggcagtaacaggggtgacggcngggaaagatcgccagcaacgtgcagaagaagctcacccgcgcgcaggagaaggttctccagaagctggggaaggcagatgagaccaatggatgagcagtttgacgcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggatctccggactacctggctccgtcaaagccatgcangaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctnnggnccagttccccnnacntcaagtcacngcattggcaagcgggggcgcaagcttggtggactacgacagttggcccggcaccactaacgagtcctttaaaacggccaaaaagaagggtgaagccaaaattgccaaggcgaggaggaggtcatcaaggcccgaaaggtgttcgaggaggatcatgtgcgtcccggaagcgacttcgcgccctgtgtacacacgggaagtttacggaacaggtcaagcattcgggcggggaaattccaggggataggtccgaactctg

SEQ ID NO: 705211 - DNA, 393 bp, Homo sapiens
tctgagatgacagtcggctgttatgcgttccacctctgattccagaggcagagatgttcagctggctgggcacacacagccactgttgtccatttcagtatgccagccgggctactacatggctgccctaatctgggcctttctctcaggggaagtaagaggcaggcagaagatacgaaagtgatctcaaggtggctcaatgacctagagctggcccccttgttccactactgttctaaactgtaggggctcctaagtggctaattcacttccaggagtacctggcagaatatgctccagtcctcacacgtaaggagcaggcaggcaggctctgtgggggagcttggagccaccatactccctgtagtagcaagagctacaacacacctcgtt

SEQ ID NO: 705212 - DNA, 802 bp, Homo sapiens
  misc_feature (127)..(127): n is a, c, g, or t
  misc_feature (155)..(155): n is a, c, g, or t
  misc_feature (353)..(353): n is a, c, g, or t
  misc_feature (515)..(516): n is a, c, g, or t
  misc_feature (519)..(519): n is a, c, g, or t
  misc_feature (530)..(531): n is a, c, g, or t
  misc_feature (534)..(534): n is a, c, g, or t
  misc_feature (544)..(544): n is a, c, g, or t
ggcgcggcgtggagcggcagccggtctggacgcgcggccggggctgggggctgggagcgcggcgcgcaagatctccccgcgcgagagcggcccttgccaccgggcgaggcctgcgccgcgatggcangagatgggcagtaacaggggtgacggcngggaaagatcgccagcaacgtgcagaagaagctcacccgcgcgcaggagaaggttctccagaagctggggaaggcagatgagaccaatggatgagcagtttgacgcagtgcgtccagaatttcaacaagcagctgacggagggcacccggctgcagaaggatctccggacctacctggcctccgtcaaagccatgcangaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctnnggnccagttccccnnacntcaagtcacngcattggcaagcgggggcgcaagcttggtggactacgacagttggcccggcaccactaacgagtcctttaaaacggccaaaaagaagggtgaagccaaaattgccaaggcgaggaggaggtcatcaaggcccgaaaggtgttcgaggaggatcatgtgcgtcccggaagcgacttcgcgccctgtgtacacacgggaagtttacggaacaggtcaagcattcgggcggggaaattccaggggataggtccgaactctg

SEQ ID NO: 705213 - DNA, 148 bp, Homo sapiens
tggtggcctccttcacagtcatgctgcttttttgaaaggtgaatttcaacacatttagtgcctctttcattcctcagtatatattccaagaagcttgtgatgacaatctactagagatggtaattagatggaccttgtccaccctgta

SEQ ID NO: 705214 - DNA, 1161 bp, Homo sapiens
  misc_feature (712)..(712): n is a, c, g, or t
  misc_feature (874)..(875): n is a, c, g, or t
  misc_feature (878)..(878): n is a, c, g, or t
  misc_feature (889)..(890): n is a, c, g, or t
  misc_feature (893)..(893): n is a, c, g, or t
  misc_feature (903)..(903): n is a, c, g, or t
gagcagagcttgtccttgtcattgtgatccttcttttaaaaaggcaggaactgaggtgcagagtgattaagggcctggcccccaggggttgtccagctccataaggtggagctgggcaagattgtgggtttgcttgctccctgaagctggcattctttcatacgatactctttctcaagacagcggggctccctgggatctccaggtgtactgcacttgcttctccggggctggacttgagggtaagtgcagtacacctgctctgctggtgcggcgggcgcgccgagccctgtggatcggaaggctacacgccgggcctgatagcgcagccggtgccgaacgcgccttggcgaccggcgcacttgtgccgcaccagtgcgcgtccgtgaaaggcgcggcgagcgcctgcgagatatccgctccagagctgaacaagaagctcacccgcgcgcaggagaaggttctccagaagctggggaaggcagatgagaccaatggatgagcagtttgacgcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggatctccggactacctggctccgtcaaagccatgcangaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctnnggnccagttccccnnacntcaagtcacngcattggcaagcgggggcgcaagcttggtggactacgacagttggcccggcaccactaacgagtcctttaaaacggccaaaaagaagggtgaagccaaaattgccaaggcgaggaggaggtcatcaaggcccgaaaggtgttcgaggaggatcatgtgcgtcccggaagcgacttcgcgccctgtgtacacacgggaagtttacggaacaggtcaagcattcgggcggggaaattccaggggataggtccgaactctg

SEQ ID NO: 705215 - DNA, 241 bp, Homo sapiens
acttcagataattcagctaggcgactaataatacataatcctagtctcggaaggttaccacctcgtcctttataacactgggcttgcatcttagactcacatctgaccgatctggtcgtatatgagagctcactaatatgctggttaggcttgaacaggatgtaaagaaatcgcctatcttctattgcctcatagctgggttacctgatgctcgaattcctcatcattgctccttgctgtt

SEQ ID NO: 705216 - DNA, 346 bp, Homo sapiens
ctcaaaagaaggaggtggtctcgtacttggtcccgcaacattgctttgctgatgttttttcaggacggatgagttggctcccttaataaccagagaagggccaggtgcagcggttcacgcctgtaatcccagcaatttgggaggctgaggccggcggatcaccggaggtcaggagtttgagaccagcctggccaacatggtgaaaccccgtctctactaataatacaaaattagcccagcattgtggcaggtgcctgtaatcccagctactcgggaggctgaggcaggagaatcacttgaacccaggaggcggaggttgcactgagctgggatcacgccattgcac

SEQ ID NO: 705217 - DNA, 779 bp, Homo sapiens
  misc_feature (376)..(376): n is a, c, g, or t
  misc_feature (385)..(385): n is a, c, g, or t
  misc_feature (388)..(388): n is a, c, g, or t
  misc_feature (393)..(393): n is a, c, g, or t
  misc_feature (429)..(429): n is a, c, g, or t
  misc_feature (431)..(431): n is a, c, g, or t
  misc_feature (437)..(437): n is a, c, g, or t
  misc_feature (465)..(465): n is a, c, g, or t
  misc_feature (467)..(467): n is a, c, g, or t
  misc_feature (507)..(507): n is a, c, g, or t
  misc_feature (526)..(528): n is a, c, g, or t
  misc_feature (573)..(573): n is a, c, g, or t
  misc_feature (592)..(592): n is a, c, g, or t
  misc_feature (611)..(611): n is a, c, g, or t
  misc_feature (613)..(613): n is a, c, g, or t
  misc_feature (617)..(617): n is a, c, g, or t
  misc_feature (619)..(619): n is a, c, g, or t
  misc_feature (648)..(648): n is a, c, g, or t
  misc_feature (651)..(651): n is a, c, g, or t
  misc_feature (672)..(674): n is a, c, g, or t
  misc_feature (679)..(679): n is a, c, g, or t
  misc_feature (681)..(681): n is a, c, g, or t
  misc_feature (686)..(686): n is a, c, g, or t
  misc_feature (693)..(693): n is a, c, g, or t
  misc_feature (714)..(715): n is a, c, g, or t
  misc_feature (723)..(723): n is a, c, g, or t
  misc_feature (728)..(728): n is a, c, g, or t
  misc_feature (730)..(730): n is a, c, g, or t
  misc_feature (732)..(732): n is a, c, g, or t
  misc_feature (738)..(738): n is a, c, g, or t
  misc_feature (749)..(749): n is a, c, g, or t
  misc_feature (752)..(753): n is a, c, g, or t
  misc_feature (763)..(763): n is a, c, g, or t
  misc_feature (766)..(766): n is a, c, g, or t
agcgggatacacttttggccccaacggtttctggtaagaaattatgaacctccgccaggcgcggtggctcacacctgtaatcccagcactttgggaggccgaggcaggcggatcacgaggtcaggagatcgagatcatcctggctaacacggtgaaaccccgtctctactaaaaatacaaaaaaaaattagccgggcgtagtggcgggcgcctgtagtcccagctactcaggaggctgaggcaggagaatggcatgaacctgggaggcggagcttgcagcgaaccaagatctcaccaccgcactccagcctgggcgacagagggagactccgtcaaaaaaaaaaaaaaatttttgaacctctaacacttttatgangggaccaangcngaatncctctagtccctcgaatatccatttctctgggaaanangttacncccaaaccaaaaacaaaatcagtactgnangggcaagatgggataactccctagaaaacgttgagtccanctttggaggccgatgaaannntgggtctgggacacctgggcagcaggcttctttagcagtatctcncatgggggctgctgaaatncatcagaggcttatggaanangaanangaaaaccagccaggagacccccaaagaanaantctcctcagagtggggtgccnnntaaanangtcanaaaggangccacccaaagaaaaaccggnnagaccaanaaacncnanggtaantccccacctanggnnagaagcaaanccngtcatagttacca

SEQ ID NO: 705218 - DNA, 338 bp, Homo sapiens
taaaatagaaagttatcaggccgtgtggtgttcactgtatccagcttacttgggaggctgagtgcatgagaatcacttgaacccgggaggttgaggttgcagtgaactgagatcccgccactgccttccagcctgggtgacagagcgagactccatctcaaaaaaaaataaaagaagacaggagaattcgccaggcagggtgactcaggcgtgcaaccccagtctcaagtactttggggaggccacttgtgggcggatctcactgaggtcaggagtccgaaaccattctgggccaccttggtgaaacccggtctctacaactgtgttccgtcaaggtg

SEQ ID NO: 705219 - DNA, 163 bp, Homo sapiens
tttgttattccgacaactcctaagtgtgtcataaagctgataaaaaggatttgaaatcagtccagtaaatggaagtgatgctttcatgcttactgatatctccctcttcatagcgtgcagcagcatagagcaggatcttcttcaatttctgtgcccatttcaa

SEQ ID NO: 705220 - DNA, 84 bp, Homo sapiens
attaggtgccacttaaatttattttattacaccatgaatagctgattaaaagaaccaaatatttctagatgaaaaaaaaacaaa

SEQ ID NO: 705221 - DNA, 861 bp, Homo sapiens
gaaagtcttatactagcattacgcatctcacttctaggaatactagtatatcgctcacacctcatatcctgccctactatgccgtagaacggcaataatgactcatcgtctgtgtcacttagtaaggtactctcataacctctcaagacccagtcctctctgtagccaatatagtgcctatgccatacgtagtctgggccagactgcgaagcatgcggctgggccttagcccttactagtctcgatctccaacagatatggccttagactacgtagataaccgtaaacctagtccaatgctaaacctaatcgtcccaacaattatattagtaccagtgacatgactttccaagaagacagcataattggaatcaacatcaagcagccacagcctaattagttagcatcatccctcgtactattttttaaccaaatcaacaacaacctgatttagctgttcgcccaagactattggcctccgaacccctaacaaccccgcctccgtaatgactgaactaccgtgactcctatcgcctgcgaccatcggatggcaagcgaacgccagttaatccaagtgaaccactaatcacgagaaatggactctaaagcatctctatagcttaatctccgctagaaatctcctatactcataagattcacagccaggagaatgtaatcatatggactatcattcttgcgaagaccagcactttatccagcaactttgggtagtcattcaacgctaatgaggcaagacaagtgaagaaacagcctgaaacgcaggcacatactatcctattctagaccctaagtaggctccctatgcctaatctcgaacaattgtacaatcaaacaccatag

SEQ ID NO: 705222 - DNA, 444 bp, Homo sapiens
ttagaacactttttgttatcagtcaatatttttagatagttagaacctggtcgtaacagaatgaattctgttataaggaagacaaaacaattcagtctgttttttaatgcagtttaggaatagtgtatacctcctatacttaagattgtcatttatctttcccaactttaaatactcttttagtttctatagggaaggaagagttattacaggttttttttttttaattattcttcaactttagatactgccagtgggatttacaaatcgaccaggttttgaagctactgtgtgtgtgaatgcacactagcagccaggcactgaggctcgctcctataatcccagcagttttgagggtagatgggaagatcacttgatctcaggattttgagaaccatccggacaacatagggagacctcatcgctattttaaataattttaaa

SEQ ID NO: 705223 - DNA, 448 bp, Homo sapiens
acagtgaactccacctaaaatgatgtggctttgatgcatgagcagcatctggacactccagcagggcgctagagctgtggatacgccactccggtaaactcaccgagtagtacacacagagccaggaccaattcccactttgatgatataagccccagaaaggatgagctcttctaccatatctcctgtaaacacattaactgccatgatggggggaagagcaaagcgcttccgtacatcttaaacaaattcaacacagtgttcagagtacccatttgccacatccaggcatatatactcacaccaggggaataacttccaggatactgtccagctgctcaaagtcagaagagcctgtgcctgagctggcagccagatactcaagacagtcaggattctaggcagcaaactcttgcccttaaacgaggcaatagtgcttatggacagc

SEQ ID NO: 705224 - DNA, 358 bp, Homo sapiens
gcggtcaccggagggtgaccaggagctcccccaggctcctagccagactacagcgccgcctgggcgaggggtacagacagcaggccgcttactacgcacagaccccaggtcctggcggcccccagccgccgcccacgcagcagggacagcagcaggcaagtgggaattgccaccctcctccttctttctccttacaacccccggacaccgtacatcctgccttagtgggtagcgccggaaacctcttcccctgcggggtgcgcccttgacgcctgcagcgggcgccgtgtggccggaggtctccgggagtccccacgcaccgccagagaagcattcgctgtgtccagaggttaaacga

SEQ ID NO: 705225 - DNA, 821 bp, Homo sapiens
  misc_feature (67)..(69): n is a, c, g, or t
  misc_feature (101)..(101): n is a, c, g, or t
  misc_feature (179)..(179): n is a, c, g, or t
  misc_feature (192)..(192): n is a, c, g, or t
  misc_feature (198)..(200): n is a, c, g, or t
  misc_feature (205)..(205): n is a, c, g, or t
  misc_feature (234)..(234): n is a, c, g, or t
  misc_feature (240)..(240): n is a, c, g, or t
  misc_feature (252)..(252): n is a, c, g, or t
  misc_feature (254)..(254): n is a, c, g, or t
  misc_feature (259)..(259): n is a, c, g, or t
  misc_feature (326)..(326): n is a, c, g, or t
  misc_feature (330)..(330): n is a, c, g, or t
  misc_feature (347)..(347): n is a, c, g, or t
  misc_feature (352)..(352): n is a, c, g, or t
  misc_feature (356)..(356): n is a, c, g, or t
  misc_feature (358)..(358): n is a, c, g, or t
  misc_feature (364)..(365): n is a, c, g, or t
  misc_feature (377)..(377): n is a, c, g, or t
  misc_feature (379)..(379): n is a, c, g, or t
  misc_feature (389)..(389): n is a, c, g, or t
  misc_feature (422)..(422): n is a, c, g, or t
  misc_feature (439)..(439): n is a, c, g, or t
  misc_feature (444)..(445): n is a, c, g, or t
  misc_feature (451)..(451): n is a, c, g, or t
  misc_feature (462)..(462): n is a, c, g, or t
  misc_feature (546)..(546): n is a, c, g, or t
  misc_feature (616)..(617): n is a, c, g, or t
  misc_feature (627)..(628): n is a, c, g, or t
  misc_feature (636)..(637): n is a, c, g, or t
  misc_feature (651)..(653): n is a, c, g, or t
  misc_feature (659)..(660): n is a, c, g, or t
  misc_feature (684)..(684): n is a, c, g, or t
  misc_feature (699)..(700): n is a, c, g, or t
  misc_feature (710)..(710): n is a, c, g, or t
  misc_feature (716)..(716): n is a, c, g, or t
  misc_feature (735)..(735): n is a, c, g, or t
  misc_feature (757)..(757): n is a, c, g, or t
  misc_feature (809)..(809): n is a, c, g, or t
gcccctggcttttccccggcccgctcttcgtacctccctttctcagacactctctgttattgtcctnnntgtacagtatatatatgtatatatattctatnaatctttcttatatttaagcaaagacctaaaatcaaccatttgacttgcctcgacagaggcgcctttctagcgtatcngggagggggcacnctggannnaaggngggagacgcagagctagcgcacttgcggncaagtncagactcagaanangtgcnggctggcacctgcggcaggtaccaccctgaggcacgtggtggccgcctctcctgctcccgctgtgtntccnccgcccaatctggcttntcctngcantncttganncccacacgctgncnggggcctctnggggcccctcccctcgacccccagcctgggtanagccaccaggtacgacnaccanntaccanaaaccaccacncacacggcggcagaaagccagcgtccatcccccaccccccccctcctgcctgttcctggctcccaacccccgcccctccccacngcccccactctcctatcggcccacttcatttatacatagtatctcattttcacagtatgttgtcacaaanngaagagaaannctaaccannggggggggttaggnnncttttnnggtatcttgttttgttttattttnttttaattttaaatnnattttgtaanaagtanattgttccctctttccttntttttaacagctttttcagacncagtattttaatcctcttgttttgggaaaaatgaattctttgtaactggtanatttttttttgc

SEQ ID NO: 705226 - DNA, 122 bp, Homo sapiens
ggtaaaacccagcccatgacccctaacaggggccctctcagccctctaatgacctcggccctagccatgtgatttcaaattccaaatccataacggtccttaatacatagggccatacatta

SEQ ID NO: 705227 - DNA, 1251 bp, Homo sapiens
  misc_feature (1251)..(1251): n is a, c, g, or t
tagttctagatcgcgagcattccccctcaaacctaaaaaaaaaaaaaaaaaaaaaaaaaaaaaaaaaaaaaaaaaaaaaaaaaaaaaaaaaaaaaaaaggggggggcgcggctttaaatatattcttctcctggagaaggggccatagaatattagcgttgtatcaccacagggttgttgtggtaaaaagtggggtcacgtcaatatatagggcgacgcgattatattataagacgaatggaagagagggagcaagagttaatacaaaacacggtgtagagtgggaaaacaagaagagaaaagaaggagatactttctgtgtgaaaagagagagagaccctcattattcttctggtgggggggggggagacaaaatatattgtggtgaagaaacaagatagtacactcaacgaaagaaatatatatataaaggaactatactgcaaaggaaataaattatgaaacattatttaaagaagtggtatatatagcggtgggtaaccaacacaaacggaaataatattgttgataggatgagtgataaaaaaaaaattgtgggtaataaagaggggagagaaataatagatagagagaaacaatttatattaccacaaacggagacgtcaccttattattacatactccgggaaaacaagaaaacaaagagaaagaagagaaacgagagagcagcagataagacaaccaaaacaacaacgagcagaagaaaaggagaagaaggaaaggagacaaaaaagaaaaaagagagaaacggaggagaagaaagggaaaagaaagagaaaagaaggggaagagaaagaggaaagagggaaggaaaagaagaaaagagaagaaagaaggaggaaaagagaagagaaagagaaaaagaaaaggcagcagaaaagagagagaaaacaggagggaagaaagagaaagaggcgactaggagaaagcaccgagagaagagacgaagagaagaacaagggaaagcggagaagaggaacagaaagagagagagggaaaagagaaaggacagagggaagaaagaagagtaaaagaagagatgagaggagaaaacagagagataaagagaagaacagaaagaacaaagaaaaaaagggaggacggagaaggaacgacaaaaaagcccaaaagcaacaaacagcagcacgaaaagaaggcgagagaagaagagacaagagcagagaaaaaaacaacaaatgaagacaaacacgaaacagaacagaaaagagn

SEQ ID NO: 705228 - DNA, 238 bp, Homo sapiens
atcagagaccgtatgcatgcatgtgtggttgaagcagtgtgtataagaatgttatagcaccactatttgtactagctcaaaatagttgtgtggggagattcatcaaagtatagtagtaaattattataccattcacacgtggactactgtacttgtatgaaaaattgaacaaactcaatttacacaaatatggatgaacccttaaaaaccttgactggttgacaccaaaaaccaacac

SEQ ID NO: 705229 - DNA, 130 bp, Homo sapiens
gggcttacttagaggaccccgtatgtaaatgatgatatatcctacctcatagggttgttgtgaggatttaaattagatattgtacgaaaagtgcctagcatagtgcctggcacacagtagagtaggtgct

SEQ ID NO: 705230 - DNA, 1103 bp, Homo sapiens
cgccgcagccgccgccgctgggcagaggagccggagactgcgagcgggtcgaggtggcggcggaggctggagcgggagcgggtaccgggcgcgggcagagcgcggcggctgcggtagactggggttttgccatgttgacctggctggtctcgaactcctgagacgcaagtgatccgcctgcctcagcctcccaaggtgctgggattacaggcacgagccactgtgcctggcctcaactgttgcttcttataaaggtgtgttccagagaacaagccttcagacatttgctatattgacgctgagctgtcaggggcactcagcgcttactgagcgcaggctacttgctctacaccaaaacagcgctctagctgacgcacgacacagcacacagcagcgcggaccagcgactcggcaacacacacgcaagctaccactcctactcgcaacaacccatgcagatctattcgatctctttgctaactgatgatcgccatgttcatggtgaacaccattcaacaatctatccatctccggaggaaccttgaagctgttcagaatatggtatctactgtccgaatgtgctcttacacccatgtctcagcattgcttggcactgaacacacctccacacggacaaacaccagcagcggtgagacagaacgtgacacacaccgatgaccgcccggacgaaccctacttcccaggcatccaacgtggtcgcgacctcgtgtgcgtgtcatcgcggactcggcctgcgcttgccccccggctcgctcgctccccgatgtctttgcgcctcgcaactggctctcctgctgcgcccgaccacccgcgcccgctcccctgtccactaacgcccccggaatctccgcccgtctcgagtccgcacgcccccacacgaaacctctcggctgccccacctggcagccgcggctcgatccactcgcggaatgatgcgcccggttccactaacgggtcctccccccccgcccccacccgcgcccttccccacccccacgccggctcagcagcagccccctggacgagccccagcgcctcgcccccacctcgccggtgcacacccgtaacctgtctcgcactgc

SEQ ID NO: 705231 - DNA, 290 bp, Homo sapiens
cataatagatcccgtcacaagatgtggtctctggcccgatcccattttctagcaggtaacaagtttcctcgtccatccatgtgtcacaactggacttgtaccttcctgttcatccgctgttctctcattaaaatccacccccaacttaaagctgatctctgtgttcttgaaggtgctgtgtgtttttagggtgagaatgtccccattcttttcgatgattgtggtaggcttggtcatgctggccacctgcctggtagcaaaacccacaccgagtgcccggtacatgcaag

SEQ ID NO: 705232 - DNA, 168 bp, Homo sapiens
gaactctccacagggcggcagcctgggctgctgccaatctggtctctgcgtggagctacagggcagtgaggagaagtgcttagcaagaggtctggagcgaggggaagtcaggtccctcaggaacccctcctcccccatattatggaggaagagggctggagagtctgc

SEQ ID NO: 705233 - DNA, 306 bp, Homo sapiens
  misc_feature (160)..(160): n is a, c, g, or t
tttctaaacatacatagaaatcagaccgctacctctgcagaacattttactggtaaaaagaacagcccacatgagggaaaactgatttggtggaaagacaacaaaaacaaaacatgggaaatagggaaggtgataacatggggaagaggttttgcttgtntttcaccaggagaaaatcagcttcctgtttggatacccactagacatttgaagttctacaatgaacccatcagagatgcaaatgaaaatgcctccgcagagacagaaaacccgcaatcgagcatcatcgacttcgcagggtgaaca

SEQ ID NO: 705234 - DNA, 354 bp, Homo sapiens
  misc_feature (56)..(56): n is a, c, g, or t
  misc_feature (350)..(350): n is a, c, g, or t
agaagagcactaacaatcactgtggtctgggtctcaggaagtctcattcctagggnaagggggagagcatcacatcaagggaacatcccatgggaaaaagaatctgaatggcaggccttgagtcccagatctttccactagtgggacgtttcttatagcagagacacaattgcagtgctgggtgcagtaaagaaagtctacacctctaccccaacaatcaggcagcatctctgatcataaaggggcttggaaagggggtccttttcccactggtacaccacttgcacacacagctgggggctttttcccagagggaattgcagtgttaggatgcacattttaggtgggcnttcc

SEQ ID NO: 705235 - DNA, 292 bp, Homo sapiens
cggacgcgtggaaacgtacagactgaagtccctgggcttgcttttcccatgggtgaggaccagaaccagactctgagcatccttacccctggccaaccgattgttcagtttgagtaccgtccagagatctggggtcttctttgaggcttgctttgttctgatgccttcagaaaggatcacatgaagtataaaggacaggcccttggtcacaagttttggctctcatacagataggactcatccaggttcccagcgaggcactgactaagcgaggctcagagcttccatatca

SEQ ID NO: 705236 - DNA, 989 bp, Homo sapiens
ggggagtcgtgatcggttagtgctgaagcccggcatgtactggcagttggaaagggacagggctgctgtagagcacaaatgtgcctgcattagatcttaatccacatacacatagtgcgagtataggtcgtagaacccaggaacacatgggagaaggagtacaagaactgtgttgccgagtggagatgattatatggtgagatcgtatcctgattgaacggaatcgtcgttgtgagggcatggtattatggaatcatcgactgggtaaactccgtcgttgtagaatgtgatacagcatggtagttaaatgtccagtaaatggaggtaatagagtgtaagagccgaaagattcgtgtatagttgaactggaatgaatcgtggaagcttaccaacaaggatgaatatgtgagtgggagacctgtgtgggctaagggtgatagcggtaatgtgacgtaaaagtgctatatccacatgtgtagaaggtgcttgttgatggaatgggaaacggagggtgaaatagattgaatagagtcggggttactttatgggatgagagcattactatattggaagcataaagaataagagggctgtgaagtgtaaacaggtaagaggtagcatttaattgataaaccataaacgttggagggtttgttacgaggaagcacgtcatttagaatcgactcaagttttgtacggaaaagtatggtctgtggataatattaccgaagaaaaagaggatatcggagtattagccacaagtgtatttggccttgagcataagtactaagtacagatttggtgaaagatatgtatacatgcgaaacagggactatgtcagtaataaaacaggaagaatcagtgctggttggacaaggtaaacgggcatgttcattaggtattcatctccaaaatttggaatcggcatattggttacaggaggttgtaaagaccaggattgggtacttaaattgggtgaatcatattca

SEQ ID NO: 705237 - DNA, 337 bp, Homo sapiens
  misc_feature (144)..(144): n is a, c, g, or t
aattcagagagacatagacaggtagtatctatcttctcattattattctagaactcataaatggttgtattttctatagaacaaatatattaggtatagatgactgccaggcttatcaataaatgactacagcatctatcatanagcacacaagccttatgtctcatctcaaaaatgctgtgacagctttttggctgctttaaccataagaaaaatggattggtggatgattttattagcccaggcttttaaaaactttcatctaggccacgtgcggtggctcatgcctgtaatcccggcactttgggaggcctgagtggaaattaagcctttgcaa

SEQ ID NO: 705238 - DNA, 589 bp, Homo sapiens
  misc_feature (211)..(211): n is a, c, g, or t
tggccagatactattttttctccacacaggggatttcttaggagtcgcctgtacccttgagaattgtctccccagaagagatgcagccaaagtaaacaatgagggttgttttacaaaggtgatgacccttatagagtcagaaatgggagtcggcgcaggaatttcctttggagtggctggcttccaactgattggaatctttttcgccaanggccttttttgggccataacaaataaccagtatgagatagtgtaccccaatggatttgtgggcctattcctctctccctttaaggacatttagggtcccccctgtgaattagaaagttgcttgggtggagaactgccacccctacttattgatagcccaaaaaactcccccagtgggttgattcaatcaagatgtatgtagccctaaaactaccccaatagggtgattcaatcaagatttgtgctcgcagggggctgattcaatcaaaatgtatgtttgctatgttttaagtcccccttttttccccttcatgttagatggttgaacccctgtatccctttgaacccctggaagagctagtaaattgtaaatgaagta

SEQ ID NO: 705239 - DNA, 164 bp, Homo sapiens
attctactgtaaatatatgtgtgatctacacgatataccctaggaagccaacttgatatcatagattcagaccatacctttgtttccaatactggttctttttttccggagtagtacgttacaatatgggagattattccgaagcctggtcgtccaacctatat

SEQ ID NO: 705240 - DNA, 189 bp, Homo sapiens
attcgcggccgcgtcgactatattttttttttttgacacgaaaggccacatgatgatttttataaaaaatatagaacaggcaaatcatagatacagaaaacgggatattgtttatataggctgcgggaagatgaagattatagtggctcctcactggtatggaggtaataagtaaaatgaaacgttcgg

SEQ ID NO: 705241 - DNA, 121 bp, Homo sapiens
accaggaataggaaatagtctctgttgtgagatcgtccctgacatctgcctggcagactatgcaagatgaaaatgaatacttactttgcaaggtcgtcacgtaggaaacttgcttagagtg

SEQ ID NO: 705242 - DNA, 175 bp, Homo sapiens
acccccaagcagtcggtctgtgctctccctgtctctacggtcgctgacgacgacggtgcttttcttcactacacaacccttctggggtcttgactttccccacggacacgactggacgacactggacctacctcacctctatgggctctacactctttccccctctgaccccacg

SEQ ID NO: 705243 - DNA, 387 bp, Homo sapiens
gttacgagctatgtgaccgaggccttcggccatgctgtcggcgctatctgttctcgagaatgagcgtggacgcgtgcgagtgtcgcaggaacaatgagcagcgagaagagatgtcgggctaatggcccgggacgggctgtgcccatcctgcgacagaacacgttcgggttttggttttgtttcgttcacctctgtctagatgcaacttttgttcctcctctcttcagcttctgtacccatattcatgcttcgtcttccgcactcagcctgtccctgccctgtacatcgatggtgatgtcgctgacacacggaattacacactggcagtgatgccgccgtgagcgtgagaacgcgtgtccactacgagtgcgatgacattccagagcc

SEQ ID NO: 705244 - DNA, 137 bp, Homo sapiens
ctgttttaccattagacagcagagtcgagtgttagagtgcaaggatccagagcgtggagaggcttggcggagttgggggctggaggctggggcctggttacttggttgacgtgcacgagctctactctgtgggggct

SEQ ID NO: 705245 - DNA, 742 bp, Homo sapiens
ttggatagttctacaatgctgataatagcactatcgtgatttttgccattccccattgaaaacatctttttaggattctctttgaataggactcaagttggactatatgtataaaaatgccttaattggagtctaaactcgcacctccctctgtcttttccttttcttgtttcttgtccttccttccttttcttttctcctttaaaaatattttgagcttatgtgctgaagaaacgtttttcgtgtgggctttagctgacatgtgctttgcaaccagcaattaagaacaaagttactccttctggctattgggaccctttggccaggacaaattatgcttagaatctattatttcaagaaatatttgtgaaatgaacttgggcatctttaggagctaccagtgtgtctctgctctgacattgatcttcactacgctgagcctagttcctatagcagtcggaagcaagaacgaatccattcctattcatacaagagctaacgattcgcgagcagtcatactgtgggacgattgttgtgtgtgaagctataacgtgtaagcaatctccatgaaaaggcatcttgttctagcctttattcaggttggatctcttagtccatatgtatgatcctgtctgaacctgtcaacagagcatggagctagtctatttcactatagaaagatttttagaactggggtttaaagacagttttttggaacacctagtaagaatatgggacctcc

SEQ ID NO: 705246 - DNA, 607 bp, Homo sapiens
  misc_feature (578)..(578): n is a, c, g, or t
ctaaagccaactagaccgcaaggccttacctaaaataacaacaaactaactatactattctactctgacgctcaggatatggataacgttggtatattactgcccgccatcatattgtactacatcggactcccaacacttagcatacttaaataataggagaggtctacgatcccaccctttacatcaatcaattggacacctttggttctgaaccttcgagttaaaccaatacggcggattaatattcaaatcatacatcttcccccatttttcctagaaccaggcgacctgcgactccttgacgttgacattcgggttgttctcccgattggagcccccattagtatttttattacatcacaagacgtcttgcaatcatgggctgtccccacatttggcttaaaaaccgatgctattcccggacgtctaaacccaaccactttaaccgctacacgaacgggggtattataaggtaaatgatatgaaatctgtggagcaaaccaaagtttcatgcccctcgtactaggattaattacactaaaaatatttggaatagggaccgtttttaccctttngcaccccctataccccctaaagagccaaa

SEQ ID NO: 705247 - DNA, 141 bp, Homo sapiens
gttaacatgaccgaagcatgcatggtgcgatggtagccgacgtgtattcaccagctgcggtgcatggcttccctgtacaagttccggtcgacacgttgagcaccgtgctgacctccaaatatcgttaagctggcagcctgg

SEQ ID NO: 705248 - DNA, 468 bp, Homo sapiens
  misc_feature (19)..(19): n is a, c, g, or t
gggacacaaggcccacccntgagagacgctttttgcccggggcccccgtccacacctgcccggggaagcggccgcctgcccttgagacaatctccccggagaaggcaccttgagccgccgtttgtcccccgaataatgactccgtccccccagggcctctaagtaggaatctgacgggggaaggacaccggagccacagcgggacacgagggcgaccctgccttacatggaatttgggcttccaggcgggcgcagcagggaacccgggagctgcgggtgctcaggggattactgaggaaccaccggcaggtttggggagtagagaggcaagaggtctgcgcgctgttctgagcagttcggggcttcatctgttccaggaattagccattttggaaaacacccgtaaagaaaaaccactcatcgactacaggagcttccaagggaaaaatcaacctttatgagactctg

SEQ ID NO: 705249 - DNA, 1507 bp, Homo sapiens
  misc_feature (1247)..(1247): n is a, c, g, or t
ggctcccaggacgcattgtgttatttaacctaacgagaggactttggggcaggtgattaaactttatactaggtacctcaacgaccaagaacctgaatatgctgcacttttctattctttagccttttacagtgctacgcattatggctttctgcatataggttactcttatcgtgtaggactatactgcttattgaggagccccaactagacctgttgaaacgacactttcaaaaacttactctgtgtagcggactattagtactcccttacaaagacataaaaacttaacacaaaaactttacaaacaaacttgctgcaagctatctggccttcgaagcgttgcccctattagttacgaatacataccttatagcccaaagtacacccttgaggatggcagaacacatgattgttctatacacgcaggaccaactaactgctcctgaactcctttccttgatacaatgcctgcaattcctataatctccattatctccgatgtccatcccacagccagggatatgggacattacccgtgtattttacctaaaggctccacaggctttgagacacactccagtggttcaaccattaattcacatgtgtagatcacgcaccgacaaacaaacgacacacccttcacagcacaagacattgcgcacgacaatgtgacgcgaacgacctacaccacagtcgccatccactataaaacactgtgagtgtgataccgcatgcaaaaaacatacaagggacgaacagcaccatgagaacacctctatgtggggagctacattactaccgcagacaagcagacaagccccgacgggctacttactcaacacgatgttctataacccctaactaatattcacagccttacacccaacactatttcagatccgctagataatacttctttggacagcagcactatcttgcaggcagaaacagtaggagctcactatgatgacaattgggtgcaacacaagatcaacacaaaaccacccgtgggtggacgcaaaaaccacacgagccataatcgctgcacctgacgacacaccaccgagacagcaccaccattcgacactgggtgccagagcgcaaaaccacacctgacgcaaggagcgaccccaccacacaacccagaactgcgaggcgaaacacagcgagaccaacaaagaatgcagacagacaaagttgccaaacacacagatcaccgacacacaaccactcgcagggaaganaacacctaacagaccgaacacgaggaagaggcacccacacacagagggagcgcaacataacacccaacacaatcaaaacggagaggaccgactgggaggacatcagaacgactcatactaatccgcactacccagccgaacgaggagcatgcacacagacatagccggaacagaccgaaacgcacacacacgagagatacactgtcggagagaccgaatctgaccagaaccaaccgtctcgccaacaaaaaacagccccg

SEQ ID NO: 705250 - DNA, 486 bp, Homo sapiens
acgaatagggccaaatcaactcataactctcaggactccatgagaaagaaaggcggcccaaaaggggtcactggtgtcaggcctctgagcccaagccaagccattgcatcccctgtgacttgcacgtataagcccagatggcctgaagtaactgaagaatcacaaaagaagtgaatatgccctgccccaccttaactgatgacattccaccacaaaagaagtgtaaatggtcggtccttgccttaagtgatgacactaccttgtgaaagtccttttcctagctcatcctggctcaaaaagcacccccactgagcaccttgtgacccccccactcctgcccgccagagaacaaaccccctttgtaattttcctttacctacccaaatcctataaaacggccccacccttattctcccttcgctgactctcttttcggactcagcaccactgcacgcaggtgaaataaacagccatgttgctcacaaa

SEQ ID NO: 705251 - DNA, 142 bp, Homo sapiens
agggactactgagctctccactctgttacccgactgggccattcaacgcctccgggccattcaacgcctccggccattcaacgcctccggccattcaacgcctccgggccattcaaagcctccgggccattcaacgcctccg

SEQ ID NO: 705252 - DNA, 329 bp, Homo sapiens
tgttttttggtaaaatggtgattgtaaataaaattagttccctgatcccctgccccctgtcccctgccttttttcccaattcccttccttatgcgggacttttaaagcttaaaaaaaatccgattgaatataaaggcctaatttcattctttgtgaaagggttgcttcctcctgattccctaattgggcggggttggtgttttgcactggaattcaacattcccttttccttttgtactgggttgggcttgctgtttttcccggacccccttaaagactgtttttttagcaaaaaatttcagtaaagggttttttgtaatcttttttta

SEQ ID NO: 705253 - DNA, 309 bp, Homo sapiens
cccctatgcgcccgcaggacacgtgtccctggtctttaccctggctggtcgtgtttcggacgttgagctttcctgctatatactgcagcgtcaggacttagactatcctggcccgtcacgcctccctgacatggcctcctgtttggagccttcaggctcatgcttacatcctctagctgatcattaatctttgtgaccatttcatgctcactgctttcttgcctaggagctaatggctgaggacaggtctctgggaaccagcgcaccaacctcgcacgttgatttttttccagcctacggctcaatatc

SEQ ID NO: 705254 - DNA, 213 bp, Homo sapiens
tattttgatagggatctttttttctgaggggtaggtatcaataatgagcttaacatattcagcgagactgtagggtatacagatatgctgtcatccaggctttgttgttccctttatagaacacaggcagagtagatttcgcataattttttttttaagagacaagatctctctccgttgcccagattggagtgcagtgagccgaggtggagc

SEQ ID NO: 705255 - DNA, 633 bp, Homo sapiens
  misc_feature (178)..(178): n is a, c, g, or t
  misc_feature (183)..(183): n is a, c, g, or t
  misc_feature (188)..(188): n is a, c, g, or t
  misc_feature (191)..(191): n is a, c, g, or t
  misc_feature (212)..(212): n is a, c, g, or t
  misc_feature (226)..(226): n is a, c, g, or t
  misc_feature (228)..(228): n is a, c, g, or t
  misc_feature (230)..(231): n is a, c, g, or t
  misc_feature (237)..(237): n is a, c, g, or t
  misc_feature (239)..(241): n is a, c, g, or t
  misc_feature (249)..(250): n is a, c, g, or t
  misc_feature (288)..(288): n is a, c, g, or t
  misc_feature (294)..(295): n is a, c, g, or t
  misc_feature (299)..(300): n is a, c, g, or t
  misc_feature (308)..(318): n is a, c, g, or t
  misc_feature (332)..(332): n is a, c, g, or t
  misc_feature (360)..(360): n is a, c, g, or t
  misc_feature (364)..(364): n is a, c, g, or t
  misc_feature (369)..(369): n is a, c, g, or t
  misc_feature (387)..(388): n is a, c, g, or t
  misc_feature (391)..(391): n is a, c, g, or t
  misc_feature (393)..(393): n is a, c, g, or t
  misc_feature (403)..(403): n is a, c, g, or t
  misc_feature (412)..(412): n is a, c, g, or t
  misc_feature (430)..(430): n is a, c, g, or t
  misc_feature (435)..(435): n is a, c, g, or t
  misc_feature (506)..(506): n is a, c, g, or t
  misc_feature (607)..(607): n is a, c, g, or t
acatataaccatcaagataccttgattataatttataggactagaatgacagattcaggtggtttattaattacatttaaaaagttttctgaaaaaacttttgcaataaaaaaaaataaattgcccatcaataagtttgatatcttttaaaatgatttttggttatctgcacatgaancaaanaaagngtnttccacaaaattctttaggcncagtctggtaaganancnnccacanannncagaaagnnttgtcatttatctcttgtgagtccaatttctgaaagcngaatgnnggcnnccctttcnnnnnnnnnnnggggtttactgttntctctttttgcttcatggcagttctgcngggnggggngggttgtttgttgcacannatnantctgtagtanatactgttngtgctctgttttcttctnctggntttttggtccgtcgcatggccttagcattcatttctgggaactgctggcaggcaaacagggcaggaccagnggctaacccgggctttagatcagctgatgttggtttgcccatctggtcagaacacggggggcaagtccaatacatcatctattagctgaaaagctattccnacattttttccgtactggtaggcgat

SEQ ID NO: 705256 - DNA, 140 bp, Homo sapiens
tgccttcatacgggaaagcctaaaggaagaccccattgaaaaatttgagaatcttgttgaacgctaaacccatttgcaaagaccatgcgcgggaacaccatttttcgccaggccaggaatcacaagctcgggttggttaa

SEQ ID NO: 705257 - DNA, 369 bp, Homo sapiens
tccacagttttgccttaaaggcccttcccaagtctccctttccctgtttggtttttcccttaaaaaaaaaaaaatacttgtagaattgggtggggggaatgagcatgaactgtccttccatttgggatatgttacattagagtgagaaaaagaataaggagccttttttatggaagaaatgggagaaaaaagacagggtttttttcagcagagtttagtagtttttttgtaaggcaaaataatttaaaaagactaacctgccccccccctccttatattgttgtgagattgcccctattttgtgtttttttgtttgcagggggccgggccttgttttaacccggaataaaggtgattgattgtattgca

SEQ ID NO: 705258 - DNA, 854 bp, Homo sapiens
ggccaatcctatgagaactcagcatcccagctcatctggaacagatcctggaagtgatttctgcagctcaggattcgtctgtaagctacatggcaaatatagtgttatcttggttgccaggtttgctctaatataatgctctgcgcaaaggaggaggatttgcacttcctcatatcagaggccagcatattaaagccagttaatgcagaatctagctgtgcgtggattaaagccgtatatctcactgccaaaccaaaggtgcgcgggcgcgctgggaagggaagcataacctgggacaatggatagctggtacaagaccggcctctgctcctttagcgatctgctagaaactgtctatacgaccttgtcaaatagtccatctcgactcgcgtggtggactccacctctagagagtatagcctgcatccttcatccctaagtccaccccagcgatatgcttctcccaatctccccgtacctccgtatcccgttctcttgctgcaattctaaaaggctgtgactatgttccagccatggatcctgttgggacgagaccatacaattagcttggagcaaccctggccttaagatagaggggctctgggagaccttgacagaccagtcctgttttgcacgggcaagcccccacttgaaggaagaagtctaacgagtgacacgtacgtcgtgactggaaccttagatgtgcctgcttcctccttcgttcttgcggacgacaaccatttggggtgacacttgagcgcgttctccgcaacctcgccgattcataggccccggctcctagcatgaaccaggtaggatccacctgtaatctccgcccggtaggacccgacggt

SEQ ID NO: 705259 - DNA, 760 bp, Homo sapiens
taaagaggaaaccccggtaatgatgtcggggttgagggataggaggaaaaggggggataggtgtttaaacatgagggtgtttcctcgtgtaaatgagggttaatgtggtaaatggtgggtggggtgatgtggacccccattggttgttggtgggtcaacattactgtcagcagggatgtaataagggtctggtgactaagttattgtggagttcctgtaaagtaaggaagaggttgtattatttggatccaggaaacctgtggtgttacttaccacagagagtttctccccagctaggttaaacaagtggggggcgtcagagccgcgaaggttctaacgggcgaaggttcctgccctacaacagctccctcacacaaaagctctatctaaggggggaaagtccagaagtttggaatctcctctttgaagaaaggagcggtatttcatgcatcgccggcaccgtggtgcagtgtcgccgctccgcgacagcttcgagcagattttcgcctaagggccagaacataactcaaatggcgcgcgactctgtcaacgccccctggggggccccgtattcatttgaaacatctgcgcacctggcccccttgtgtagcaccactctcctacaacgggggggttctgcgggatcgcaaacattggcgctgtgtccacatacccgagggcgctattgcgcgcgctcgctctccgacacacgtctcgcaactcgcgcgccactctcaccgctccggtccgcgcccctcag

SEQ ID NO: 705260 - DNA, 167 bp, Homo sapiens
tatgccgaagagtagaggagttgttacctgggctatgtagtagcctcatttaccatcgttagtattactgaccacatatgctgtcactgggaaagaagccgtttcagctgcctgaacgcagttgggatgtctttgaggacagacattgcccggaaactcagtctatt

SEQ ID NO: 705261 - DNA, 787 bp, Homo sapiens
agcgggggggcgctcgcagtggccgcagcagcgcgccgtggccctgtgcggccccagccgagcgcagcgcgggagtcgccccgacctttctctgcgcagtacggccgcctgggaccgcagcatggcgcggcatcgctggccaagctggcgaaggaccgggaggcggctgaggggctgtggcttcccacgagagggccatcaagtacctcaacaggactacgaggcgctgcggaaacgagtgcctggaggcccggggacgctcttccaggacccgtccttcccggcatccccgtcggccctgaggcttcaaggagtttggggccctaactccagcaaaaacctggggcatcgagtgggaagcgccccacggaggatctggcgctgaccccgcagtttatcattggaggagccagccggacagacattctgccagggaggccctaggtgactggctgggtggctgggcaagccattggccttccctcacctttgaattgacggaaactccttgggtcgagtcgtccccccctaaaccaggagcttcccgggaaaaacttatgcagggatctttcacttccagttactggcaaatacggcgagtggggtggaaggtgggtggtggatgacaggctggcgccacccaaggccgggggaagcctgctctttggtgcattccagccggacgggagcgaagtctgggagccgccctggttggcgaaggcatcgaccaagaatcacggatgctatgaagcacataccgggggtgccaccattgaggttagaagag

SEQ ID NO: 705262 - DNA, 255 bp, Homo sapiens
  misc_feature (34)..(34): n is a, c, g, or t
  misc_feature (49)..(49): n is a, c, g, or t
  misc_feature (80)..(80): n is a, c, g, or t
  misc_feature (97)..(97): n is a, c, g, or t
ttgtttggcttttatttttattgggggtggtaangaggaggcgggtttnaacaggagggacggggagcttccttctaaanctttccacataatgaanttaattatcatttcttctcttcaaacatggatgggtccttcctaagaagtgccaacatcttcttgggatggagctcccaaaggagggggcaggctgccatttttgcgggggggggtaccttcactggggagacatccagggactggaaaattcgaggg

SEQ ID NO: 705263 - DNA, 443 bp, Homo sapiens
  misc_feature (202)..(202): n is a, c, g, or t
  misc_feature (234)..(234): n is a, c, g, or t
  misc_feature (300)..(300): n is a, c, g, or t
  misc_feature (335)..(335): n is a, c, g, or t
  misc_feature (341)..(341): n is a, c, g, or t
  misc_feature (372)..(372): n is a, c, g, or t
  misc_feature (392)..(392): n is a, c, g, or t
  misc_feature (416)..(416): n is a, c, g, or t
  misc_feature (422)..(422): n is a, c, g, or t
gtgatacatctctgcactttcagtattttccaactcatccttaaattccttctcacaacagtgtcaagagcctggacgccagccagggattgaggtcctacgggtgtttggggacctccccaagcccacgagtatcaatgggcagtatcaattgtctgtgacagtgattaagggagcaaaacacttgggaacccacaaggantcccagaaggtgaagttaaggagctcccagantcataaggttatttaggaacaggcaaactgggcacccccaaagaacttttacggggagactttggnaacctattcaacaagtttgggatggagggggtttnaaaggnttttcaaccaacccaaccaacccccaaggcnttcaaacttgagggggaacnttttttaacctttcacagacagtntggganggttgggtgggggggccgggg

SEQ ID NO: 705264 - DNA, 616 bp, Homo sapiens
cccccttgggtgggggccccgggactggacctgtagtgccacctcctggggtgtgcggagaggcgctccggtcagccagagaagctggtagtcctgggcaggcttgtgtgtacatgtgtgcatgtgtgtgatgcatgtgtgcatgtgttcatgtatgtgatgcctgtatccatgcgtgatgcatgtgtgcgcatgtgtacatctgtgttcatgtgtgtgatgcatgtgcacgtgatgcatgtccatgtgtctgttcatgtatgtgatgtgtgatgcatgtgtattcatgtgtacatcagtgttcatgcgtgtgatgcatgtgtacatgtgtgatgcgtgtccatgtgtctgtgttcgtgtatgtgatgcatgtgtgcccacacgtgtgatgcatgtgtccatgtgtacatctgtgttcatgtgcgatgcatgtgtgtccatgtgtacatctgtgtgatgcatgtgtgtgcaaccgtgttcatgtatgtgatgcatgtacccatgtgtggatctgtttcatgaatgtgatgcatgtgtgtccacgtgtgcacccgtgttcgtgtgtgatgcgtgtgtgtgcacacacatctctgtgtgtattcctagcactcatagc

SEQ ID NO: 705265 - DNA, 130 bp, Homo sapiens
acggaggctgactagaggacccgaccaaggcgcagagagtgaaattgcagagaatatattaggtgattaaaatatttgtatagaatttgatacaggaatgagaaagtatagtaggagataaatttgaaag

SEQ ID NO: 705266 - DNA, 729 bp, Homo sapiens
aaaaacattccagtaacgaaagacatggtccgtgtgaagagattccagaataacactgcatgtggaagaagttgttccgagtgtaattggagccctcctttggcttggcagggatcatgtataccatattggaacatacattccatgtccgagagggagatgaacagagaacgttcttcagtttccctgctgtggttgctccattcaaatgttctgtccttccactgagccagaaccaagagtttatgccatttgtcaaggaattatccgaagctctgaccaggaacggcgtgtctcataaagtcgatgactcctctgggtctattggaaggcgctatgcaagaactgatgagattggcgtggctttcggcatcactatggactttgatacagtgaacaagacgccccacactgcaactctgagggaccgagactccatgagacagataagggcagaggtctctgagctgcccaatgtggtccgcgatctgccaacggcaacattacctgggctgatgtggaggccaggtacccactctttgaagggcaagagactggcaagaaggagacagtagaggaatgagaacagctggcagcttatgaccatcgtgctaataaataactcatcatgtccactacacagagcattgtgactgcatccagggacggtttttcctcagtggctgcttggttttactcccacaattaaagttgaaggaattctgaaca

SEQ ID NO: 705267 - DNA, 147 bp, Homo sapiens
tccccagcctttaccccaaagccctctttccccccaaaaaagcccttttggtttgccgagccccccttttttcccagggggtttgaccttgcccaatttgtttcccagggccagcccatttattttaattaccagggcccccctcca

SEQ ID NO: 705268 - DNA, 1236 bp, Homo sapiens
  misc_feature (324)..(324): n is a, c, g, or t
gatggccgtgagtgtctcagatgaaggttctccgttcccagagatgggtccctcggtttcctgtctcgggagcgcaccagagaagcatcgtgggagggtgaacgagcttctcctacatgggtgacccagtgcacagtccggtggcctagtcgtcgaccagacactatcctgggtgcataggcaagggcttggacatagacgtcacatctgtgacgccgtgaacggctcgaacatggccggagatcctacaggtgacacaagaaggagagtggtggaaggcatgctagatcagttgtaaagacagtcaggccatgagaaggctcngattgagggcgattgcttgtggacataacgatgaggaacagcgcactcgttcgacagggcacttgcgcgagaactcctctcacacggaggtgctccttattgcatagtaggctactagtgcaacgcttgcattggacattcgcacacgaaaggacgcttgtacatgactgaacgtagataggagacaattccagtctccccgaaagaagggggccttttcgatcccaaatgtcatgtggcacacgtaaacagtggtcaccggactgacgcggactgggccaaagaaaaggcagttgtggacgactcgagagctctcgaggaccaagtagttgactggtagtcttagcgtgacccgaaagagtcaagtcgcggtggttaccagtttcgtatcggcaaactaggtcgcaaaggtaaatggctgaccctttgacatttacattccttccgttgaagtaggcaccagagcaaaacgtacaatgggcgcccaactccatatgacaatcgcggaatggactccccaaggagattggaaccaggaagacaggggaaccatgaatggaagtcccggactcaaattgctttggggaggcttggagggcgccccccagcggcacgcaaggcagccatctcgacaggccaaaggcaagcgcagcgttaacacccgtcgcatggtaaacagccaaacagggagagctaacctggggacgccaacggggcaccatcgaccagcacgttggaaatcaggaagacgggatcacgagctcacgggcggggagataggagccccacacaacgaggggaccactagagcggcgctaagcaagacacggaaggacggattcaaaccacgaaggagacgggctcacgagcacgacacaacccacaaggatcataggccattggaacccccgg

SEQ ID NO: 705269 - DNA, 135 bp, Homo sapiens
  misc_feature (57)..(57): n is a, c, g, or t
atgctatagattctctaagtcagctggatggcttataaaaatcagctatactcggcntgggtgcacgtgtgactcacgcctgtaatcccatcactttgggaggccgaggcaggtgaattgcttcagcccaggagt

SEQ ID NO: 705270 - DNA, 877 bp, Homo sapiens
ataggctagtacgaggctggggttaatcggacgaggctagcggaaggtcctctatcccatggcctcagtgtcatctcagcagggtcttgtgccagcctcaggaggccctggtgctgtccttccctcatgagaagctacggcttatgtccacagaccaggaggagctgtcacgctggtaccacagctctagagttgggctatcagtagccagaaaaagtagaggaatcttatagcattccagaactcaggatacctcagggataggtccgacagccgaagagtacagaggaagtcttcagatacgtgaacaaaagcagaacccttacatgatttgacaataggtcactttctgtttgcctggaccaggctactccagatcatctgaccagctcttaaaaatgacgggcaggcacatgtggctcatgcctgtaatcccagcagttggggaagcagaggtggcaggatcattccagcccaggagttcatggacagctctgggcatgcacaatagtcgctcaggaagaggtcgtgcgtggcctgcgtgtgtgggggagagcagtcaggaagtgttccagtgttcagagactttgtgtccaactccagcagactcgacctcccgagccttcacctggttcgtgaagcctccataatccttgtgccgggtggcttatcgttgcagacaggtcgagggaagtggtccagtagccttcaggtgcacgaagcgtccggctgggggttccagacccagaggagttcacaactgagaagaaattgttacacgtcagtgggggtcccaaccgttattgttcccccagtttcctaccctcctggccagaaaatttccccaaaaaatttcacacgaaattcattgcgtccc

SEQ ID NO: 705271 - DNA, 102 bp, Homo sapiens
taccagaatatgatctgtgcagtgtgtgacttgacattatgtaatatgaagggatggctacgtgttccttttccccagttgatatgtatttaagctgtttca

SEQ ID NO: 705272 - DNA, 1267 bp, Homo sapiens
tatcttgttggatctctgcagggcttgtgttctaatagtacatcatcttagttcgataggatgtagaccaaagactagtcgttcacatccatcagtaggaatgagctatgcaatctatggcttttaagctgtgcctatcacgtcctcttcctgtcgacccatttatgaacgagctgggcaggaagcgtatgcaacgttcaacgtctccgtcgtgtcaaatatccacagtataaggcccaggaacttctagaataacccagatgcgctttaattgtactttacatatgttttgatcacggtaacttctagaataacccagatgctctttcattaattctttgtaactaccctcttgcactcaacagcctgcgctgggtgaaaaacatagtctcttttaatttctgctaccctttccctacgttagattaacggtgaaagacgcccaggcgaacacgacgaccttttaaactatcttttgctattcaaccaacaaaactttgttggaataatagtctctctattcacatacatgggcgagagtatctgcacgaaataagagtcttttcgccttgagcctcctcgcgaaggcaggctgtccgcagcgctgtgacggccagagtatctcagctgggcccaatgatgaccctttgttcaacacagcggtcttagccagttattactccagtactgtattttacacggacctgtaaatggttggtacatttgaaacaacgacggtaatcagaccccaattgcttgacaaggagcgacacgacagaaccgaacactcgactttgacacgcactcggctctacttagcggtatctacgcaacccctccttcttcttttgacccagcttggggggttttgcctcacttcttctcctagggaacttctatacgcgttacctttaggagggaacccgagagctctctaggccaacttcccctcttcggggtctacacaggaactcctgggggggaacaacacaacagtaccgcacgtaacaaccatagaacgaggagacgtgtcaacacaaccccacacaatgacaccaagcacggacacaacatagcaaccaccaaatgacacacagataaccaactagcaggtcgcacccgaaccactagtacaacagaaacacccacagaaacagacatctccactgacaaaggaagcgagaatgcagaacaccagtgatcagcaatcaacagaacttgatcacatagcaaacagctaaatagtcaagcctaaggaacatgatcc

SEQ ID NO: 705273 - DNA, 183 bp, Homo sapiens
ccccttttggggcttttaaaaacccgtttttttttttccccttttcccggtttttttcccaatatttttttttcacccctctttaagggtggatttggaaaattttttttttttttttttaaaaggggtgccacaccttttttttttttggaaaccccaaaaaattttttttcccctttggga

SEQ ID NO: 705274 - DNA, 384 bp, Homo sapiens
  misc_feature (1)..(1): n is a, c, g, or t
nagtcacgagtaggcgcatcgactgagcctgagaggatgaggagtcctcagaacacggtgtctcaggttgctctatggggcaggatgtagggcaagagggtgatgaaccgatgtatctcatggcatggcccaatcaccctgtcaatgttcatcatgcagcgtctatctgttctaaggagtatttcatcagtatcagcagcccatgttttagaggtgaggtagtggtctctgtcagcgcatatagcgtttcggaggcagtagcggtgactccgtccattgtgtacgagtgctctacggtgtgcttttccatgtccatttacacgaacagtcagtctctcaggtcccagggacagtggtgctacagaagttcagggtgctacttcg

SEQ ID NO: 705275 - DNA, 156 bp, Homo sapiens
  misc_feature (16)..(16): n is a, c, g, or t
  misc_feature (69)..(69): n is a, c, g, or t
ctagaggatctgtgcntccacttggttgccgaagtgctgtggagtacaggcatgagcactgtacccagncaaatgataagctttctcacaaatcaacagcacttttggaaactattcttgtctcaaggctattggggtgctggaaacattttcctg

SEQ ID NO: 705276 - DNA, 111 bp, Homo sapiens
ctagaggatcgcgtaatttctgcttgcaccctcggcgattcatgggtggggtcttcaagtgtcagcttacatagcctggggcaggagagaagatggagtgtctcagacact

SEQ ID NO: 705277 - DNA, 346 bp, Homo sapiens
ctgtttccctaatctttcctttccctcctaatctcgtacatcaagacatcctcaatcaggtgcagtggctcatgcctgtaatcacagcactttgggaagccgaggtgggaggatcacttacgccccaggagtttgagaccagcctgagcaacatagtaagaccctgtctcaaaaaaaaaattagtcaggccttagtgctacttgagtgacacacgcctatagtcccagctacttagggagctgaagaaggaggattgattgagtctgggagattgaggctgccatgtgctataatcttgccactgcactccagcctgggtgacagagtgagaccttgtctctaaaa

SEQ ID NO: 705278 - DNA, 427 bp, Homo sapiens
tggctgggacattccagatcatggttcctggagagttaggggtctagttgaggagcccacgcttctgggttcatcgtcttggattctcaccggatcgcttcgctggctggacggagcgcggtgagctctctggagtttgtttgagcgggccttggtcgccatccataagggctctgccctcataacctaatcacctctcacaggccccatctcctaataccatcacatcaagggttacatttcaacataggaatttgggggagacacacacaaacattccgtccataagaggcatgaatcccaacttttgaaagagggtcactagatggaagtatgctgattggtgggacagagcagaagcagccacaggggaggaggctgcagcagaggtggcaactggtttgccgaagcttgatcacggggatcc

SEQ ID NO: 705279 - DNA, 281 bp, Homo sapiens
agtatgaagaatgatgcttttggtgcctgggcgccaggaccgattgctttagaactttgctgacgctccagctgcaattgtgttccatgtgatcacagatactgaaaacgcagcttcagaaccagtgtgaagtgatgtacaaataagtgcctgccctatatctagtgagcaggttgtggcaatcaggaagggattgatattttgatcccatcctgaggcatggagtgtttttttgtcgaagcagttaaatgtgtcattaaaaaacttatttaatcttcgta

SEQ ID NO: 705280 - DNA, 591 bp, Homo sapiens
  misc_feature (327)..(327): n is a, c, g, or t
  misc_feature (331)..(331): n is a, c, g, or t
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctgggtgacagagcaagactctgtctcaaaaaacaaaaaanaaancaacattcttttatccagcactgtggttagaccttagattgaatttaccccttttgagttcccaaaggccgacaaaaacaagtgtgagaatctccagaggattggccacgaaaacatttgtgcaaaagggaccttaaggggaaattgattgtggatcatccgtgtaaaagggtaaaagaattttaaaaaccttaacacttcatttcccctttaaggctcttttttggtgggttggttttggtatttcagaatggagtctt

SEQ ID NO: 705281 - DNA, 221 bp, Homo sapiens
  misc_feature (213)..(213): n is a, c, g, or t
cacaaggttcacagacagcccccattacttcagtgaagcccaaatttcatcctcatctgttagtcatactcccgttcaccgttctcaactactcatacatgccctgctcttctttacactgccggtttacactgtttctccaagacatcacagctgatatctcctggtgctatccccaaactgccactctaaactcttgaagtaaataaatcncccccccc

SEQ ID NO: 705282 - DNA, 505 bp, Homo sapiens
  misc_feature (327)..(327): n is a, c, g, or t
  misc_feature (331)..(331): n is a, c, g, or t
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctgggtgacagagcaagactctgtctcaaaaaacaaaaaanaaancaacaaaatacaaaaattgtcggatgtggttgtgcatgcctggaatctcagctagttgggaggctgaggcatgagaatcgcttgaaccccagaggcagaggttgcaatgagtggagattgtgccattgcactccagcctgggtgacagagcaagactccatctcaaaaaaaggc

SEQ ID NO: 705283 - DNA, 399 bp, Homo sapiens
  misc_feature (327)..(327): n is a, c, g, or t
  misc_feature (331)..(331): n is a, c, g, or t
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctgggtgacagagcaagactctgtctcaaaaaacaaaaaanaaancaaccaaaatattagccaggcgtggtggctggcatctgtgatctcagccactcaggaggctgaggtga

SEQ ID NO: 705284 - DNA, 427 bp, Homo sapiens
  misc_feature (327)..(327): n is a, c, g, or t
  misc_feature (331)..(331): n is a, c, g, or t
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctgggtgacagagcaagactctgtctcaaaaaacaaaaaanaaancaacggttatgtcaggtacagtggctcacacctgtaatcccagcactttgggaggccaagatgggaggatcacttgaggcttcaggggtaccgagc

SEQ ID NO: 705285 - DNA, 392 bp, Homo sapiens
  misc_feature (327)..(327): n is a, c, g, or t
  misc_feature (331)..(331): n is a, c, g, or t
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctgggtgacagagcaagactctgtctcaaaaaacaaaaaanaaancaacaacaacaacaacaacaacaacaagggatgtaccagagcactactttcaaagattgat

SEQ ID NO: 705286 - DNA, 924 bp, Homo sapiens
  misc_feature (226)..(226): n is a, c, g, or t
  misc_feature (288)..(288): n is a, c, g, or t
cttcttcgaaatccacacttatccccaccttggccatcatcatccgagtgaggccagaccagccagaacgcctgaacgcaggcgctagtacattccctaattcgtacaacccctaggtaggctccctttgcccactacgtcatctgcacataaatttacatctctacgaatcgaccctagggcctcacgtagaactaattcttactacatcatcgtcttcaactgncacaatgaacatatctagaacttgctcgtgaggccaagcatacgttagatagtgaactagcntgtacggcaatagccttttatagtatacacgaaataaccctgcgtgttagcgggaccgtcgcagctttagttgaccttcctcgtgaatagaccacatgttgggataggtcccacccaatcgtcatggggtcaagtagttaaccttgacccgtcgggattactccttagaagactaggggcggcatgatggggtataagtaccgtcgcatcgaacaacttcgatttcttcgaaacgctcccacgtgaactataaaaactatcaataagcacatatcggcgcttttcacatttgttaggataaatcaccctgagttgatggcgattgaactttattataaccagaaggtcttgccaattcggggcgcattaacggactagaatcggagagcctaagatagtccgcttcaatgtgctattagctccttcgagatttcagggccaacgattagccccgtgcggttgaggtaaggcaggtcgattcgtcgagtaaccaaaacgccccgcgtgtagaaggcgttccatcgcgggctggcgaggttccattttccttcaaataaatttccggtcccaccgggggcttaacgagtccttcgatttacttgatttcttggccttaggctgagacttccaaaattt

SEQ ID NO: 705287 - DNA, 131 bp, Homo sapiens
tgtattgtgtgacctattgaatactcaatgctatgcttccaatgcgttgtgagctctcccatattgtctgacctgcaggctgctggaattcactagtgattgaatgtgggagcatgctgagactccttctc

SEQ ID NO: 705288 - DNA, 527 bp, Homo sapiens
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcagatttgcaaagcactctgggctaaagatatgtggtaatcaattgcatgtgtctccactcacgccgttataaacagctggcaggtccctaaataatataatagcctctgtatgtcatgggcttcggaaggtacgagtcgtcgagcgggcatgatctccttctttacagtgacacacagctggcgagtgtcgccaacctgagaggagtccccgaggcttcgctgcctgaccggggactcctcagactcac

SEQ ID NO: 705289 - DNA, 1003 bp, Homo sapiens
cctggtttctgaccggcgcgcacctgtgggctgagccgggtgcgcgcgggggtcgggtctggaactgcccttgaatcgacgggatttctctggctgtcgtttgctgctgcatttatcctgaatacatccagctcgcagtgcatcctgcaagaaacggtccctgtgctcgctgtgtactgcctgacacctctgtgcccaacgcagtgactcgatggtggtttctatgtgccctggtgtggctgcaagtctgccctccgaggggaggctggacaagcgtgtgcccccaggtcgagcggcctctcgctgcctggcagttgcctggcaggcccccacctctgccagtgcttcggaaaccctgcctggccaggttcgcccgcggtgacaaaaatgaaagcaaattccccaacagaggtagccggaactttcctcgacgaaggctccctcctgcgcctgtgtctggagaaaaccccagagcgctgcgagttagcaacgcagagattcgatgtgcggctctggaatgcgcaacggaatggtggctgctgggtggagcaaaggaaggccacttggggtgacccagcctggtcccggggttgaaaccgctagaagaaagggcggccatcggacattccttaataacaatgcaaagctccctcggccccgaggaccggtgagaaagtagtattccaaaggctgggcgcgggacgcaccagggagtgaggtaaggcagagaatcaaaactggggcgaaacgaaggcaggcgtatgggaagaaaggcatgccagaagaggaattaggccgagtcgaaaggcggtaccgggcccgggcgggaggccagtacaggagaaaacgcatgcgagcgaacaaggcgacacagagggcccatatgggggcagagacacagggagccacgagaagtaggccgatggggagaacgccccgcagagcacaaggaacacccgagggccgtccacataaccgagcgcccagcggcgaacaaaagagg

SEQ ID NO: 705290 - DNA, 356 bp, Homo sapiens
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctgaattttgaggttcaagtaagttattttctctctctctctctctctcctcttcctctcctccttctca

SEQ ID NO: 705291 - DNA, 356 bp, Homo sapiens
ggtcaggcactgaagcctggtcaggcactgaagcctggtcaggcactgaagcccggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggcactgaagcctggtcaggctcttggctaggtcggtaagcgtgttagccgtggtcgttcagcttcccttgctcgatcttcacactccgaggcttcagt

SEQ ID NO: 705292 - DNA, 519 bp, Homo sapiens
  misc_feature (300)..(300): n is a, c, g, or t
ccatgtagcaagcgggtctccaattccggggctcaggcaatctggcttgcctgggcctcccaaagggcggggataagaggcatgagccacaaggacgggccttatatgctatattcttttacaagtcagaattttactagtgttttgggcaaacgtccttcaatagcatgtgaaaatgatattaattggctatccataatttttcctaataaggtaagtgcttcaggaagtcctttcaaaatgaagtatttttccatagtggaagtggtatctggtcctatcaaaataaggagggttggnaattttcacagcaagtaagaaaaaggccataggatactggaggacgagtccagagttccaggtttggcccctcaattggttcacaaaccagcggtgtgatctggaaaaagtgactatgtctctgaagctccatttctttacggaaaataggggggtctacaatctatgattctagtcaataactgccatttcactacacatagatggcatctcctttaa

SEQ ID NO: 705293 - DNA, 248 bp, Homo sapiens
actgtactcgtccatccggagacagttcagccccatccccttcctaaaaaaacaagtatcagtggaactttcatacatggaagtggatgtttcgaacagcccttttatcagctcccactggagattacattggcaagcagcaagaagaccctgtgtaatgaaatgaaccccctaactggcttacggtgtagctcgagatttccaatttccatgcatgggctataacaggcctggctacctgctgaggg

SEQ ID NO: 705294 - DNA, 187 bp, Homo sapiens
  misc_feature (34)..(34): n is a, c, g, or t
  misc_feature (100)..(100): n is a, c, g, or t
  misc_feature (119)..(119): n is a, c, g, or t
ataccataccagcgctccaccaaaacacagtcangctgctccatagccccagctgatcccccggacacaaactgagttgaacaggtagagacaccatggnctcctcccagctggcaagnagccacccccgaaaccacctccatagctggcagaggagctctgcaggggggggctgctggctcggggg

SEQ ID NO: 705295 - DNA, 688 bp, Homo sapiens
ccagttcctgggtgcacacccatgaggtccccttctcgccgtccgtcctgcatactgtcgatgggtagcccggggccgtttgtgagtcgcccggacctgagaggctgctgcactgggcctcagccagccctccggatgctggtgctgccatcccccttgccctcagccttctggcgatttgtcctccgttgagagccattggagggcccgtcccctgtcggacgttgccgctccccagaagctggaccttcctcctccatcgtgatctccccaggcttcatctcctccatgggccaaccactatcctgcttattagacactcagggtgtcccctacagcagtagctaggtggacgagggagtcacagagggagccagtgggccatgtggggctccatggcccaccaaaaagtgctacagactgcccctgtgtgctcaaggggtcttcgatgtacatgtcctaccttcagcagacacagatatcacgcgcactcggagtgtaaagcccgttcgagtgtgacatctgtggtgaaggcgattcaagcgctgccagccacttggcacggacaccattccgattcacctggcgggtggtgggcggacccacggcttgcccgcgtctgccctcgcacgttccggggatgcgggtgatctggccatcacagtcgggtgccctctggtgcactccc

SEQ ID NO: 705296 - DNA, 1433 bp, Homo sapiens
gcggagtgcaggcataatttctgtgttgatatatctcttttgtctaatcgtagtttgtcccactaatctatcctgatcaagtgccgttctcagaaattgcgggtgtcttcaaggttcttttttatcctcctaccccacatatgtgggcgtgtccatcatacactaggggtgcacacatagggggcattcattcaaaaggggtctcattgcgggggtcataataaggaaatttttatatttgacacgcggaccacgcggggattgtgacccccttggtgctccgcccaatgttggggtttgttccataccggggggagaacaccttaaaaaccctttgggggatatctccaaccccaattgggacaccttgtttaaagcccgttctggaaagggtattgatatgtcaccaagtgtcctggttccaaaccaggggaattgtatgggattgttcaaagcccagtttctgtgtgaagatgatagccttcttttcccccacacagttgagtttgatcgcttctcctataggagggcccctttggggtaagaaaaggtatcatccacgccattcactttgttaggtaagaaagtgtataaaccccgtgtttccccacaaggccccacggttcttgccaaaatgtttctaaaatggtgtttgtgccacggtggtttaagaaaaatggtgttgttgccacaaaatgaacacatgtcccgagtttaatcccccggagtcccacatatatatttctcccctccaactgagagaaaacattttaatgagattcttcttttaaaagtttttcgtaaaaagacacatgtgaattttgtctaatataggagcggagctccccacgggagtttttacctaatataattatgaaattatagaatgagagccacgcgtaaggcttttctctttttttctccacaaatgtgaaaatttcacgccacacaaatataatacacacgggattcttgccccaccccacgagagtttttgaaattaacactccactgtgtgagaaaaatttatgccacgtaatgtgcttataatgaaaaaatttggttcacgggaatataaatgaggcacgttaaagaataataaaccacacttttaatgcacatgctgtgaacttaagttctaatggagatttatattgccacacaaattggcttagtcacccacatgcacgtgtctggtatttttaaaaaatgtggttcaaaataaaacactaagtgagttataaataacactaaataagagaatgagggtggtaattacagttaattcctaaataaataagggaataaatgctgtttaattgtcacagagaaaaagtaaaaatcgtttttttcaaataatggcccttttattttgggaccaggcttttattctccctgattattatttctatttaataactcttttctctcca

SEQ ID NO: 705297 - DNA, 184 bp, Homo sapiens
  misc_feature (45)..(45): n is a, c, g, or t
  misc_feature (110)..(110): n is a, c, g, or t
tgggcaggagcgaggtcttgttccgcttcaacgagggtggtctcncaacacgtgcgcgcagcctgtacatcagggacttgctttagttttttgagccgcggacatgcccncgcattgcttcccgcagagtgcagagacaggaagctggagatttccttttaagtcacaccccttcagacttcta

SEQ ID NO: 705298 - DNA, 85 bp, Homo sapiens
gcggccgcctactactactactactgctcgaattcaagcttctaacgatgtacggggacatgtgtaaggagtctgatcatttagg

SEQ ID NO: 705299 - DNA, 697 bp, Homo sapiens
gccaggttgtgaggaacgcagcgcgccgcgaggaccgggccgtgagcctgcagccgccccgggccgtgacctgcgacctagaccccgactcccttggctcagcccgcgcgccccaggcccggtccggggggcgcgacgggaggatgagcggtgggcggcggaaggaggtagccgcctcatccgcagctggccaacgggggccctcaaagtctccgtctggagtaaggtgctgcgagagctgatgcggcctgggaggataaggatgaattttaagatgtgatctactggttccgacagatcattgctgttggtcctgttgtgtcatttggcggaggtttatggacaatttagcagatgggttctttgggaagtaggcaggatgtcttgtcctgaatccatatgcaaggagttcttgttaacctctaactttggagcaaatataactctgacaaggaagttgatgacgcgcaccggaagtattgcgtggccagggtaggtgcagcattctacagacacgggagagggttctaagtagagacgtgcttatgagcccttgctctgatgtggcactttcggatcaatcattttccgacctggcacacctcgatgtctcgacttgaatgcgctagtactgggcttgcgacattgttgctccgctaatacccagtctcaattggaagcccgtcgttgcatcaca

SEQ ID NO: 705300 - DNA, 204 bp, Homo sapiens
  misc_feature (66)..(66): n is a, c, g, or t
ctcgtgccttggaggatggagacagagattggagtgatgcatcttcaagcctaggaacactaaggnttgctggtaatcaccagaagctggaagaggcaagaaagtgtcctttcctagagccttcagagagagcgcagcctgccaacaccttgattatatgcttcaagcttctagaattgtgagagaataaatttctgttgttat

SEQ ID NO: 705301 - DNA, 907 bp, Homo sapiens
  misc_feature (286)..(286): n is a, c, g, or t
  misc_feature (683)..(683): n is a, c, g, or t
ggttggtgagtgggctcctaccgaccgaggtgtaggcagtcgcggggagctttgcggtgttgccatttgtaactccgagatcctaaaattgctctgtcctgttctctgtctcttctagtgttgggggccgtcccgctcctaaggcaggacagatggtgtgaccgcagataagtaatgacgaagaaatggtcgctgggatgtcgatcagaactctaaggctctcgaactccgttactgcataacacgtggcgaagtactgctctctgagggttacatatgcatgacntctgtaatgcactgatcagcacaagggccacagagccgagacattggttcctatctctcgtctacacaatcttgctccagctttgagcgaagatcttgcaaacatgagagtgactcatgcttagttgttggcttaaatactggtgtcgtccatcatctcaccaggtgtggctaatcaaagtatctgacatcgttgggctaccaagacatgcgtgtaaaaataccttatcaggagtgatgctccactggctgatcatctgagtcctaggtgtactctgaacgatgctagtttaggatagcattgctcagaaccagactgggtggagatacacgtaataccctgtttgcattgctacaagaatgtttcacctgtcaatagcctttaaagccttgcgganaatttttcgcttttaaatatgcatgtgccttggttcgtcaaatcccatcaagccacaccatcttttaattgcaacaagacaacctttgttgccacagtggcaggcgagcctggaaagtggcttgtaccaaaggctcagcgaggcgggggggagggggcccccatgtttggtcgtcctgccccgtcctcaagagccccagcgaaatgtcgggtgcaacgcctgtt

SEQ ID NO: 705302 - DNA, 1044 bp, Homo sapiens
ttgccggtggtccaggtcactatgtagtggagggggcagatagcctcgcgcgaattctggaaggttcttagtctcgacttgaggaactaagtcagaacaccgagagactcctagctcgtcgcgcttcaggtgcactggcggattgaacggagctggcgtcgccatgtttggctgacttggatggcgagcgaggctggtgcaaacaagtgtgcacagtcaagatggtgatatggataagtttgtattttgacttagcctgattatgagagtatcaagcatgtcctggttatgatgctgggaacaatcccatttcctgagggaatgggatagatctgtctacttgtcttattcctgatttcacatgtggagatgccagtatggcaacatcctaggatttgtcacgaatgggaagtcaagtgccatcttcatgaatttcaggtcttaaatctggagacggaagccaacaatccttttggagccatgaatattgtgccgaactccatctgttgctcaggatggaaattgcagtggaattaattcagagagtctggctcaacagactcctgtaggtaatgcttgtgtatcctcagttgactcatttcagtcagttcgacacggaagatgttggaccattggctacaatttggttcatcatatgctgtctctcaggcccagatgagacaagccatctgaaatgtcctttccggtcaaagtgggttctggaactgtataagactcttcgaggacgattgagccgggaaaccctctcctgtgggcgacctagttggacttacattagttttcatggggacaacacgacaggggggcgcagagaatccgcagggcccacaacgatacacggttggacagagggcccaagggcgaaaagacgcgcggagataagtgtaatgaaagaccgggcatgagagacacctcgggaacaggacagcgaaagcgacataagtcgtgcagcaccgcgtactacactagacaggcaagagcgctgtgtcgctcccccccctctgcatcagaggagaaggaggc

SEQ ID NO: 705303 - DNA, 870 bp, Homo sapiens
  misc_feature (39)..(39): n is a, c, g, or t
  misc_feature (42)..(42): n is a, c, g, or t
  misc_feature (44)..(44): n is a, c, g, or t
  misc_feature (49)..(49): n is a, c, g, or t
  misc_feature (73)..(73): n is a, c, g, or t
  misc_feature (82)..(82): n is a, c, g, or t
  misc_feature (86)..(86): n is a, c, g, or t
  misc_feature (113)..(113): n is a, c, g, or t
  misc_feature (118)..(118): n is a, c, g, or t
  misc_feature (144)..(144): n is a, c, g, or t
  misc_feature (159)..(159): n is a, c, g, or t
  misc_feature (161)..(161): n is a, c, g, or t
  misc_feature (167)..(167): n is a, c, g, or t
  misc_feature (177)..(177): n is a, c, g, or t
  misc_feature (183)..(183): n is a, c, g, or t
  misc_feature (187)..(187): n is a, c, g, or t
  misc_feature (196)..(196): n is a, c, g, or t
  misc_feature (224)..(224): n is a, c, g, or t
  misc_feature (231)..(231): n is a, c, g, or t
  misc_feature (262)..(262): n is a, c, g, or t
  misc_feature (271)..(271): n is a, c, g, or t
  misc_feature (276)..(276): n is a, c, g, or t
  misc_feature (341)..(342): n is a, c, g, or t
  misc_feature (416)..(416): n is a, c, g, or t
  misc_feature (431)..(431): n is a, c, g, or t
  misc_feature (438)..(438): n is a, c, g, or t
  misc_feature (678)..(678): n is a, c, g, or t
  misc_feature (760)..(760): n is a, c, g, or t
  misc_feature (868)..(868): n is a, c, g, or t
ctcacctggacccggggactcttcaacgaggggcgctantgngnccgantgggcgagttcccgcgtccctgcncgttccgtngctnagttccacgatacgctcccctgctgcnccgcntgttcgcgggtgggtgggcgcttccntcggctccccgtganantttgcngacgctcccnggcgcngggnatgggcgcngccgccgttggttcccgagctggattcngcgagcngtgcccctgaggccctcggctgctggggtcngtagaagcngcgcnatgaatgatcggagcagttggaggcggacaatgaaggacgatgagaccttcgagatctccattcnnttcgatgaggcaccccacctagacccacagatcttttacagtttgagctccttttggagaaacttcgaggagcntccggaggctgcgtnctccgcnctggctctgatgaacagcgttaagacccagctgcacatggctctggagaggaactctctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtnagcagcctcctccctcagcggagtccccgaagaaggcagcccagttagaggaggcggcagaagcagaagggaggtgctagtnggaggcgctttggggaagcccaaggcccgggagaggcagcgagtttaaggacgccgacggggtcctctgccggtacaagaagatcctgggcacttccagaagctcaanac

SEQ ID NO: 705304 - DNA, 188 bp, Homo sapiens
gtcctgaaaaatgatacctgtgtgtcttatgccactcatatactctggaatgctgtaaatcttcgccattgtttactgggttgtttcttattattgagtctaagagtctttacaggtctagaaataagtcctttgtctgtatatgtactgcatgtatatttggagggcgtggcgtgcctagtcctcta

SEQ ID NO: 705305 - DNA, 271 bp, Homo sapiens
gcccccttttcccccctttgccccaggcctcctgaatcagttttttccattggtccttaaatccccatttcaaaaaagtgggggttccccaagttcaatgcttatgaattttaaaacatggtggcttaaaaacggctcatcccaaatggctgtggggtcaagtacatccccaattgtggccctttggacaaatggggggccctgcactcataagggcttccaatgtgctgccccccttttaaaactccccaaaaaattttacttcctgtca

SEQ ID NO: 705306 - DNA, 347 bp, Homo sapiens
ctccagttcatcgctgttctccgtagttgtccgtagccttgatgtcttactaaacacacatgacacacagacacagacacacagacacacacacacacacagacacacacacacaacatatctatattacagacgagggtttgggttttagttttttttttttaaagggtgaggactcaaaaaatcaaggggctagtaaaaacagtgttatgttgggaagcagggtaccccaaaagatttaccctgatatgtcacggcactcccaaaagcacacaagcatatagagatatttgtatccccacacacgcatatacacaaacgcaataaagtgcaggcaggtcccgagc

SEQ ID NO: 705307 - DNA, 143 bp, Homo sapiens
ctccgactacggccgcgggggtctcactttcctaccactgccttcactgcggcctgtgacgacacgacccgcttgggaccccctgtgttgagctagcctagatctctaggcgactgtagggagctcggaccccaaaccatgac

SEQ ID NO: 705308 - DNA, 191 bp, Homo sapiens
  misc_feature (14)..(14): n is a, c, g, or t
  misc_feature (52)..(52): n is a, c, g, or t
  misc_feature (108)..(108): n is a, c, g, or t
atagagagggaganaatggtcagagaagagggccactctgccagatgaggantgaggggaagggcaggaagaggaaccaagtcgtcagagccgggagagccaggaggnctgatgggcctagcagacacagctgaccccaagtgaggggaagtggcctggggtcttagttcagccctgagtggccctggcag

SEQ ID NO: 705309 - DNA, 224 bp, Homo sapiens
  misc_feature (54)..(54): n is a, c, g, or t
  misc_feature (84)..(84): n is a, c, g, or t
gaatcgccgccaggttcattctatctgtacatctcactcaaggaagaaaccccnaaactcctgccataaacccttctgaactcnctgcaccaccccaagcccgacactgtcgggcttttttcattgtgcgagtaatgcgctcgtagccttacacccatgcagtgtggagctgcccatgatcaacatcccaggccagttggccatccgcactatcagcggccgct

SEQ ID NO: 705310 - DNA, 344 bp, Homo sapiens
acgcgcgcggacgagactgcggcaaaggggtaccgggcgcgacactgcgaagcaaggacaggttcaggatctacagtccagaacacgcaacttacagcaaagcccctaacccaggagctggagtggccagaatttgcaaccagcaatctgatcagcagggcgcagggcaccagcatacgtcacattgtgttggacatttaacattcaaaatcaccaatcatttacaatgagaataatcatccacttatatttccataactctctgcaataaagcactttaagttgggaatcaaggatgttggcagacacatgccacttacgtgcggaacaggtgctgaattcca

SEQ ID NO: 705311 - DNA, 310 bp, Homo sapiens
  misc_feature (166)..(166): n is a, c, g, or t
taccccaacgcgctgaatagcctcccaacgcgctgattagcttccccaaagtgctgggattccaaacacttccttttattattgcttcgtctcccagcgagagctgaggccctggggaggcaggcgagtcttccttcttgagaaatctatgccctgtgtccagatntctggggagggacctttggctctcgaccagtgtcctgcacccaggcttcccagaagctcctcgtatctcagttggtgctgaaattgcatgtggggtatgaacgtctgagaattgagattggggcaaccttgctatgagcagagc

SEQ ID NO: 705312 - DNA, 402 bp, Homo sapiens
catcaaataaagaacatttaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccttttaaaattcccctggggggccccaattttccccccccccctttttttttaaaaaaggggcccttttgggggggctttttaaaacctggcccttggcccttttttaaaaactttgtattgggaaaaattttttcttgggaatttttggaaagaaccctttttttggggggggaaaaatttgggaaaatttccccccgaaattttaaacctttgggggaaattaaaatttttta

SEQ ID NO: 705313 - DNA, 262 bp, Homo sapiens
gtccgagtaaatcaataaatattattgactgggcattgtggcgtcagacctgtggtcccagcactttaggaggctgaggcagtcagatcaccgtgaggtcaggagtttgagaccagcctaggcaccatagtcaaaccctgtctctacaaaaaaaaaaacaattcaaaataaaaatacaaataagccaggcattgtggtgcatgcaaatagtaccagatactaaggaggcagaaggtgccaggccccttgaacgctgaagggt

SEQ ID NO: 705314 - DNA, 403 bp, Homo sapiens
tgagacagggtctccctctgtcacccaggctggagtgtagtcgtgcgatgcaggctcactgcaatctccgccaccctggctccagcaatcctctacctcagcctctcaagtagctgagactataggcatgcaccaccacaccaggctaatttttatattattattatttgtagagatggaatttcgccctgttgcccaggctggtttcgaactaacctcaagtgatctgcctgcctcggcctcccaaggtgctgagattacagggataatccaccatgccggggaagtaaataagtatcttatggtaatagagggctgggattgggttaggtgggggatcatggagcaagattcttagaaaatttgggagaatttattaatcaaaaacacaaatgggggagct

SEQ ID NO: 705315 - DNA, 492 bp, Homo sapiens
gggtcagtgctataaccgggagctggtgttcactgggagacgttgtctattgggcagcaatgtcatggcgggggtagtggtcacactgacggagaagatcccgctgcacactcatcatactccgctaaggttaaactagactcactaggagtcgacgcgtatgacattctctaccagtccagggtgtgttatcatgaaccagtacatcattaactattgcgttggcaatgttgtcagcacagtgaaaagacccaaggcgggtctgtaggcggaggtgagaggggaacaaaatatccaacgtgccaggataagaattagaactgtatgaaattgataaaccagaacatccaagtttcataagataattaggagtactaaatatcctgagtatcttaaatctccaacattacaatgtgctttagtacacataaagtgtctggaaggatacacgagaaatcggtaaccatggctaatatatggggaagaatctta

SEQ ID NO: 705316 - DNA, 1687 bp, Homo sapiens
  misc_feature (153)..(153): n is a, c, g, or t
acttgatcgtgactctccacaaagatcgatcactcatttgaattcaagcacaagcaccacacaggccgttaattcatgaggcattcatcacccctactattatttgataccataactcgatcagatcgatacctagtttagatctgttttacncctaaatcatttgtatccatgccgaacacacccataaactaacctctgctcgcgtcgcctcatagtatatacacataccctaggaacatccgtatcctccttactacgatatcactggtctaatcctcatatctgctctcattctaatccaatgtcgaaacctacttatctacgtatatagcaacactcataacgcatcctattaatacactataatacatacacacgtgtacaacatcgtccttatacatattatgaatccactacaccaactagccgccatccaggaatctaatatgctatacactgttaataatccatatactctacgtccaataaccacacactctatatacgctcacccacctctgcccacctaaataccataccaacacgcgacactgcacagcccaaaaacacaagccacacaacacatacagccctatgcacaacacagacaacagagcccaacaacttaaccaatttccccatcaatcttcatagccacacacccataaccgcctacgcgccccatcccctatcatacacacactctcacccttccatctccgcaccaaccataacacacttctctaaccacacttacaaaccaaaacccaactcccacaataagaccgcccctccaacccttacacacaccccacatcactacactacccttaacccataccaaccttcccttcccaccactcgcccccccacaccgcaccacacctcaactccacacccacccctccaccttgcacgcccccaacacccacaccccttctaccacttacctgcaaccttcacggccttacaaccaccacaactacgccttccccacctaaccctacaaaccacacttaccacctccctactcttaccccgcgaaccctcaccacccatactactcgaacacttcccccccttacacccagtccccccatcgccttcccaaacgacaccccccacactaccgccatcgcgcgcctccaaactcaacttcaccctacgccccgtacaatctaacactcctccaaccacacctcaactcgcacgcgcccaccatcacacaccactcaaactaaaccaccccattccacacaccacttccacatctcccttcacaccaccccccacccttcgcacccaatcaatcatcctcacattaagacccttaaacccccctttatcacctttggctctacttctcatcccccctcaattccaacgcccaccttccaaccctctttctctaacccaaccagcataccccacatctgctccctcacccacacacaaccacggccactcctacaaccatccctctccattcccaccacactcctccaccaacatccacgcccacacttaacaccctcccgctcaatcacacacacccccatctcctcatctccgcacgcccctctcacaaccctttcacacgccgcgccccaccctatctcacaaccccccccccgccaacatccaaccacaatacacaacctgcccacacacactgtcactccgc

SEQ ID NO: 705317 - DNA, 156 bp, Homo sapiens
ttaagaatggggttgtgatacagacgttgatagggtgaatttccagaagttgggacaagcatcttcaagttggcagaatgtgctttggagtcaaaaaaaaagtttaatcgtatcacttactagcaagtcatttcaccttgctgggactcagtttcc

SEQ ID NO: 705318 - DNA, 183 bp, Homo sapiens
ggttttgaaggatgagtgaatataagatggatgtggaggctgcattagtccattttcgtgctgctgataaagacatacctgagactgggaagaaaaagagggttaatggacttgcagttccacatgggctgggggaggcctcacaatcatggtggaaggcaaggaagagcaagtcacatctta

SEQ ID NO: 705319 - DNA, 259 bp, Homo sapiens
  misc_feature (1)..(1): n is a, c, g, or t
  misc_feature (27)..(27): n is a, c, g, or t
ncccattgtttctaaaagcagagaganctattttagtagtcaacagaaggtttagttgtgaattccgattttgtggacaccagatgtgtgcggtgttttgttttctttctttcgttttaatttttttttttttaagacaacaactaaaaagaaaaaaaaaatcccaaggattctgtgcactggaactgtagtggtagggtctcagcattgtaaagagattgttcttgtacaggccttttggctgtttctcttgtatgta

SEQ ID NO: 705320 - DNA, 121 bp, Homo sapiens
aatgcatgatgtcccagacgaacagtacactttgagcgaatttcatgtgagtcttggaactatgcctgcaaactctacgtcattcttagatatattttgatggtacgttgttgcactgctg

SEQ ID NO: 705321 - DNA, 148 bp, Homo sapiens
  misc_feature (125)..(125): n is a, c, g, or t
ctcggtctaaccttgttttggtccaatcatgttgtcaatgatgccacacactggggagagggagatcaatggaaaaccagccaatgctcctcccaatatgaggatgtttgccaatgttccagtgnagctcccagtggaatgtggtctg

SEQ ID NO: 705322 - DNA, 346 bp, Homo sapiens
ccgattacctaaaaatccctgttccccctaaaaatcttgacattagccgggagtagtggcgcgcgctgtagtctcagctcctcgggaggctggggtgggaagatcgcttgagcccaggagttcgaggatgcagtgagctatgatcgcaccactgcactctagcctgggcgacagactgagactgtgtctcaaataaataaataaaggaatgaagtgctgatacatgctataccatggatgaatcttgaaaacattatgctgagggaaagaggctgcctcttgtatgatttaatttacataaactgtctaaattaggcaaatccactgagacggaaagcatattggt

SEQ ID NO: 705323 - DNA, 801 bp, Homo sapiens
gctgactcctctctccgccatggcgtgtgcgtcgcccacgtgatatcggtgtacgtccgacaaagggggagtcatctggcaaaagatgtcactttgcctgctgctattcaaaggctcctattctgaccgagatatagtgaatcatttgttgcacaccaacttgcgcaaaaacaaccgaggacagtcctatgctgtcatgtgaattagcaggtcatcagactagtgctgagtcttgggtgtactggtcgagagctgtgtgctcagagataccccagatgttcgaaggtggtgaggactctaccgacatctggcacacgggtgctttttggaacacgatgatgttcgtgagagtgcccgaagtgtattagcacacaagacatagagacctgtgcgtccgatccggctcatcggtatagttgagactacaacgccgaaacaaacgagatacggtcgcattctcgatgtcctcgctccttgtgctatcgcctcaggctcgctgtaccctagcaactcggtccatgctcgtacaaggggtcgattcctacttgactgaccgttcactgaactgttccttatgagtcagttgatagaactctccagtgtgaacggtctacaatgatagacgcaacagacgcctgaatggagctcctatatagaaaagcgttaagacgcctggaactgatatcaacaacgacggtcgtatgccatctcagtgaactgagagctggcaacaggcaaaatgagagaccgtccccgtatcccaggcgcaggggcccgtggatcattctattaatgaggata

SEQ ID NO: 705324 - DNA, 334 bp, Homo sapiens
  misc_feature (47)..(47): n is a, c, g, or t
  misc_feature (66)..(66): n is a, c, g, or t
  misc_feature (143)..(143): n is a, c, g, or t
  misc_feature (185)..(185): n is a, c, g, or t
  misc_feature (255)..(255): n is a, c, g, or t
  misc_feature (306)..(306): n is a, c, g, or t
agtttgaatcatgcaaagatgctgccacttaaaaacctctttcctanaaacttaaacccctccgancgtggttttcctgtgaatctcagctgggcacgatggcgcctgtcatcccagcactttgggagactgaggcaggtggntcacgaggtcaggagttcaagaccagcctggccaagatggtnaatcctgtctctactaaaaatacaaaaaatagccgggacgttggaggacctgtatcccagctcttggagntgaggagggaatcgcttgactcagggggagaggttgcagtgagtcgagatnacgcactgactccaggctggagacagag

SEQ ID NO: 705325 - DNA, 540 bp, Homo sapiens
  misc_feature (200)..(200): n is a, c, g, or t
  misc_feature (252)..(252): n is a, c, g, or t
  misc_feature (275)..(275): n is a, c, g, or t
  misc_feature (292)..(292): n is a, c, g, or t
  misc_feature (338)..(338): n is a, c, g, or t
  misc_feature (411)..(411): n is a, c, g, or t
  misc_feature (426)..(426): n is a, c, g, or t
  misc_feature (475)..(475): n is a, c, g, or t
  misc_feature (493)..(493): n is a, c, g, or t
  misc_feature (502)..(502): n is a, c, g, or t
  misc_feature (530)..(530): n is a, c, g, or t
tacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtaccgtgggccctgctcctgcccacttagcgaggcatgggctccttgnctcacctggccccggcaatcccactgaatttctactctggggtgggtggggnacacacttcggtttttttaatgncaattccgttttcatgnccgaatctaagaagccacaacttgctttggcagcttcagggcaggnagccatgattcaatttctcgccttgaaaaaggacaatctgtcctgaaggtgggtctgaccgtcttgcctcttntccccaggaacaagngtgaccttgggttgtggggtcaacggccagtcccggggccctcctgttnttctcgggtttccggaantggagagcntgctggcccggctttggccagacaggtnttccccaaaa

SEQ ID NO: 705326 - DNA, 410 bp, Homo sapiens
cataggtctttcattgcgcacgcaatgcacgcggaatgtgccctccaggagaaattcccgtagatggtcgaggtcgggcccttccagttgatgaggagtgactgaatctcctgtatccggaccgcgtgctcatgcctcctcttcatgtcgttgatgtaccaggccacacaaggtcatggtgtcaatggcatcctccaccacctcaaaagccatcctcttcttcatcaaaatgtatgggcactttcctggagcagcaggtggtacttgaggatgcgctggaacttgcttcagcaggttaggaagcccaagggcagcaagcgctagtagcagctcctgccggtcccgaaaagaaatttggccttgctgcatgtccccgcatgcaattccacaggtgggggccgggtaccgag

SEQ ID NO: 705327 - DNA, 212 bp, Homo sapiens
  misc_feature (141)..(142): n is a, c, g, or t
tgtgtgtgttcttgctgagctatgcggattatatcatgtgccgatgagctggccatgttgaacagatgctggtgcacctgacctctgcatctgccctgtgcagcagctgcctccctgcccaccatgtgatgtgatgtgacnnctctgcgcccatcttgcaatgtgaacccatgctgggtgaatcctctagaatgtctgaccttgcatgtgca

SEQ ID NO: 705328 - DNA, 709 bp, Homo sapiens
gacttgcgctgagctgccttctgctcgatttcgctgctgcctcgaactaagtgaaacttcgtgatccatgtctgagaatacccgatatggtctgagacttcgtatactttcgtcccgtcgaatggctgtcgagagatctgactactggcgatcagaacaaaattccaagatgtgcttccaaatgtacacctagttgtactcatggacgacgtcatttgccggcgaaatttcgtacatgactgtgataggtgtccgccaattatttgactaaggccatttccagtcaagacacttgatcctctcgagttagaagccctcggagattaaggcctgtgtgtataacgcgttcggatacatgaatgtcggacagaagggttgagactccaccggttgctaataatgagcatgttagcttgtcacgcattaacagcactcaacaaggaaacgaccctgagcaacgaaaaaggccggcgtcaaatgggcttgtcccactcatgatcctatcgaagtccttgggtcctgtgaaaagcgttcatatgagacccacgaacgcttgcactcgtggagttagaaatcaggcaatataggcgagtcgaaaggaaaaaataaatgaaaagacagtacagaccgaggacacgaaatagacgacactagttaacaacaagaacgcgaggaacccaatagacgcgcggccagaggcgtacgcaat

SEQ ID NO: 705329 - DNA, 347 bp, Homo sapiens
tgcgcagtggctcatgcctgttatcccagaactttggcaggctgaggcaggtggatcacctgaggtcaggagttcaagaccagcctggccaacatgatgaaaccccatctctactaaaaatacaaagattagccatgtgtggtggcaggtgcctgtaatcccagctactcgggaggctgtggcaggagaatggcttgaacacaggaggcggaggttgcagtgagctgacatcacagtactgcactccagcctgggggacacagcaggacttctcttctttgagcaggcttatgcttgcggccccatttagtgttcaattgcccaattcccccctggcggccgttacg

SEQ ID NO: 705330 - DNA, 155 bp, Homo sapiens
aagggggcgtggacaaccacacgttgatacctggtccgtgccaaaggtgtcctgaacccataaaatccagagaaaagaaaatcgttttaaagggcggaggctggggggtaagttactatgcaagcagtagtgagcaagaacagagaggagcgggg

SEQ ID NO: 705331 - DNA, 925 bp, Homo sapiens
gagatgcgatctagaaatggcgattgtcgaaccggaaagccacccctactcctaatcccccgtactagtgagaaggagaagagggaatctagatcaggaggttgctgaagcccagaacactatattgagtcgatccgcctacaggaacaagatgggcgacgtctgtttcttctcaaacttgatcaatgctatcagcttggcagatgccaatccgtgcgggctggattctccatagttttagtacgtggttggaacgacttttgggcgtcgtgtacaacctatatccatgttgtctaagtaattgaaatagcctcggttagtgacggacctcacatttgattagggatggtatagagcctatgtgggaagatgagaaaaacaaagggggaggacgatggctaatatacattgtagacactacgggcagagtaagtacagtgacctgaatgcgcttgaggctagagacattatctgatgctcttgattggaggaatctctggatgactagagtgatgatggtatgtggtgctgttgtaaagtgttagagctaaaggtgattaggatagcaagatggactactgaatgtgaaacgctgagatagctgttgcacatatgagggagggtataccaggaaggtgtacgaacttcctcctgaggatagtgatgggtatcagatcacaaggagacgtcaggtactcagagcgcatccaacagtgaacactacgtggtgttaagaagacgccttgggatatctcaccagacagtggtcaagacaccggactgggggcggaccgaagcccttcacagcggagggcgggaaacgggaacgactccggtacgaatcacaacacctcgctggcggaatggcgctctaacgacgaaacacaccccgatgcaccccacacaggtcgggccccaagacaca

SEQ ID NO: 705332 - DNA, 816 bp, Homo sapiens
gagtatgtaagttcctgtgctaataagtccacttataaggtaagactgcacacacatatacctgccatgctactgatcactcatcaagtactgccactaatcagtccataactactcttgattcaactgcccgtcggtgggtcagatggactagatcgtacatgatttgtataatgtacatgaggggcgcgtatctttggctcaatagaatagcagccatacatagcattcgactcttctacaagctctcacgcatggtactatacatcattattaactactcacacgccctatccttgtgataatcctactacgccgaaaatgcaatacctgtagaatataatcaaggaatgactcccgggcatgacgcatacgggcacaccggagctgaaatcgctcataggcataatcatatgctatcaaggcacaaccatatgcgcactacggtagttgataagtctatgactcactccacataaccctcgatcatacgcttatcaacagagaagcagtctgtgtcattgatacgtgcacgcacttacattcctcatgtagtactatactgtccataccacacagagtctcaactaggagcgcgatctgagcgctttatgatactctatcaagtactctgcctactaactgctactagttagacgtagcgggtgctttctagaagctgtgcataaactcatctgagcatcacacgataaccctgatgggagcgtgatgtgaggtactaccgggtactcctgatcagatatacttctgcagtcgagacctcagtactacatgagcctatttcctacatgttac

SEQ ID NO: 705333 - DNA, 485 bp, Homo sapiens
  misc_feature (456)..(456): n is a, c, g, or t
  misc_feature (480)..(480): n is a, c, g, or t
ttgtagttgtgtgtggttctcgagtggctgcgcatgtgaacacgtgtgatttctcagtgtactgtactgtgatttgtttttattgcttgttttgtttcccctcagtgtctgtaacccttagcaggctctgacctagtcaggctagaagaagcataaggatcttttattgctttgtgctgggtgagggctggccctaaacatctgcctaatcctttcaacgggcccagggaaaagccagactggcattcatgtccacagcatcgcttaatatcgttggttgtcatccagacacctcaacttgtgctggcagagggaaataagttccttcttcacggatgcatcatggatgggatatttgaaacctgcaggggtggcaggaacttaacacctgtttccatccatcgtggggatgtttaaaggatttggggttaacatggcccaagccggttaaggccnttggggtggggggccatggagganttttc

SEQ ID NO: 705334 - DNA, 612 bp, Homo sapiens
cctagctctatcccagccgctcagtctccactgcgctgtccagcctctggtaccatacctatggcctggctcccccctggccttggagcccggggcccctttcacttcctcagcctcagcaatgttcccttttgagcgtcatggagctggctcgccttaggtctttcgttattccaggctaggtagggctgtgaggaatgcattaagagggtttgccagtttctgagaacctggaggagcatagctagattcagatcctgtctgcctggctgggtccttggcaggttccctgtcctcctgcgtgtaagcttatggggtggtgatgcacaatgactggtaattcactcctagatcgcagcgtgtggctgcttggccaggacagtgatgccgacagggagagcttccgcttggtgaccagagacatgtcccacatggacatataagcccctctctgtcgtactgcgattttttagacttttacttttgaggtccctaggatggaacagttacgtgggagataaggacgtagaacagtttgacacgcgttcgtatacttgggagatttcgttaagcctgccaaccctttcacctgggattgttccggttgggtcg

SEQ ID NO: 705335 - DNA, 353 bp, Homo sapiens
attaaaaaccaaaaattggccaggcatcctcgtgctgcctgtagccccagctgcttgggaggctgaggctggaggatcacttgagccctcaaaaggtggaggctacagtgagctgagattgtgcccctgtactccagcctgggcaacattttttgtagagacagagtctctacaaagaaaagaaaagaaaagaaaaaaattagctgggcatggtggcaaatgcctatagtcccagctgcctgggaggctgaggtaaaaggagtgcttgagcccaggagttggaggccccattgagctatgactgtgcccctgcactccagcctaggcaacagagcaagaccctgttttaaaga

SEQ ID NO: 705336 - DNA, 227 bp, Homo sapiens
  misc_feature (174)..(174): n is a, c, g, or t
  misc_feature (212)..(212): n is a, c, g, or t
  misc_feature (217)..(217): n is a, c, g, or t
  misc_feature (226)..(226): n is a, c, g, or t
agactttgccggccacgacaacgcagtgcaacctgtgcagggtttacaccttccgccagctgctcttcaccgccgccgcaacgagatccttgtgttggaggtccccgcctctgagatgcagcagggactgtgttggttggcatcacgccttgtcatgccagcaccttgacacangctttgcagaggcgccacgttgtcaattgccctccatngactngggggacang

SEQ ID NO: 705337 - DNA, 137 bp, Homo sapiens
aatttcctgtaaaaaatttaaaaactttttcatgaaaatggagttatcagttatctgtttgttacggcatcatctgtttgtaatcattatttcactttgtaaataaaaacccccctttaaacatggccaaaaaaaaa

SEQ ID NO: 705338 - DNA, 356 bp, Homo sapiens
ggcgccgccgccgcctctccttagaggccgccatgacgaccgcgtgcacactcgcagatgcgccagaactaccaccagaactcaaagggcgcgcataaaccgcgcagagcaaactgtgagctctacagcttctacggttacctgtgcataggttactactttgaccgcgaagaaggggctttgaagaactttggcacaaactcttttcaccaatctcaagaggagagaggaacaagctgagaaaccggtgaagctgtggaaccaacgaggtggcccaatatttcttcaagagatcaagaaaccagactgtgaagactcggagagcgggctgaatgcgatggagtgtgcattcttgg

SEQ ID NO: 705339 - DNA, 980 bp, Homo sapiens
cgctcttagcccaacggggcgccttctatccctcctttgtggcttccgcgcggccgacggtggtggttccttcccccttccgcatggccggctgtcattattttgccggttttagcgccacacgcaggaccaagatattgcaacagtggtgggcccgggttttttaaccccgagggcgcacactttctcgggcgcgcccaccactagccccgccctgtccccaaagaggcgccctttctatatcgggggggatacatccctctttgtttttgtccgcccacgaacagtgtgttgttttttccccccgaaatttttttttgggccgcttgttactcaaacctctgcaccgctcggtgccgcctgtccccccccccactttatatgggggggcgacctcgtcgcccccaactcacgggcgtgttgctcgctccgctcgttattaattccctctcgattaaggtcgccacactccttggtgaacaacacactccccctgggtttatgctgtgcactacacggggtgagtcatacatccccctccgggggtcgtcccatcatagtttgtaatatataggagaccccagccgcggccccctattgatgtctctaggcgcccgcttttttatttcgcacttttttgtggggtgtttttgtttttccaccctctcctaccaccgccctccgggtacattctgaggtcttctccttcctactccttttcgtccggccggcggtttttcgcggcgctcaccattgttttggtaggcgccccggcgtgctccccggcggttctaccgtccaattttttgggcgtcgaacatttctcctccactattttgtgttttaccccccccaaatatttctcctttaaaaaccaaaacaacctttgtggtttgaaacacccccccctaaattgtgccttttttaaaatggggttggtaaaatttttttattttctcaatttttgaaggggggtttta

SEQ ID NO: 705340 - DNA, 814 bp, Homo sapiens
tctttttctttccttcccaagaaactgaggaatgttaatatgaaaacatacatcggatatgtgaaaagcacaacaaaattcttagtgtacacagtaaaaaagtaactatataaatgtagatggcatttaggaccacagcttggtggatttgtgtaacgctatgggaataacttgattggtataacgctatttagagtgaggctggaggtggcagcttcacagaactggagaaccaggccaagtcccctccccaacctatttaggtcattcaggacagctaagtcagtatattgagagcaatactagcatacgttcttaatttgttatcagcattgaccatgtggttccgaaggaggcatgctttattatcacaatagttttgattggtaaacccaagaaattactcctgtgtttatctaacttcataatagcaattattgcccgaagctatagtggcatatttacaaaagttcttattactgcgcggactgataacatttcccaacactacttgttgttgaccccaaaatgattgatacccaattctacataaaatatgaagacctatcttttttgtgttaccttcagatgtttccttaaataactcagtttttaagcagaagtttcagggcattaatatatgcggggatgaggtttcaactggacctaatttgcggtcaactggcctcccgggtaggggcttaattttgaacttacttgatgcttttaacaactcaagcgctgttttaccgcccctgggatcggaatctaaatggacagggcggctcccacacaggtataaaaagcctttaag

SEQ ID NO: 705341 - DNA, 1058 bp, Homo sapiens
aatcgtttgcggtagtagtttgacttgtgggtgtttcttatagctgtgtggtgtgccgcgtcgctgacgacgccatgttgggggcgcctgctgtgtgtggtgcgcctttgttgtgcggatatttcccgagcacccgtggggccacccagatgccctggcacctgggaccaccatgttgcgccgggccctgggagaaggtgttgtgggtgagccgcccgaagggcccacagtgcgcgcacccgaggagttgggcctttggaaagtgtgaaccgtgtaggaaccgtttccctctccggagagtacctggaagtgaggggctctccgcgaaatccaggactgtgagaccaatctggttatgaagatggttgtctgatccagatgaccctgagtaacccttcggaactaggtggacttatgagtgaagaagcatatgagaatgaccggaatctattgaggagtgaaaatggaactcctgaattaactagtatggaattaccccagcccgccagagttgtctttaaaattaagtggtggattagaagacctttgaaatagaaaccttttagtattacccgatggggagaaaaaaaactacctgttaacccctgcgtaagtgagaagagaaatcgccccttaactttctaatagatttattagatgaaataataaataatgccgtctttgttccaccaataatccttatgatatttttagacttaggcttttagtgttccagaatattccatgaaattatcccatggtaaaaactagttataaaaattaccataattccaagatacaccattgttattcttaacgcccttatataatattgtgaacattgccaagtatcccataacctggatttgggatgaaatacttaatgatctttcccattggaaataactggaagtgaagaggttttgttgcttgtaccagtgtccagatgaggaaccacccactatcttaattttgcgataccctgccatttgctggtgctatttttataccgtgaagccacagctttgcacccaaataattaaatactttttcgttta

SEQ ID NO: 705342 - DNA, 312 bp, Homo sapiens
gctgagagctagccagacagcactcgacgcatttctcttgggccaacaaccgggacacgtctgccgcgttcggcctgctgcgggggctgtggctggctacaatgttgcggatctgcgcgtcggtagcagcgaaaaatacttctcctctggcaagcgtgttttgacggccggaacatcagtttttcgggccattcagccgccttttgtcgagaacccttcgattggcggaagcggaggcacgttccaggcgaccgagcaggcgaccattgggctggagagttgcaccggaacctatgcctccatgaccatcag

SEQ ID NO: 705343 - DNA, 451 bp, Homo sapiens
tgtactttgggcggcgctgtgttgggacggcgtgtaattggtaggagggaggctgccgctagagtattcttggtctgtgctttgagacggcgctgctttgggacggcgttgaactactggccacttcctttcgtggaaattttctagctttactccctcccggtgaaacactgccaaaactgatggtttccgtcttcaccgtttagggactccaaattgagggtttttgttcccaaggtttctgaaattggggatagctggactcttggtcctcttgtcgctcacgggaagcaagcggctgtctcttcctgttccaggacagcttttgcgacctcctcccctccttcctctttaggcccctccgtcaaggcagagccctctttccctttaatgcctgtgaatgcgggctgtgctgcagcatccccgctgtatcccgccgtcccaaaggggt

SEQ ID NO: 705344 - DNA, 214 bp, Homo sapiens
tcttaagaaagcctaacttaatttggtcccaatttctccacactgtgcccgttcaaacaaaaacggtcccacaccttcacaaccacccctcaaaaaacctttttcaaaattaaaccctcacataaccttaagaagaacatcctccgctttccgtctccctctttgaaacttatcaccacattgtcattaggctacccacctccaattcccaatc

SEQ ID NO: 705345 - DNA, 222 bp, Homo sapiens
tttccaaagcggattgccggccctagcaacacccccatagccagctagggagggacccacctagggcttagctctgttacggcacagaacgcgcttcaaagagctgcgttctgcaaagggaaactgtgctcggggaacaaacctcagcccccatgcggcttggctcagaatcgcagcgcttgcctagttctgatctagcactcagcatctccgctttggaaa

SEQ ID NO: 705346 - DNA, 119 bp, Homo sapiens
ccagggcgtagaatggctaggttggagaatcccagcctgggtcctccctgcctggtgctccactaaccatctggctatgtcttagctttggtcaagtaaaagcaaaggaagctggagtt

SEQ ID NO: 705347 - DNA, 469 bp, Homo sapiens
  misc_feature (262)..(262): n is a, c, g, or t
gggggggcgctgtggctcatgcctgtaatcccagcactttgtgaggccagggcgggcggatcacgaggtcaggagatcgagaccatcctggctaacacagtgaaaccccgtctctactaaaaatacaaaaaattagccaggcgtggtggcgggcgcctgtagtcccagctactcgggaggctgaggcaggagaatggtgtgaatctggcaggcggagcctgcagtgagcagagagggagactctgtctcaaaaaaaaaaaanaaaaaaaaacatgcatgccggctgggtcgagccaactgtcgactgactcaagcttattcatgcagtgcggacgtaaagctaactcactcgatcaatcctacctagagtgagatgacatacaactgactcgccgttgacaaacaacggactgacaggacatggctgtacctacccttcagcctgcttgacatacatctttctgcgctg

SEQ ID NO: 705348 - DNA, 990 bp, Homo sapiens
  misc_feature (577)..(577): n is a, c, g, or t
ggaggtcgtgcgttggctgtgatgatctgtgatcgtgccgctaattctagcctgggcagcagagcgagaccctgtctcaaacaaaaataagagaaaaaaaaaaaaagaacccctggaattttttggggggtcagggggcttgcggggtcgtacggcccaggcgtggcgccgacacgtgggcctgtatgtcttggccacccgtgctgtggggagcaacttttgggtgctactaagacgatccttcttctctgccttgtggctccgccccacatgtgcggacatttcaatgggaggtgtgagccaatcttgtgccctacttcacttttaagtttacagtgtctgccccagtgtgtgtgttctctcctgtgtgtttgtggacaacgtgcccgccgtggtgtgtctattcagagagagagtcttgtgatagtctccccgaggatctggtgtgtttagccgttccacaaattcccagatgcttgcatgcaccacaatttctgcgacgggagggggagtagtggagaacccgtggtgcgagaattaatctgttagccgcctcttcgaggtgccacctgcggtntcttctataccaattttgtatctaccatcatatatatataaacgctggcgggcgggccacagagggtgggccccgtgggggcgtgagcgcatccccccgagtcatcctccggggaggggccgcggaggtggggcaggaaggcatcgccgcttgagtggcctgggcgagagtttggtgcacaggaccggctgtgtggggcgcacgttgtgtggtaaagaggccgcttgttccttttgggcagcggggcggggcgcatcacaacaacaagttcctgtggttcccaggaggcaatgcttttggtggcggcccccaaattgtgtaaggcccctcccctttgtttggcgccctcaaaggtggggccaccttgttttcagccccttatgggagaagggagacccttggtgccctcactc

SEQ ID NO: 705349 - DNA, 323 bp, Homo sapiens
tagtttattctattaactgactgatttgattaatacaattgacaatccagtcatttgcctttacatactgtaaagattgtctgcaaaaagaaaacacatgtaatttcttccaggtacatcttttttaagagtgtctcattggtttaccttcacttgtaccacactctacccctaccacctttttaatttccccaaaggtaatcagaaataccttttgaggaagaattttttgtctgtctgcttgtttactagcactttgccagtctttgtactttttcatattaaatcttaaccacccggtaatagaataactacttctttcc

SEQ ID NO: 705350 - DNA, 117 bp, Homo sapiens
agattacgatgtcaggatctcttcacagaggtcatgattcctgtggcttcgttgtccctctcctctgggagatgggtctgtttctctgatatacgactagtctttggattactcagt

SEQ ID NO: 705351 - DNA, 606 bp, Homo sapiens
  misc_feature (383)..(383): n is a, c, g, or t
aaagataagaaatagtacatctgtatagggcactaacttgcaagtggtgtgggtgagtcagtgagtcagcagggagggaatgtgaaggactaggctattactgtacactactgtagacttacaaacactgtatacttaggctattctgaatttatataaaatatttttcttttttcaataatgaattaaccttcgtttactataacctttttactttataaattaaaaaaaattttaacatttgactcttatgtaacaactgttagcttaaaacacaaacacactgtacggtactgtataaaatattttctttccttatatccttattattaatgaggttttttatgatttaaatattgtaacattttttacttttcaaactntttgttaaaacaaagacacaaacattcacattagcctagggcctatacaggatcagaatcatcacaacgtcactaggctataagggaattttcagttttattatggtatggaactaccatcatatattcccctcggtgatcaaaacattatgcagggcctgactatttataaaggagcctttgaaaagggcatgtaaatggtaatttctggtttcaacatcaa

SEQ ID NO: 705352 - DNA, 352 bp, Homo sapiens
  misc_feature (126)..(126): n is a, c, g, or t
caaccacgtaagatgtaacttactcctccttgccttccaccatgattgtaaggcctccccagccacatggaattgtaagtccaatgagcctctttattttgtaaattgcccagtctcaggtatgtntttatcagcagtgtgaaaacaaactgatacagtaaattggtaccagtagagtggggcactgctgaaaagatacccaaaaatgtggaagcaactttggaactgggtaacaggcagaggttggaacagtttggagggctcagaagaagatagggaaaatgtagggaaagtttgggaactccctagatacttgttaaaatgggttttgacccaaaatgcttgatggtgg

SEQ ID NO: 705353 - DNA, 435 bp, Homo sapiens
tggcagtgtacgcttcctgctgataaggtggcattcaggtctgtgtgccattgccccggcagagtctctgcgttaccaacctcctaggagggcttgctgtgcggagggcctgctatggtgtgctgcggttcctcgtggcgcgtggggccaacggctgcgaggttgtggtgtctgggaccctccgaggacagagggctaaatccatgaagttagtggatggactgatgatccacagcggagaccctgttacactacctacgttgacactgctgtgcgcaacgtgttgctcagacagggtgtgctgggcactcaaggtgcagatcatgctgccctgggacccaaataggtaaaattgggcctaagaagcccctgactgaacacgtgagcattgtggaacccaaagatgagatactggccacaaaccacatataagaa

SEQ ID NO: 705354 - DNA, 277 bp, Homo sapiens
  misc_feature (3)..(4): n is a, c, g, or t
agnnacccctatagtataaatttcaaactccctggcaaggaatgtaaatgcttactcagcttggtatttatagtcatgcgccgcatggcaacttttcaaagacagaccgcgtattcgacagtggtcccgtaagattataataccatattcttactgtatgttttctatgtctagatacacaaataccattgtgttacaactgcctacagtattcagtacagtaacatgctgtacaggtttaccatatagcctgggtacgtgttgggcgataacatca

SEQ ID NO: 705355 - DNA, 2172 bp, Homo sapiens
ggcacgaggccattttcaaacagtccctcctgggagaacacagacaggcagaggattacaacacaaggcagcaagcactgggagacgaaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatctcccacattcgctactgggtgctgcagatcatcttcgtctccacgccctctctggtgtacatgggccacgccatgcacactgtgcgcatgcaggagaagcgcaagctacgggaggccgagagggccaaagaggtccggggctctggctcttacgagtacccggtggcagagaaggcagaactgtcctgctgggaggaagggaatggaaggattgccctccagggcactctgctcaacacctatgtgtgcagcatcctgatccgcaccaccatggaggtgggcttcattgtgggccagtacttcatctacggaatcttcctgaccaccctgcatgtctgccgcaggagtccctgtccccacccggtcaactgttacgtatcccggcccacagagaagaatgtcttcattgtctttatgctggctgtggctgcactgtccctcctccttagcctggctgaactctaccacctgggctggaagaagatcagacagcgatttgtcaaaccgcggcagcacatggctaagtgccagctttctggcccctctgtgggcatagtccagagctgcacaccaccccccgactttaatcagtgcctggagaatggccctgggggaaaattcttcaatcccttcagcaataatatggcctcccaacaaaacacagacaacctggtcaccgagcaagtacgaggtcaggagcagactcctggggaaggtttcatccaggttcgttatggccagaagcctgaggtgcccaatggagtctcaccaggtcaccgccttccccatggctatcatagtgacaagcgacgtcttagtaaggccagcagcaaggcaaggtcagatgacctatcagtgtgaccctcctttatgggaggatcaggaccaggtgggaacaaaggaggctcagagaggaaagacgtgtcccttctgaactgatgctttctcactgtcatcactgcttggctcctttgagccccgggtctcaatgacgttgctcattaattctagaaactataaccagggctctgggatagtaagagaggtgacaacccacccagactgcagttccctccccaccctctacccagtatacgaagcctttcagattactcatgaaacagggtagagggaaagaagggaagcatggcaaaagctggcctggaagggatagccagagggatagaatgactctctctctacataccagcagcataccaaatgcgttctctaagttcctacctccttgacctgatcaccctccctcctccaaggaagagctcaaagttcccagccaatagacagcatgaatcaaggaacttgcattatatgtgctcttgaatctgttgtctccatggaccattcctcggagtagtggtgagatggccttgggttgcccttggcttctcctccctctactcagccttaaaaagggcttcttggaactttaccagcagcctcagctttacaaatgccttggtatgtacctctggcaaatgccctggtatgtacctctggcaaatgccccaccttggtgatgttgcaacctttccttctgctagggtgtacacctagcctgtgcaggtgtcagccctgctagggagtcactgtacacacaaactctactggaattcctgccaacatctgtcaccctgcagctcctttacagttcaatccaatgatagaaaccatcccttccctttctcccttggctgttcacccagccattccctgaaggccttaccaacaggaatatccaagaagctgttgtcctctctcgaaccctgaccagatcatcagccactgaggccagtggaatttccccaggccttgtt

SEQ ID NO: 705356 - DNA, 742 bp, Homo sapiens
  misc_feature (681)..(681): n is a, c, g, or t
  misc_feature (687)..(687): n is a, c, g, or t
  misc_feature (712)..(712): n is a, c, g, or t
  misc_feature (737)..(737): n is a, c, g, or t
gggagttgatatcttcccatccacccgccgcttctttcctccatctagcgatttttattttttaagtgtctcttcctttttctttcttttcttcttttttattttttatatatattttttggcattgctttgcagatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccnaaaaanaaggtaatactggacaacctgttcnaactagccagaatggacttgggaanaaaga

SEQ ID NO: 705357 - DNA, 149 bp, Homo sapiens
agtagtacccactcaccagaatagtgtacattagtacccgagaagtggtattacatccctcacactcctcctgccctcccaacttgggggagtctccactgtttattattcacactactgtatgtccgtgtgagcctactgtataacta

SEQ ID NO: 705358 - DNA, 441 bp, Homo sapiens
cggcacgagggcggcaggcacacctcgctcgccagccagctctgggaagttagaccacaggacagtggctgcagctgccaaggagacattttctccccgaccagccaggttccagcgtcctctgccaacccagcttgcgggctccctgtctacttttctccaaacaggctccccggcggtcacgagatttcagcctgtgcagggattgggcgagagttccgcatatggaggcgcccttgctggagcctctcggagtggagcgcgtttccttctccccaccctgcctgagacccttctcagttaaggctttggacagactttgaaagggacccacctttttttttcctccttacagtttgtcaatttttgcccagtgcccataatattgcgtttgtgtcagacattggatttctatgttagatattaaagagcttacttgta

SEQ ID NO: 705359 - DNA, 482 bp, Homo sapiens
cggcacgagggcggcaggcacacctcgctcgccagccagctctgggaagttagaccacaggacagtggctgcagctgccaaggagacattttctccccgaccagccaggttccagcgtcctctgccaacccagcttgcgggctccctgtctacttttctccaaacaggctccccggcggtcacgagatttcagcctgtgcagggattgggcgagagttccgcatatggaggcgcccttgctggagcctctcggagtggagcgcgtttccttctccccaccctgcctgagacccttctcagttaaggctttggacagactttgaaagggacccacctttttttttcctccttacagtttgtcaatttttgcccagtgcccataatattgcgtttgtgtcagacattggatttctatgttagatattaaagagcttacttgtattttcttggagagaaacaatgtttaattattaggataaaaa

SEQ ID NO: 705360 - DNA, 309 bp, Homo sapiens
  misc_feature (137)..(137): n is a, c, g, or t
aaaatttttttttatttttaaaaattggcccatttaagggggtggggctttcttactaaaacccaaataaatttaatcatttcaaaggccttctatttggtttaaaagttgattcccaggagggccatatttcagcnactgtatttcctttttcttgtaatgtaaacagcccaaaaaccatgggctatcatttttgtatcaagttttttgcacaggatgtgacccctgtcagacccctgttcttttctttctttttgtgattgaaaagcctaaaccccaatttaaagtaaatttttgttttttttagta

SEQ ID NO: 705361 - DNA, 1053 bp, Homo sapiens
  misc_feature (992)..(992): n is a, c, g, or t
  misc_feature (998)..(998): n is a, c, g, or t
  misc_feature (1023)..(1023): n is a, c, g, or t
  misc_feature (1048)..(1048): n is a, c, g, or t
agcggggtgcggccgaggggcgcccgggactgcgcggggcgggcggcggcggagggaggaggggagagaggcggggccggggcgggttgttgtgaggcgactgcgctactgccggagcggggcggttatggcggctccatattaacagcctcctcctcctccgccgccgccgccgtctcctcctcctcctcctttccctcccgcccgcgctctaagccatctccgccttcaccctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccnaaaaanaaggtaatactggacaacctgttcnaactagccagaatggacttgggaanaaaga

SEQ ID NO: 705362 - DNA, 422 bp, Homo sapiens
tggggtatatgggggtttctatttaacttcccaaaaaaaacgcgttttttggagaaaaaaaaaaaaaaaaaaaaaaaaaaaaaaaaaaaaaaaaaaaaaaaaaaacaaaacaaaaaaaaaaaaaagaaaaaaaaaaaacaaaaaagagaggggggcgggcaaaggagaaacctcaccgacgggagccccacgaaccggcaccagtgttatgtgggaaggcaccgcccaccacagaggggggggcgacactaactaaatagagggagaggagcggaagacggggagacaagaacaaacaaaggcgcgggcggagagagaggaaaaccaagaagagccagggggggagaaaagaaggaggaggagacgaggaccaaacagcgagggggggaggggaacaaaaaagggagaaaaacaccctacaa

SEQ ID NO: 705363 - DNA, 174 bp, Homo sapiens
gcaggactgtgtatctacctttgtcttttcatgatattcctgtcagagttcatttccactcagaaatgttaacgtatatgtcagattatgtgcagggtgctatcatggaaagtgttgggaggccgaaggctaagtgctatatcagtaataattgctcctcgttcagcgctctga

SEQ ID NO: 705364 - DNA, 921 bp, Homo sapiens
  misc_feature (860)..(860): n is a, c, g, or t
  misc_feature (866)..(866): n is a, c, g, or t
  misc_feature (891)..(891): n is a, c, g, or t
  misc_feature (916)..(916): n is a, c, g, or t
agcggggtgcggccgaggggcgcccgggactgcgccgccgccgtctcctcctcctcctcctttccctcccgcccgcgctctaagccatctccgccttcaccctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccnaaaaanaaggtaatactggacaacctgttcnaactagccagaatggacttgggaanaaaga

SEQ ID NO: 705365 - DNA, 133 bp, Homo sapiens
ggggccccccccaaccttttcctcaccccctcccccccccaggcccgactccagccagggcctccctcccccccagggcgcccctcatttcatttcctttaaggggaaaatatatatctatctatttgaggga

SEQ ID NO: 705366 - DNA, 883 bp, Homo sapiens
taatattttgggtgataaggaatagtgtaaggagtatggttttcattggtttggaggttagttggattagtcattgtgggggggtgattagtcggtgtgttgatgaaatattgggatggtggggtgatcaataagatgggggaaataagaatggatcagtactggcggcgggtatggcctaagagattggtgggggtgcaattagaatagaaagcagaaccagattttacgttccatatttggtgttcctccacgggtttggttcatacattcttctatcatattattaatgggagcttgggagtagacggcgatgggtaatgtgtggcgtcacggtttgtgtgctgttataattctatttttaatgtatgggtgtagatgagagtagacaatatgttgtacaggagatgttatgtgggggggtacatctatgggtgggcgccaatcacggagatgtaatatatacgttagggggcgcataggagaagtaagtgttacaaagggtaaattgtaacgttaagttctaagagccagataattgtcgtgtgtgacagattgcagcacctgatgtagtgtgctagggcccaaccctgattttgcttcgacaagtgcgcgcaacagacctagtattggcaactcatggcccaataatgggcgctaccaaagggacaagtggggatgttagaagggtacatggagaaagtaagcctactacagtgaaccaggcggaaagaaatataatccccttccaagggcaatagaacggaggaagcaacagaagaggggagccgaaaaacccaggtatcccaaaaaactgacatggggaacggccgaaaaaatatatcaggggaggaacgagcccaaaggccaaaaacgggcagac

SEQ ID NO: 705367 - DNA, 1081 bp, Homo sapiens
agcggggtgcggccgaggggcgcccgggactgcgcggggcgggcggcggcggagggaggaggggagagaggcggggccggggcgggttgttgtgaggcgactgcgctactgccggagcggggcggttatggcggctccatattaacagcctcctcctcctccgccgccgccgccgtctcctcctcctcctcctttccctcccgcccgcgctctaagccatctccgccttcaccctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatggtatggtaattttaatcttactgtggttcatatgtgaatgatatcttaagctactattaaacacttcctaattattaaatacaaaaacattcttcaatttaattttaaaaactatttgtaagtaggtatatttatatacaatcctgttttctgcaaccactcttacatgacagttatgtgctattgcattatagtaaattagcctttattttgacttaaataacatgtaataatatacatgtaataagagttatttcgtatgtttattgttccaggaaaaaaaaa

SEQ ID NO: 705368 - DNA, 1151 bp, Homo sapiens
  misc_feature (1090)..(1090): n is a, c, g, or t
  misc_feature (1096)..(1096): n is a, c, g, or t
  misc_feature (1121)..(1121): n is a, c, g, or t
  misc_feature (1146)..(1146): n is a, c, g, or t
agcggggtgcggccgaggggcgcccgggactgcgcggggcgggcggcggcggagggaggaggggagagaggcggggccggggcgggttgttgtgaggcgactgcgctactgccggagcggggcggttatggcggctccatattaacagcctcctcctcctccgccgccgccgccgtctcctcctcctcctcctttccctcccgcccgcgctctaagccatctccgccttcaccctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggagtagagacaaggtcttgctatgtttcccaggctggtctcaaactccggggctcaagccatccgccctccttggctcccaaagtgctgcgattataggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccnaaaaanaaggtaatactggacaacctgttcnaactagccagaatggacttgggaanaaaga

SEQ ID NO: 705369 - DNA, 715 bp, Homo sapiens
ggtgaaaccccgtctttactaaaggtataacaaaattatccaggcatggtgatgtgtgcctgtagtcccacctgcttgggaggctgaggcgggagagttgcttgaacccaggatggcggaggttgcagtgagccgggatcgccgccactgacactccagacctgggtgaccagagcgagacgtccatctcaaaaaaaaagaaaatgaaaagaggatcatctgctgggggccgctgtggttcaacactgtaatcccagcacttttggggagaccgaggttggagcaacgactcatgcctggaagtgtcaagagaacattctgaagacgtatgccctggccccatcaattgggtatgcaaaccccgacgctgtacttacctaaaatagattatctgaacaacttaaggcgtgggggtacgatgggttgaaacattatgcactgtgaatcccatgcttacattcgtgggcaaggccatgaaggcacaggaagatatacgcttctgaaacccccgagcggcagtgttgggtacgggattggccactgttagagacccggaaggtatctacgaccccagatttgcagcttcgcagaggcctgcggaggagccacagaagctgggacaatccgatcttcagaaaaaacaggaacaacagagaaacaaaagtgcgtcgggcgcacccagggggcgcaagtggtggaaactccagaaccctag

SEQ ID NO: 705370 - DNA, 550 bp, Homo sapiens
tcatgtgtactataaaagaaactcattagttgcttaattacgacagtaaaatagcagcaagtaccaatgacatagtgcatcactcctatctaagacaagttacttcatttacatcagagttagaaatgttaagactggattacttgaatacttaaatatagctcgaatcactggttagatatggacgtatttgcccaactgtacatcagggaggagtgctttcattagtttcagaaaatgcagaccctcagacagccagcatgaccacaacactgagcaataagagaaatgaagcatttactttccaagcatttgccacaagaaggtaatggagtcttaacatatgtggtagtctcttccctccataagttaagggttgtgctttgttgaggcatttcagagaaattatttggcatgccactagtgatacttagggtcatgggtgtaggggatgattcagtagagctagtgaggcttgtgtatgtgaccataccatcttggagatgaatagtagagttgcagctgctgcttcatgtgaatgatagctctg

SEQ ID NO: 705371 - DNA, 818 bp, Homo sapiens
agcggggtgcggccgaggggcgcccgggactgcgcggggcgggcggcggcggagggaggaggggagagaggcggggccggggcgggttgttgtgaggcgactgcgctactgccggagcggggcggttatggcggctccatattaacagcctcctcctcctccgccgccgccgccgtctcctcctcctcctcctttccctcccgcccgcgctctaagccatctccgccttcaccctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggctccccggcggtcacgagatttcagcctgtgcagggattgggcgagagttccgcatatggaggcgcccttgctggagcctctcggagtggagcgcgtttccttctccccaccctgcctgagacccttctcagttaaggctttggacagactttgaaagggacccacctttttttttcctccttacagtttgtcaatttttgcccagtgcccataatattgcgtttgtgtcagacattggatttctatgttagatattaaagagcttacttgtattttcttggagagaaacaatgtttaattattaggataaaaa

SEQ ID NO: 705372 - DNA, 777 bp, Homo sapiens
agcggggtgcggccgaggggcgcccgggactgcgcggggcgggcggcggcggagggaggaggggagagaggcggggccggggcgggttgttgtgaggcgactgcgctactgccggagcggggcggttatggcggctccatattaacagcctcctcctcctccgccgccgccgccgtctcctcctcctcctcctttccctcccgcccgcgctctaagccatctccgccttcaccctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggctccccggcggtcacgagatttcagcctgtgcagggattgggcgagagttccgcatatggaggcgcccttgctggagcctctcggagtggagcgcgtttccttctccccaccctgcctgagacccttctcagttaaggctttggacagactttgaaagggacccacctttttttttcctccttacagtttgtcaatttttgcccagtgcccataatattgcgtttgtgtcagacattggatttctatgttagatattaaagagcttacttgta

SEQ ID NO: 705373 - DNA, 860 bp, Homo sapiens
tctgtatcacaaaaaaaaaaaaaaagaatagattcggggtgctcttactacttatggaagggtgagggataagtaagttggcttgaatgtagtaattacttcattatgtgtgtatatatatgtttatatcaaactatgtggtgtaccttaaatatatatataattttaaaaaatatgggaactctttcatcaccacagagatctccctcatggctaccaaaaagaaatagagtaatttaaatttggagattaaactgggaaaagggatattttataaagcaactagtggaccctggtattattttaaaaaacaaagaaagggggggtagatggcttaataaatctctggtatcactagctaatctggcttatggaatcttactaaacttccatagaatactattcctttcctcttataaggttgggggagttcataattgggacacaaaataaatgtaaatctatacataataatagtaacagctaaataattaagggaaggcctcctatgtgccagaacccggttctattacctcatggcatcttcacctcaaaccctgtgaggcaggcatggttatcctctccatttacaattgagaacaacctgtgtatttcactaatatatccttggtcaaggtcagtatgggtccttaaaaatactatgtaagtggaaatactggggtaatccggggaaagattactactacgtgacaccagaaagctcatcctttcaaatcccatagagattcagtggtggaacattcttttggaacaagatactgaagagcaatccagtgccagttaatatgggatccctaatacaggtccgatagacaccgggagcaattagcgaaagaatg

SEQ ID NO: 705374 - DNA, 265 bp, Homo sapiens
cttgctgtctgcagccccctctcggcaggcattggctcagcccgctgagtgtggtgggtcgtgggccagtccccgaggagctgggcccctgtaccaggcacacatggtccggaccacacccagcggtcccccgcacagccacccgtggggtgctgcccttatgcccggtgccgggcgaccaactccatgtattggctgttagtcttgtgattgttttgtatcaagaaatgattcaaaatagcatattaacaaccccaaccgaaaa

SEQ ID NO: 705375 - DNA, 371 bp, Homo sapiens
gggcctgtaaagaatcgtgtttgtacaggaccacgaagctcccatttggtagtggaaaaaccctcaaatatttcctatcaacagatgtgtgtgctagagaagaggaagttgtggaaaatatcccagtgatcctacaaaacattctctgtgttcctagctagggttttttttttttttttttttttaaatctttgtggcctctgagaagtagacttcttcaatttctggaatttgggtggccaaaaactcataaaggagagactcactcagataattccagtgactttaaaaagcaagctgagcattctcattcataaatgacactgatttacactgtggaaaatgtggtaagtacgtggggtacctggaag

SEQ ID NO: 705376 - DNA, 87 bp, Homo sapiens
ggttttacttatttgtaccatgtgaaactgaacaacactgtgcgcaggactgcgccgagcggccgcttcccttctgtcgtcttctcg

SEQ ID NO: 705377 - DNA, 1481 bp, Homo sapiens
actagttctagatcgcgagcggccttcctttctccaggaccaataaaatttctaagagagctaaaaaaaaaaaaaaaaaaaaaaaaaaaaaaaaaacaaaaaaaacaaaaaaaaaaacaaaaaaaaaacaaaaaaaaacaaaaacaaaatacaacaaaaaaaaaaaaaaagagaagagagaggagcacgccgaagcagggtggtgtcatatctagcgagagacttctaaaagacggccactacgagatcgcgacacacaacgggtgagtgtgtcgattgataagaagaggcggctctctctctttcttgatgatgcagggacagaatagataagccagtggaaaactacaccaccagcagcgcggttgatgtgactagcaaagcacaatgagtgatggcagcatagaaatctcatcatagatgaatggcgtatacatactttatctaatgaagaggcggagcaactaattcaaaaataaatgagttggtggagaaaaaaataacatagaatgaaattacaaaaaatcactttactatttctttatactctctcataccagcatcataatcacactatataatcaacatacccaatcaacactactagattcctcactcatctatacatcagatcgactcctacatttcaaaccacctagagacaaaacataatcactcatcaatagataatataaactgatcacaaatacatattggttatgtaacaaaaaaaaaagaagtatagataatatctacatatactgataatatcacaacacattaaatcattatctatacaaaaaatcatatatatccatataatagaaggaaaaacacgacaatcataaacacacaaaatcaaacaaacactacaaaaccacaaacaacaacatacacaccgaaaataacacaacataacatatcaactaaacaaataaaacaacaaattaataagcataaaatactatatacgaaaacagtccaatgaataatatacgctaacaactatcaaatagctcaaaaactcaaaacttcatctaacaagacaaataacaaatagataccaacaaaacttacataacatcaagaagttaaagttattacgatacactaaactataaagagaataatatcataaactacgtaaagaatacaactacatatacactcaccacacccaatatgtactacatcactactatcagtacgtcctaaaaatcaaaccaaacaacttatagcatactatgccatatacacaataaccacaacatcctctcaacacacaccaacaccacttcatctaccctactaagcgtaacgtacaatcttacgaccgataagatccaagactgaacccaacatatgccaaacaataagtcaccgagctacgaggatctacgcatgatacaacactaagcaaagactaacaatatcaagacatacatagcctatcatcaatcacatacatactcaccagcaat

SEQ ID NO: 705378 - DNA, 150 bp, Homo sapiens
cccacacctgttggtgatgggttggttggttggttggttggttggttggctggttggttagctgcagtttggggactgcttgtttttattataagattaatgggtcttacagcagaggtcagacaggtatgggcatctttaaataatttc

SEQ ID NO: 705379 - DNA, 1285 bp, Homo sapiens
  misc_feature (183)..(183): n is a, c, g, or t
  misc_feature (478)..(478): n is a, c, g, or t
  misc_feature (540)..(540): n is a, c, g, or t
  misc_feature (924)..(924): n is a, c, g, or t
gcgggaggtgcaggtcctggtgctctgcatggtcgagggctcatgctccatggcgtcctgtgcatggacgggccatcgaggtctaaacaggtactgctgggtcgggacggggtggtggtcgtgatcgctgtgaagagcattcacatgattgttctggtcagattgaactaagcgaggatagancaaggttgtgaacgtacccttgggcatttagcgtaccgcagaggtcggtactgtacagcaacacaaagcactctgcgccggaggaccgctcgtaaccatcgttccgtggctcccgcagaccgtacctcttactgggcgagacccagtagcgacggtactcgcttgctccacgaagatacaccaatgggatggccatggctggatgctggatgcgttactcaaatggtggtctctgacagtggtatccccaaccgtcccttagcggagcagaggaaacacacacagacgcgatcgngtgcgtgtaccgtgttcttgtcaccctgcaaggcggtccgttcgtacggtcttcgtagatgnaccctgaaacaaaggaaaaagggttttgtggacgctatctgcctgggggggggcctgcccgtgtgggcgtacatgcgggaagcggggtagagcggccgtgggggggaatagttaaaaccaataagagggcccaagagttcggaactggagagcccctaaatcccccatagggggggatgggcccaggccaaaagagaagaggccacaattatgtcacaggaacagacgcagcgggacagaggcaaatacgctgacataaaacacaaggggggccaccagggcaaaattccaccaagacggcgaggcacttttcgccattggaacatggcgccggtgcacaacagggtggcaaacagatcggcaagagggtctcccaagcatatngcaccacggcaacaacgggtttagcgggcaagggcaagcaggggaaaacacagagacatatcttgggctaagcaggagaacgcagtgttagaagccgacagacaaacggagcacaggggaggtatacacctaccgaaacatgggaaatcgccgccaaggcggtggggcaggcattacccacttgggtcggactttacatatgggaagggacgaccacgccaggaattacacacaacaaagggacaacctagagttacgcgatagacttatgtcaacacgcgtataccaaagttggacgcacgactttatcagggagacgacctgcggcagcgccgccgttattacccactttacacaccaa

SEQ ID NO: 705380 - DNA, 462 bp, Homo sapiens
gccatcaccgcgcggccgcgcagcggacaccggtgcgtacccggcctgcggcgcccggcacggtgagtccccggccgaagcccaggagcgcctctgacccgctgcgccggcggctgccgccccgccccgccccagcggatcttgcgcatccgacgtggccgctcgggggcgaccgggaacccgaggccatgtcccatgaaaagagtgggtgtctcggggacaagtatcctccccccaaacccgaggatatcccgggggggcccagactacacgatgcacacacatatgatcaagacatcccataccatgagggcactataacccaacagagccccataagcgagaacacaaccaaacaccaacaaaacagaaaacacaaaacgaacacagaagtcgaacagacaaaaacacaacaaacacacacaaacacagccagacaataatagacaatacaaacgcaca

SEQ ID NO: 705381 - DNA, 296 bp, Homo sapiens
  misc_feature (90)..(90): n is a, c, g, or t
  misc_feature (99)..(99): n is a, c, g, or t
tggggctgggagtagttgtctttcctggccctaacgttgagcccctggaggcactaaagtgcttagtgtacttggagtattggggtttgnccccaaacnccttccagctcctgtaacaaactggcctggactgttttctttcggctccccatgtgtcctggttcccgtttttccccctagactgtaaacctttcgagggcagggacccccccctgtactgttttgtgtttttcccagctcctcccccaatgctgaatatacagcaggggctcaataaatgatttttagtgccttta

SEQ ID NO: 705382 - DNA, 382 bp, Homo sapiens
gcggccgctactactactactaaattcgcggccgtcgactagagggtcagcaaacttttttgtgtaaggggccagagaataaatattttcagggctgggcacggtggttcatgcctgtaatcccagcactttgggaggctgaggcaggtggatcacttgaggtcaggaattcgagacctgcctagccaacgtggtgaaatctcatctccactaaaaatacaaaaattggccaggcctggtggcgggcgcctgtaatcccagctactcgggaggctgaggcagtagaattgcttgagcccaggaggtggtgggtgcagtgagccgagatcacaccactgcactccagccttggtgacagagcgagactttgtctccaaaaaaa

SEQ ID NO: 705383 - DNA, 229 bp, Homo sapiens
  misc_feature (27)..(28): n is a, c, g, or t
  misc_feature (45)..(45): n is a, c, g, or t
  misc_feature (161)..(161): n is a, c, g, or t
ttataaaataaaaaaaaattaaatatnnaaattaaaatatatatnaataaatataaaataaatatcctatacttactgctatatgaaaagcaatttacctgcaaccagtaaggacaactttgatatgtgcagttgaagtttcacatctagcaaactccttncagctgaaatcaagggaagaaatggtagaaaacctcctgctgataccaagaccaaggaacagcacacc

SEQ ID NO: 705384 - DNA, 1289 bp, Homo sapiens
ggaggatggcggacgccggtgttcgccgcgtggttcccatcgacctgctatcccctcgtgctcggcttcctgcgcgatagaccaatctcgtcatagtgctggccaataaggttcgtcacagcgacaggagctacacagcaggatgccaatgcctcttccctcttagacatctatagacttctggctcaacaggtctgccactgttcccagagcgaaacgattacagtgctaatctggatccatgtggtctaagaaatgctaagaacaaggccatcatccagtgtgacagctgagtgcacacgcagctgcaggccggcagcgcacggacagcttccacacggggccctcccagccaacacgtacacgtgcttgctgtctccctgcgcaatgctcacgtctggctcgtcgccgtccctgtgcgcaactgcctgcctcgccctcatacggccactccacacaccaaaccttaggccaactgctaagcctggacaaacaagttacccacacctatcaactgtcactccacctcaaatgcaaccgccacaggtaccccacacacacccaacacacccacgcccactatgctcaccatacaaatgcaggcacctttaacaccgccccccacatacaccccaacacacaggccacgtacccaaaacagaccatttccatacccattacactgaccaccggccacaaaaataatccctcccatcaccttcaccttgcacctatccatcgaccctacataaagtactctccaagcacgcgccaattccaataccccaaccatatcactccaactcctaacaaactccccaaaacatgaaattaacacaacacacttgctagaaccaacttaaacacaggccatttccaagcacttcaaacatcccactctttcacctcactactcacaaaacctccgcccaccacacctaccccactatcacaatggtagctcaccaaatatcacattataacgacacccccaaacatcaaccacacacactccacttcaacaaagacaacacaaattcatgataaccccctccacacattcacaccctcctacacgaacgactctaacacggcccactcaacaccacacctccacccaccaaaacacctcttaactccccatccccaaccccacaattccactcatctctctcaatacacccctcaaatctcaccactccacaccatataccacccatcaccaactaaatacaacattataccccatagcaccacaaatcacatccaacaataaacctactcattat

SEQ ID NO: 705385 - DNA, 631 bp, Homo sapiens
gattcgagcaattgatttttttttaaagaaatccatgccaagagagaacgatagacagggagggagcgagagagaaagacatggtaaccatgttctagcagccaaacataggagaataacttggcacaacttgatggttttttttgtttctttgcaaagggacaatctatatgctaccactaaaaggtatcttcctccaaaagataccatttgattttcgaaaacataacacacggttagtcctctacttcatggctggaggaggtatacggggtaacggatgaaaaaaatgtagaggaatttgagaaaggggttccctttatcgaggaagaccacagggtgctggagggcagcacatgtactgggcaccaggcagccagagccccaggatgaagaagcacaccacctagatggccatgctgcagagaagcttcagaggcgaatgaacgttccccaggtagtgaaaggtgcttatctagatcgtctctcgagatagctgctggcttgttgcaggcgctatatgcaaatccagaatatgagccagtttcggaaggaaacggaaatggttcttcacttttataaatccatcaccagggccctcatggccttattttattaataaccgaagccg

SEQ ID NO: 705386 - DNA, 396 bp, Homo sapiens
  misc_feature (383)..(383): n is a, c, g, or t
cgcgttccgaagcgcacgatcacaggcgccatgccggcgccgagcagggtcatgatcaggccgaagatcttgctcagcccggcgatctggtccttggtgaaaccctggtcgatatagaacacgtggccatgacgcccatcaccgtgtcggacatgcgataggtggcaatcagcccgagcagcagcagcgcctgccaacggtagtgcaggataaagtcgttgaccggcgtgagcacgggcgcgaggccccggcggcccatggctgagaggcacagggtagtgaggatatatagaggatggcgcgcaggaacgcgcggtcttccatcagcagttcccacaaactcacgccctggaacagcacgctggcgaagtggtgttgtacangcgtccgtagcgg

SEQ ID NO: 705387 - DNA, 647 bp, Homo sapiens
tggaagaacaaaaataaaactgtaaatagaaattccacaagaaaacaattgcagggaaaaggggctctggtgtttctttatatgcattgtaaattaacttaaccatgtacatatattaattaaaaagttcttttaagttccacaagaaaactatgccagggaaatgggttctagtgtttcttaatatgcttttgtgaattatttgaatttaaccatgtatgtatattaatttgaaattttttaaatgtcaaaagttatctggatagcagaattatgactatattattttctatatagcaaactcagataaatccttttaaaattattgtaattactatctgaaattaaactgctatttagaatataaacattggccaggtacatatgtctcaaattcatttttttgagaatctgccttagtttcatttctatgtcatggaaagagccattgggggaaaaaggttgacagaaatgtactttttctcctctgtagctctttatttgcagttttatgctctaagacttttcccttttatctgatctctggcagcttgtttatcccaaccaattatgcttcatgctatgagagaaaataccatggtgtctatgtgatagcaatataactgtttaaaaatcacatatttcct

SEQ ID NO: 705388 - DNA, 1150 bp, Homo sapiens
  misc_feature (613)..(613): n is a, c, g, or t
  misc_feature (655)..(656): n is a, c, g, or t
  misc_feature (678)..(678): n is a, c, g, or t
  misc_feature (684)..(684): n is a, c, g, or t
  misc_feature (695)..(695): n is a, c, g, or t
  misc_feature (697)..(697): n is a, c, g, or t
  misc_feature (699)..(699): n is a, c, g, or t
  misc_feature (711)..(712): n is a, c, g, or t
  misc_feature (715)..(716): n is a, c, g, or t
  misc_feature (721)..(721): n is a, c, g, or t
  misc_feature (724)..(724): n is a, c, g, or t
gatcacataactggatcgggtgctcctgatgacatcccaaccttaccaagggcttcggcatgattgggcccaaggacttcttcccacttctggacttgtgccatatatgcccagagacacactgcacctgatcatcgccacgcgctgcagagatgcagacgtgatgtcagcctctaccgccccgactgaaaatgctggcattttggagcaaagccggattccacacctgcatacctacttcccttcttatcctgtccagagccacccctagctgtcccccatgagatgaagaaagagctcctgagcagcctgactgagtgcctgacggtggaccccactcagtgccagacgtctggaggcagctgtaccctaagcacctgtcacagtccagccgttctgctggagcacttgactcacgctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgtngctgctggtcttcgctgataggcttcctgtgccatgacctcnnggtcacacagatccttccaggnctcccnttactggccgntngnttcgaatcatcnnggnnttctntancctgctaagcccaagccataccgcctggttgatacgcccccaacaagtggcattccctaaacattcaccgtaaaccgaagggcttccctttcggccaaactggggggccaataaaccgactgggcactttaggtggaccattttgggagcgggcggggaaactggaatccgaacccttggggccccctggcatactgagggctcccaacctggctcaccgtggtgcggcccagcttgcagctggcctgggctcacaccaatgccacagtcagacttcctttctgcccactgtgcctctcaccttgcgtggattaggtgacagtctcaccagtctctctcagaaggatacagatccagcataccccgattccgtgaatcacgctactccgctatctcgagcagagctgcccctgcaataccaccaga

SEQ ID NO: 705389 - DNA, 88 bp, Homo sapiens
  misc_feature (34)..(34): n is a, c, g, or t
ttttggctaatcaatggagggggagatgagtaanacaaaaaaaaatgaaatcttactaattcattattgaataaagaccacttttatc

SEQ ID NO: 705390 - DNA, 200 bp, Homo sapiens
  misc_feature (190)..(190): n is a, c, g, or t
ctggctacttgagatccaacgaccgaagacttgacatatctcataggtgcctgtccttgtcttggcactgtctgagcatggcagaagtgctcaagtcagcacttcacattcatctcattactcttgaggttcccaggacttgagcacctcggcgttggtagggttctggcccaggtgccctcatcacatncccaacactg

SEQ ID NO: 705391 - DNA, 598 bp, Homo sapiens
  misc_feature (10)..(10): n is a, c, g, or t
  misc_feature (13)..(13): n is a, c, g, or t
  misc_feature (57)..(57): n is a, c, g, or t
  misc_feature (73)..(73): n is a, c, g, or t
  misc_feature (106)..(106): n is a, c, g, or t
  misc_feature (111)..(111): n is a, c, g, or t
  misc_feature (120)..(120): n is a, c, g, or t
  misc_feature (128)..(128): n is a, c, g, or t
  misc_feature (136)..(136): n is a, c, g, or t
  misc_feature (175)..(175): n is a, c, g, or t
  misc_feature (212)..(212): n is a, c, g, or t
  misc_feature (457)..(457): n is a, c, g, or t
  misc_feature (459)..(459): n is a, c, g, or t
  misc_feature (483)..(483): n is a, c, g, or t
  misc_feature (496)..(496): n is a, c, g, or t
  misc_feature (500)..(500): n is a, c, g, or t
  misc_feature (545)..(545): n is a, c, g, or t
aggggggaanagnattcttccaagatgtttaggagatttggagtattggtttagganattcggggggttaganaatttcggtttaacttagaacagtaggtagccntggantaacagtgntgtagaanataattangaattcttttttcagtagttttttccccagtaaaacgcnttcagtcagtgttggcactgtatttaatttgacattntgaacagtggtattccagagtatgtgcagtaaactcacctgcctacagaagagtgacccaaatcctgtgattaagaaagaaaagaggggccaggtgtggtggctcatgcctgtaatcccagcactttgggaggccaaagcgggcggatcacgaggtctggagttagagaccatcctggccaacatggtgaaaccccgtttttttactaaaaatacagaaaatgagcccgggcatggtggcatgtncntgtattcccagttattcaggaggntaaggcaggagantcanttggacccgggaggcggaggttgcagtgagcccagatcgtgccantgcactccaacctggtgacagagcgacagagtgacagagcgagactctgtctc

SEQ ID NO: 705392 - DNA, 1220 bp, Homo sapiens
  misc_feature (910)..(910): n is a, c, g, or t
gaaagcttgagtcggggggcggccgtgcgaattgaggggagggaactgaagaggaagatggcgcggagcgggagtgcggcctggagcgacccggaggactaatggcgggaacgggaccagctgtactacgagtgctactcgggacgtttctggtccacgaggagatgatcgcggacctgcgtcctgcacctgagtgccatacctgcctgggtatccttcgagaactgggcagctgctgcggagtgcaagacgggtagctgggacgttgttggcgctgggcaaccggcatttctgagcattcttctagtgcccaggcctggggccctgagcgcgtgtacgcggtacgaaggccagcgccattctgtgacaaaccatgtgcccgggcgagggtggtgcgggttcaaactgtggctgtgatgtgacccgggtgcacggtccttggccgcggaccaggtggagactgtatgagcttgccgggaacaggttggattgcccatcagtggagcgagtggatcggggctagcaggaactaccttgagacggaaaggtccatagcttgaggcttccgtccctccaatgcagactgaaacacggaggtgggcctggagcggaaggggcgggactaacatacctttgccgggaccttccggcacgaagtctaccttcgataggccacaccaattcaaggcgaccaaagaattgcctggggacatttggcgggcccgtggggacttccattggaggcccaagggatggaacaggcaagcaaacttattgggtggtgggaacaattgagaagacttggccctgggaaaggggacttgatcacccaactcggcgggcctggtcctccattgggggcccaacatccgggaagaatacgtgttggtggcaagggggaaatatgtanccagagcagagaacgggaaccgattgctatggtagcccgtgaccggacagtagcaggactaattgcgcctgcagaggccttagaagacattcattccacgtcggaccggtggcatgtggcgaagacaatgtggaagccatgtgacagcgggacagaggaagtatgttgtacatgtggtacagcgcaattcacagggcttgacagcagttggcaaaaaagtaggagatcaggagagggccgacaaattgcaatttggggcgtttagggcgcaacacatagtgtattaccagagtggtgaaacgatatccac

SEQ ID NO: 705393 - DNA, 272 bp, Homo sapiens
ggtatcacttcagaggggaaccggcagactaatgtgttaagcaagccagaatggtacttggctcaagtaccttattgtggaatttggaacccattacttgaattcctggatgagaggatccagccatttataggcacagagttagcgctctttggtaaccgcaggccttgattttctctcggggccctaatgatgctggtctctagagaggtagccactcatatcccttgctctgctatatgatgacactctcttctgtcatagggtggatg

SEQ ID NO: 705394 - DNA, 829 bp, Homo sapiens
tgtagggcccgtacctactgcagtgggttcagggaaatgggattgacttggccttcaggcttcctttggtcataatttaaaatatgggagtagaaaacaacaaaagaatggaatgacctcttaaaacaatgaaagagcatttatcgtttgtcccttgaatgtagaatttgttttggatttcataattctgctggtaattgtgacacgttaacaatgggtgcattatgtatatatatcataatttagaaataccattttataattttactattccaggttgaccatattgcatttaaattgtgggattcggtggagtatcatgttcaaacctgggagtggtcacgtatgagtccctcaggaaacacaacacaatttccgggtttaaaaagcatcgtgattctaagctcctggaaacctatggctactctaaatttcccattattttaacacattttcaccactttcttcactttcagcaattggccaatacttctaaccttggaggagggggtttgtacgaacattaccttttaggtaagatgtcccccaagatttaggtcttaacctttaaaccttttctcttaaaacaccagttggttggggcgtcaccttttaacccaggtctagagtacgtggtaataatctggcaacgtatctgggagatatcacgtgcaacgctaacaggtctaatttaacatgaaaactccacttgggttgggacataactccgtttttcgggcacaccggcaaacagaacaaaacattgttcgcgcccggccgagatgttcacacactcttggggggcgccgtgacaaactcgcccctttca

SEQ ID NO: 705395 - DNA, 745 bp, Homo sapiens
  misc_feature (1)..(1): n is a, c, g, or t
  misc_feature (140)..(140): n is a, c, g, or t
  misc_feature (162)..(162): n is a, c, g, or t
  misc_feature (173)..(173): n is a, c, g, or t
  misc_feature (179)..(179): n is a, c, g, or t
  misc_feature (187)..(187): n is a, c, g, or t
  misc_feature (189)..(189): n is a, c, g, or t
  misc_feature (200)..(200): n is a, c, g, or t
  misc_feature (271)..(271): n is a, c, g, or t
  misc_feature (295)..(295): n is a, c, g, or t
  misc_feature (348)..(348): n is a, c, g, or t
  misc_feature (379)..(379): n is a, c, g, or t
  misc_feature (396)..(396): n is a, c, g, or t
  misc_feature (409)..(409): n is a, c, g, or t
  misc_feature (423)..(423): n is a, c, g, or t
  misc_feature (431)..(432): n is a, c, g, or t
  misc_feature (443)..(443): n is a, c, g, or t
  misc_feature (476)..(477): n is a, c, g, or t
  misc_feature (482)..(482): n is a, c, g, or t
  misc_feature (493)..(493): n is a, c, g, or t
  misc_feature (718)..(718): n is a, c, g, or t
ngcgaaacccaataaccccaccggttacttaccagtaatgggggtactatttgaagcatcgaaatctattggagatgacaatttagagagctggacaaaaatcatataatttcaagtataacaaacttaaatggcatatncaatggtaagaacattaaaagnatctgccccantatatnaacttagngntgccctttttntcttcttcatttttaaatttcaaaagaggccacattccgatgacacttggccaagaaatgtaggaaattcnaaagtccttattaaaacgtctccngccagaaggaaaggagacttgattcaattaggccttttgcatctttggaagcngggaggggaggaaataaagacacctttccgncctgtgcaataacgacngtgtccgtttggnggcaatattcttgnattgggannagtctctctgnggggcaaaacaaccgcggaaacgggcctgacannttggnaaaattatccncagggtggcacaaaagagcattatctccaaggccagtaaggtagtaactcctggaagcaataggcggaaagcagaggtttctctccttcatgccaaggtcatggtcactccaaaggtgagggatgaaacagtaaatatataatacagaaatatccctattctctttaaatgaggaaaacaaagaaaagtaagtatccaaagagaacaattttactttaaaaaatncaaatatctcaaaaatatatgttaaga

SEQ ID NO: 705396 - DNA, 513 bp, Homo sapiens
tgggacatgcagcgccagtaaggctacattaggcttatgccactattgtataggttctcccagcagttgacgagcatcccttgaaatcattgcccttagatgcgataaggcctgggcttgcaagcactaacgctcggcccatatctaactggtactactatctcagacgtccggctagtcgctgcacggttgctatacagtgacgcctagtctacgcatgaccaatctcatattcttacgcacgatgtgcacataagacatgcgtaacatatcctggcttcccatgatggtaattgcacgccactgcttgtgaagcctcaagtgacacatcctacggcggtctgacccttagctactagatacttgctgtcaaatgactagaaccagacgacctgctactcatggctgcaaataatcgcggaggagtaactgtccgaaacctccatttctttgataaggacagcacggtcactgcacgactttataaaccttgcccgcaatatgagttcacca

SEQ ID NO: 705397 - DNA, 190 bp, Homo sapiens
  misc_feature (169)..(169): n is a, c, g, or t
gatacctgggaccattaacaagctgcaccgtttgtcattctgtagtgccaagttagatcaccccagttattcctctcacatccgattccaccgcaccagtggaacaggttctttctcctcagtaccagaaacatcccacacacgtcgcacagatctggtcacaggctgnctgttactaccaatgtcttct

SEQ ID NO: 705398 - DNA, 1115 bp, Homo sapiens
tcgaagtggtcattacttcaaatcacgtggcaactttttaacccgttgcgtagctttgtcgttcctttgcctgcctaaactggtgtacaatttccgaccagtattatgcgtcagagatctgatgcccatgtttctcagctccgtgcctaatccagggcaaacaaatagtttatacatcaatattgagaagacttggcattttattaacattgtgcatacttggaccatactttccttaattaagtaacgcactaatatgtttttggaataacgtgctgggtttaaaaacccactgctaaaggcaataagctgttgattatagctagcctcctgattatctgtactgtggatttaagtatgctactttctctcagcactccttataatcactggcccctcaatttatctacgtgctcacccagggattcagagcaagaagtcatgtgctagtactacgaaactgtatgccactaaaatatcagagcttgttgggcatgaacatcccaacttcttgttccactaatatggctctggtttggaaagatactgcaaactcagaaagaatgatttgcagaagagaatgcacaactatggtgtaactgtaaactctgggcagcctctgaatgaaatgctactttcgtatgtagaaactactaatagactgccttagagcacttactgaggtactacaactagtaatttaatgataccatttaatatggcctccgtaaatgtcttcagtgttctatcagggtagttgggatctcaaaagactttggttcagatccaaacaaatagcacattctgtgtctttagctcacgtagttttctaagatcacaagaaactgccacacatgcaaaaaattgtctactactcggttggacaaaccaaatcagttctcaataggaaatgaccaggatgcttataaaaagttataaatatcgagtagctctaataacaaaccacatgaccaagagggaagtgagcttgtgcttagtatggacattggattcgccagtctctcgtaatcactagacttatgtgcaaactggtgctagaaattctataaactctcttgctgtttctaatataaccgccctgtgtttattttgtt

SEQ ID NO: 705399 - DNA, 418 bp, Homo sapiens
atattatagtagatgcactgtttatctgtgggggctgggatattgccttaactttgcgattgagtgactgtgttgaaacagtactgaaagcgttggtactcagacaaatagctgaaaactagtgaatgctaggttgttatcaagtttttatttgacattacggttacaaaggtatatttattttctaaatatatcggacttttttgtttgttaactctttattagctgctaagtaacattaacgtgtattacatgatgtgttccgttaacccgatttatggaagacagtacagaacagccctctgtagtcagtaaagtttcaccttctaaagaatatatattgaattagtttcatgacctctgtgaaaattctgacccattacttgccaatttataaaagcctatattattacaaggc

SEQ ID NO: 705400 - DNA, 198 bp, Homo sapiens
tgatccgaggatcccggaggtcgctgggtcagaggcagaagcttctggtagcttcctaagtattttttttttggaccctcacgactgtaatatctatgaggttctctgtgccctgaatttataatccccaaacctcaattaactactctcctcatgtatccctacaaatggttcccctactgtagtcactttccacag

SEQ ID NO: 705401 - DNA, 219 bp, Homo sapiens
  misc_feature (16)..(16): n is a, c, g, or t
  misc_feature (25)..(25): n is a, c, g, or t
  misc_feature (51)..(51): n is a, c, g, or t
  misc_feature (57)..(57): n is a, c, g, or t
  misc_feature (66)..(66): n is a, c, g, or t
  misc_feature (195)..(195): n is a, c, g, or t
atgattttgaagctcnacaaaattnaaaagagcacttgggcaattaattcntaatgnaatttgccnaagcatgtcatgattgaggaaaacaaagcacagctggctaaatcaacactctaatcagtatagtgaggaagcagcaggtgatctgccttacttcactttatcctctggttttagggccagacgccagangccatgtgtcaattttacccttcc

SEQ ID NO: 705402 - DNA, 864 bp, Homo sapiens
agcggagtcagtcacctcacgcgcgcctccaggagcaaggatggagaggctggtgatcatgtgatgcccttctgtcatctgatctagcctacagacctggtttgggtcattggcagcagtggtgctgtgcatcagcacaagtgcaagtggtgacccaaggactgaaagagagcacctgtacactacctgcttccttaaaattgctctctgcataaatgcccaggaagccctcattgtgacattggtcgagaaataaggaaagcatgtcaagcccagaaatacactggtcaccttcagcgatgaaccatggggtggtgatccagcctgcctataaggaccagataaacattacccagtctgggactccaaaattcaaggcatcagcttctggaatatcaccctggtagtgatgaacgggtgcttacatggtgctctacttcaaatacctattggaatttggggaatgatcgtccaggacatcgggcctgcctacaccgtcgtatgtacagggccatagtatcccttcaggtacaaattctctgaagagcacctaatatatcacttgctctgcgactgcccgtccagcccccatggtcgttctggaaggtccctcggccagggattgaggactagtgcagtgactctgtctcacccatatgtggaccacatctggtacccagctattcctccatatcaagaaccctacgtaatcaggtggggcaaggacgctaatctgccatggtgcctgcagcttggggactgtgaacgacctttaagcaaaccggtcacaagaggctagtaggatgcagattcccgctaagtggctaaagcattgttttccctggtaattacttcgtcgtccta

SEQ ID NO: 705403 - DNA, 362 bp, Homo sapiens
tgtgaaggagacccactaatgggggagaagctagtccaataaaaatgtttggtttccccctaattgacatttaacgcttctcatgaacaaaggactgtgccttacatatctgtggtatatagcatacatgtctgatactaacacatttgctgcataactttgaagcataggtaattccacgcttgggataggttgagtttgaggcctgtgacccaaatctaatgggcttttgcaaattcttagcagcagctaaggagggaggtgggcacccattatggagctccatactgtgtgcccccctccacattgtggtgcttcaccctgcacttcttgcttttcctctccaccatatgttccaccaa

SEQ ID NO: 705404 - DNA, 349 bp, Homo sapiens
tagtaatactagtacaaccaggagggagtctctgatgatctgattaaaccttacttagacaggtactagagcctgggtcttgagtgtgtccgtggcaagatttacttttcctcctcctggactggagcttctttttctttttcccatgttcctttaccctagctgcagtgggtatccaccagtgttctccaaccatgggtttcaagtccttcccccaaagactaagcctttttttctgtattggggataaagggatctgggtaggtttcacagtgggtgctgttttcctcagccagctagccagcaccatggtgggcgctttctctgggatttttccctgatcttccca

SEQ ID NO: 705405 - DNA, 234 bp, Homo sapiens
tgaccagggtaccctggtcgtgaccagggtatcttggccccagcagatcctcgccacgatgggcgagctgaagttgttcgggatgaaggcggccaacgacgagatcatcaaggtcgcagtcaagcgcacccacgagccgcagcagatcgtcggcgacctgctccaggccgagatcagcgagaagcaggcccgctcgatccgctaccagatgacgatcgccaagctgccctgggg

SEQ ID NO: 705406 - DNA, 1287 bp, Homo sapiens
  misc_feature (518)..(518): n is a, c, g, or t
agcgggcattctgagtaccatggcgggagcggtggctaacgccagggctgtgagtggcgctgcgggtctctgggggtgctcgtcgcgtgacgtggaccgacggacgggcatgtgtgggcgagcacatccgccttctgtagtcttgcgcaggttggagagtcgggagaagcagcagcacggtggtgtccggtacaacagactgcgcacacaacctagtcaagaatcccaactgtggagattgaactgtgtgttccaacacaggcagacgtactctgaccctttcgagtcgtagatattgcttgcgcgtgcaaaaatacgtctaggctgcgctatacgcgtatttgttcacacatctatacgagtttcaacgggatagttactcctcgactggtcaaactagatgctatatgaagagttacctagttaagtccgcgaatctcttaggactgggacttggtcaatccacccgaagaattggcgtagaatcggttacgccttctatggtggcattcaacggnctccaaaatagactgacaagctataccaagagtccatcatgcgagttgtaccctgtagggactagacgagatagcgagacagtacactctagaacattcacgggccaagaaaggcatgttttctcctgggatggatcaaaggtcgttcatccaaacgctggtttttgcttcagtcctttggccgcgtattcaaaacttcccaccaggggaaattctctggtggctgcgatgagaaccccatacaccaacaatgtgagttgacagtgcctgaacatgacaccccgagtaggaagaatcaattgctgtgggatgatctttgataggttttaaggacaaaggttcgtagaaacgaaaactagggattgatagagatacatgggaggagtaagtcgtagcgagtcaactgattgatatttggaagaagggtccggatctttattgccataaacaccacatacaccccttgaaaatacttaagggagacattgtggaattcccattgaaaccaaggaaattttaacttgcgtccttatactatatgtggggaatcagggttcgcggtgtctttaacctgtggaagaaaacgggaatcttttgtttacattccataagttgcgatgggaggccatagaatgatttaggtaagggttaaccaggtttaatttgacttcagattttgaaaacagttagaaattggaggggtggttcgagaatggtggtaaggaaaggcgcaaagttgtttaccgcattggggggtacacaaatgtag

SEQ ID NO: 705407 - DNA, 184 bp, Homo sapiens
atatagctggtaccagtgttactcacaaacaggcaggcgcagtggctcacgcattatcccagcactttgggaggccgaggtgggtgcatcacgaggtcaggagtttgagatctgcctggccaacatggtgaaaccccatctctactaaaaatacaaaacattagctgtttgtggaggtagcact

SEQ ID NO: 705408 - DNA, 286 bp, Homo sapiens
tgtaccagttcgacggagactctccacttgcgcgcgacggctgtatgggcccgatcgctgccatgcgcccatccattttcaggtcgtctagggtgactatcgtgcagagtgagtgtgttacacactccttagtcggattcgcgatttccatggacaccgtcctgcgtgtctatatcaaccaaaagcttaactggggtctgatgagcgtcggcgtcgggcgccttatcccggcgttcggtgtcatcccggtcagccagttctgtttaccacaagtggccctactatg

SEQ ID NO: 705409 - DNA, 512 bp, Homo sapiens
attgaggttaagggccactctttttttgttttatcatggacgcattattttgtattggccagggccagtagggatataatttgataaagttgccattggaatattattcacagaagatgtaagaaatttccgcatggtctaaatctttggggactttatttggaaattatttgccccgggggtttagaaaaaagtttttgaattttaaacctgctggattcatgcagcccgctttgcggggtatcagagatccaagattggaataaaaattttgttaattggaagccaaaagttatttttatattaaaacccgtctaattgttccccccaattggtcccggtttcatctaggcaaagattcagtaagggccttggccacaaattgaattttcttagctggggggggtttttttaaaatttgaaccccaggggggttagaagaccatcaaaaaacatggatgtttcgggaaatttgccccgtccttaaaaaaaaccacccgttttcccgggga

SEQ ID NO: 705410 - DNA, 207 bp, Homo sapiens
tcatggaaacaaagtgtctttcgagttgtttaaaggaaatatcgtggaattctcaaatgcctctttaaaaagggattttaaggccaaggtgggtggatcacttgaggtccggcattcaagaccagcctgaccagcacggtgaaaccctgtctctactaaaatacaaaaattagctggatgtggtggcccactcccgtcatcccagct

SEQ ID NO: 705411 - DNA, 193 bp, Homo sapiens
tgctgctgcggtgctctgaggtccccgcgctgcggcttagtgaacggcacggtgaggctatagcccttgagcgggtacaggggcaggtgcacccctggcaacgtcagcagtgggctgcgatggccggcggcaatcaccagatgctccactgtgcagcacttcagtcccgttcacattaatgcctgctagcgcg

SEQ ID NO: 705412 - DNA, 275 bp, Homo sapiens
aaaggcgttctttgcgcgaaccttgcgcacacttgaacatgtgtgacaccttgctgtcgtctccacctcatgatgctcccgagatgcactccactccccattcgagcgcgaccagagtacctactatgtgagcacagagtggctgctgtgagaccctccagacacccgagacaatccaccacagggggtacccaccgctagacacgacagcttgcttcacagctctttctgctcaagcattcattgttgggcatgatgcaccagagcgaacctct

SEQ ID NO: 705413 - DNA, 2114 bp, Homo sapiens
attataaatctagagactccaggattttaacgttctgctggactgagctggttgcctcatgttattatgcaggcaactcactttatcccaatttcttgatacttttccttctggaggtcctatttctctaacatcttccagaaaagtcttaaagctgccttaaccttttttccagtccacctcttaaattttttcctcctcttcctctatactaacatgagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactgtctctcctcttccctcctccatggatctgcttattcaggacagccctgattcttccaccagtcccaaaggcaaacaacccacttctgcagagaatagtgtcgcaaaaaaggaagacaaggtcccagtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagaaggcctcagcacctacctaccccagcctctactcttcctaccaccagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgctttggaagctgctggggaaggccttaatgtaatacagcagaccactaggtattttagtactccacaaaccatggatttattcctaaactactccatgaacatgcaacctgaagacgtgtgaagatgagtgaaactgatattactcaatttcagtctggacactggctgaatccttcctctcccctcctcccatccctcataggatttttcttgtttggaaaccacgtgttctggtttccatgatgcctatccagtcaatctcatggagggtggagtatggttggagcctaatcagcgaggtttctttttttttttttcctattggatcttcctggagaaaatacttttttttttttttttgagacggagtcttgctctgtcgcccaggctggagtgcagtggcgcggtcttggctcactgcaagctccgcctcccgggttcacgccattctcctgcctcagcctcccgagcagctgggactacaggcgcccgccacctcgcccggctaatattttgtatttttagtagagacagggtttcactgtgttagccaggatggtctcgatctcctgaccttgtgatccgcccgcctcggcctccctaacagctgggattacaggcgtgagccaccgcgccctgcctagaaaagacattttaataaccttggctgctaaggacaacattgatagaagccgtctctggctatagataagtagatctaatactagtttggatatctttagggtttagaatctaacctcaagaataagaaatacaagtacgaattggtgatgaagatgtattcgtattgtttgggattgggaggctttgcttatttttttaaaactattgaggtaaagggttaagctgtaacatacttaattgatttcttaccgtttttggctctgttttgctatatcccctaatttgttggttgtgctaatctttgtagaaagaggtcttgtatttgctgcatcgtaatgacatgagtactactttagttggtttaagttcaaatgaatgaaacaaatatttttcctttagttgattttaccctgatttcaccgagtgtttcgatgagtaaatatacagcttaaacat

SEQ ID NO: 705414 - DNA, 202 bp, Homo sapiens
  misc_feature (41)..(41): n is a, c, g, or t
ccaagggttgagacaagctgtatctataggctgtaatgtgngaagtactacgacccgagttcctcgtccagatcgagagcacaagcaagcacacacgcgcacaggcgcatggctgcaacagcagcacgcagagcaggagcacacgcagccagaagagcagaagagggaagcaggcgcaggcgcacgtacaggatagcgcgct

SEQ ID NO: 705415 - DNA, 488 bp, Homo sapiens
ttgtgacggtgtatactacttgaccaggagcaaatgactgaaaaagatcagaaaaacagggagagagatgattatgtcttcccctcatttgcaatagctagcatgacatgggagaaacggacatcctgggcttgggagacattgatcttcagaaagaagagaagctatctctttaaaaaggtccttaagtggttagattccaaagtgtctaaggagaagttgtagttgcttcaattttactttagaaattctctgtaactgatggtctgaagcaagatttcttttaagaaggtgccttgttctactataacctttaggttttatgctctgaaacagaacccccaaacaactctgaacaataaggatttgaaaatttattcaaaacagtatgatatgaagggatgtggtggctgcatctcccaaccagagggtagaaggcaggtgtactagacaggtccagggacccaagaggtaggggtcagaaggga

SEQ ID NO: 705416 - DNA, 771 bp, Homo sapiens
agcgcccgcgagtgacatggactctccgtccctacctgagtgacgtgcgggccacattgcaggctgccctctgcctggagaacttctcctcccaggttgtggaactgacacaagaagccggaagtgggagtcaggagtagcgaagagctcctgttacaacgctgtgaccatcagcaggaatgatgaaggaacaaggttacggattgagggctccatcagagctctgtccgggtcagcagagcatgtgataacaggctgatgagatcgagaagattaagtgccacaagttcatgcgcttcagtgatgatgcgagcagagaacttctttatccttcgaaggaagcctgtggcggggtatgatatcagctttctgatcaccaacttccacacagagcagatgtacaaacacagagttggtggactatgtgatcctaggttcatggacggagatggacaaggagatcagtgagatgaagctgtcatgtcaatgcccgtgcccgcattgtggctgaagagtaccttaagaactatgggataaccaatctggactggatctcgatgggccttcacccacatcagactgacccatgatgtccaacgaaggcgtactggagtcactccccgagcaagcgcggcggacggcagggagttggggtaggagagtggcgcattttgatggcagggagagtgaggtggatgtgactatgatagacatggtgcaaagagaagcaagtatgttggtgcgtgtacccaaggccaaaacgtgcctgtg

SEQ ID NO: 705417 - DNA, 659 bp, Homo sapiens
  misc_feature (56)..(56): n is a, c, g, or t
  misc_feature (67)..(67): n is a, c, g, or t
  misc_feature (572)..(572): n is a, c, g, or t
cccaagagaataccaagacaagcaggctgttccctggaaaaaatctaatgcaaggngggctagtttnagcaaattcactgcctcctcccatgcacgtggtagagagtaccagtatcaacatggccctgttttctgctaaaaccagattttgaggaatcagagacccccaacactactcactcagtagctagcagccccttcctttcaactgggagtgttattagaatgaaaagtaattagttagaagggcatacatctcagtggcatgagcattgtggaatatcctttcctaggcacatttgtccactaagggaacagcctcagaaactggtacagcaatgggtgagatgagatcctggagagagaacacagccatcccctatagaaaggcacagcttttgggcttctctggcctgaatgccttctggggtatttccatatgcaacagcccagagtcatagccttgggcaaccacacataggaggtttccttcttcacttcagacacatacatcactttcacaccacttggggatgggaattacctacaagagttgaaggttcaaggggccntccccagggttttctttctttattcagtttcctcctgaccagtttgccaaccattggccagctatggggcttattcttcatttgttt

SEQ ID NO: 705418 - DNA, 120 bp, Homo sapiens
acgatcgtcgtacctcgtatgcaagtgtcatttcatccaccctttgtccaatagtgcactgactagtttgtactgctcgctagcatcggacacaagtctatccagcccttctctggctct

SEQ ID NO: 705419 - DNA, 143 bp, Homo sapiens
ttccctgcctggactctatatgtattgtcactttgggagcttatgattccacatgaagtggataaccagctcatagttcttgtggtactgaaacacaagtattcagccaggcgcagtggctgacacctgcaatccccggtcga

SEQ ID NO: 705420 - DNA, 894 bp, Homo sapiens
  misc_feature (474)..(474): n is a, c, g, or t
  misc_feature (518)..(518): n is a, c, g, or t
  misc_feature (568)..(568): n is a, c, g, or t
cttacaccaaagaacaacgattactcgaccctaaagcaactgggcagaaaaacacccacctctgcgcatccccagttcctacaacaccctttctctccgcccctgctccacccaacgcttcccccttgctcccccactgtccctatggcttaggcctgctcaccagccttcaccccagcggcctctggcctacacgagcgactgccctggccccagggcagctacactccaccagccactccttccaagcttctgcctccacaacctggctgctgcttccctccctgggcactggcaccttgcagcctcactctctacacgggcaactactctgggccccactccctggcgctcagccccccttctctaccccctcttaccctgtctgcctagctcacccctctccttaacacccctcgctccctggcaacacactcgtgcactctggccaactgcgctgccacacacgccagncctaccacgccgcctcaagctctccttgcccactcctccagcgnctcctgcgcttccccactgcagccacgctgctcagccgcttcagacaacnccctcagcaacgctgcccagcccggctcaggcctgccccacatgcactcccagctggcagcatcgccccagccagagcgcagcagctcccctgtgggccttgccaccctggctttggctcagatgtgctaccgcaacccctgccctccatgcccgccaaagcttatcagcgctagactgaactcggcaactaccgacagcgagcagggcccgcgccgacctcacctacgcccggacctgtgcctgcgcccctgcgcccggaccctgccttccctctcccgctcggcctcatggcgccttcaccttcgcgcgcactctgcgctgacg

SEQ ID NO: 705421 - DNA, 762 bp, Homo sapiens
  misc_feature (3)..(3): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (39)..(39): n is a, c, g, or t
  misc_feature (46)..(46): n is a, c, g, or t
  misc_feature (57)..(57): n is a, c, g, or t
  misc_feature (60)..(60): n is a, c, g, or t
  misc_feature (62)..(62): n is a, c, g, or t
  misc_feature (77)..(77): n is a, c, g, or t
  misc_feature (79)..(79): n is a, c, g, or t
  misc_feature (109)..(109): n is a, c, g, or t
  misc_feature (156)..(156): n is a, c, g, or t
  misc_feature (216)..(216): n is a, c, g, or t
  misc_feature (236)..(237): n is a, c, g, or t
  misc_feature (243)..(243): n is a, c, g, or t
  misc_feature (245)..(245): n is a, c, g, or t
  misc_feature (262)..(262): n is a, c, g, or t
  misc_feature (269)..(269): n is a, c, g, or t
  misc_feature (279)..(279): n is a, c, g, or t
  misc_feature (310)..(310): n is a, c, g, or t
  misc_feature (358)..(358): n is a, c, g, or t
  misc_feature (378)..(378): n is a, c, g, or t
  misc_feature (393)..(393): n is a, c, g, or t
  misc_feature (406)..(406): n is a, c, g, or t
  misc_feature (437)..(437): n is a, c, g, or t
  misc_feature (483)..(483): n is a, c, g, or t
  misc_feature (536)..(536): n is a, c, g, or t
  misc_feature (662)..(662): n is a, c, g, or t
  misc_feature (677)..(677): n is a, c, g, or t
  misc_feature (730)..(730): n is a, c, g, or t
gtncaccaaatttanttnaaaaancaaaaaacgcttccnacaaaanagcattacatnccncncaccgccccgaacanangccagggacatgtggaccattgttaccttncccccccgccccaccccccaaatgttacagtgaccacaaagcaaggngttcacaaaaattacatggggggaattttttaaaccaccaacaaaaacgaaaaaaaaaanccacccaccccgccgccgtnncaaaantncaatgttagtttttgcncgccccncccccccccnaccccgtttgtaaggaaccaaaacattacanccggggaacagcaaagatttcaccacaccccaaatgcagaacacccangaagcagaggaatgttggcnttttaaacagaagcngaaaaaaaaaaanaagcaggacccccccagtcccccaccagtcntagaaaaaccttccagaataccgcctcacaccgttccgcagccaanaccgtgcattccgtatccggccccgggtccccgtaatggtaatgatccgatcntcggatccctctaaaggctcatcaattttgatcgaagctcccgactcatgacggatttgtttaatccgctgaccacctttgccaataatagatccagccaaatctttgggaatagttacttgtgtngtaataataggtccnccaagatcaccatatgagccacgaccccctgcataggaataatcatatccggngccaccctgtggttcataagccatctgccatt

SEQ ID NO: 705422 - DNA, 1033 bp, Homo sapiens
  misc_feature (131)..(131): n is a, c, g, or t
  misc_feature (134)..(134): n is a, c, g, or t
ggggacagattttctgggacacggtttggacagtcccaaaatggaacatcaatggaatgtggttcttgtacttctgttaatttcattgaatattcagtgtcaaatggatgcatgccccatggcatcgactnatngtgatttagtcaaggtatcgttcgattagtacgagtagtacaattgaagaatctgcatgatggagcagagaagcgaaagaagaagtgtcgcaagtaaacatagtgttgcaattagcgacattagcacattgctactcatgtctagtggacaaattccccaaagttatcaacaagtgaataggtagcaagatcatattggtgctggaatcaatcgtggttatgatcaaacgatgggaaaggtcactcacaataaattcgaattagtgatgcaggagtagtgctgagttagcaatttcgaaactggatcatatatgttaacttctttggcaatgggagatgcattacgaaaattgcgcgaaaaactggttgattgaagaacgttatgggcagagggtaactggaaggctcccgaaggaacaaaaattgatattgggagacagttacaactcttggtgtcaaaaacttaatttgagaagctatccgaaattttctacaccacgattgaaacttctaaagggtttctagccagccttttattccggtctatgcgaatacatttatggcttgattactcactccataagctatcgttccaacagggtgggattcccggtttcaaatggcttgtttcatagggtgggacgaagaggaaggttaaggggcttccacgaggtggagagacacgcctatggattgggtggcttcacacaaggaaaaaacactctcctggtaggcagtttgcacattcaaaggggtcggccccattattatttcggttaggaaatattgtcggatcgcagggggaaaataggaggtaggtactaaaaggacttaataggtaacacttttacattgggttgaaggtggttaaaatcccgcataaacagttagtaatattg

SEQ ID NO: 705423 - DNA, 1092 bp, Homo sapiens
gtcatggactgcccctttcccagccctgggctggaccatcgttgtacaagaacttcctgtccaggttcaggaacgtgaggtgatcaaactgtgccggcccgactggactccgcgggctcgagcactgtggacttcgagatctctactatctcctccctcagcgtccgccaactggtctgtgtagtttgcctccctgcttctggagaggagggtcatcgttcattgcagacaagctcagcatcctgtccaagtgctgtcacgcgatggtggcgctgatctaccccttcgccaaggcagcaacacctacatcccggatgctgccatccgccatggtcgacatcgtgtgctcgccgacgcccttcctcatcgggctgcttctccagctcgctggcactggtcagggagctgacgctggaagaggtccttgtggttgacctcgtacaacagacggtacctcagacagatggacgactgaggactccatacctgccccggaaagcttcaggtggccctggaacacattctggaacagaggaaccgagctggctagtagagcaggacgcagggcccctagacggcaaggcacgggccagagtccaggccccttgaacgaggaggagtctgaagcctaggagcgcaactaacgaggagcatgggggacacctacgtcatagagcagacagtggggcgagcgtgaaggagaaaccctggaagaggagaggcctcccgcaaagctggctcctcaaagagccatcggcaactacaggagagtcacacggaaactcaaaaggtacagaggagacaccaagaagggagactgccccagaagaagacaaaggcaggaaaagggcaacgcacaacatccggaaaaaacccagaggggacaccagagggagacaaaagccgagagaggaacacccaaaaggaaatccccagagaaacaaccgacccaagaagaatcccataggaccagtgaaaaagccggggcgccaaagaggcacacagagacaacaccgagcatcaagctcacaagacaacgcgatgcagcctaccacagagaggcagagaaaagacgaaccaatgcatgacaag

SEQ ID NO: 705424 - DNA, 982 bp, Homo sapiens
acagcctcaaggatcatcagcgaatgcctcctgcaccatcaagcggcttagcacccctggccaaggtcatccagtgacaactgtggtatcgtggaaggactcatgaccagcagtccagtgccatcgactgccacccagaagactgtggatggcccctccgggtaaactgtggcgtgataggccgcggggctctccagaactatcatcccatgcctctactggacgcatgccgaaggcatgtgtggcaggaggtcatccctgtagcatgaagcgggcaagctcactggcatgggcgcttgccgtgtcccactactgctcaacgtgtcacgtggtggaccgtgatcgctgccgtctagagaaaaccgtgccaagatatgatgacatcaagaaggtggtgaagcacggcgtcggcagggccccctcaagggcatcctgggctacactgagcaccaggtggtctccgtctgagttcaacagcgagacccactcctccacctttgacgctggggctggccattgccctcaacgagcaccttgtcaagctcatttcctggtatgacaacgaactcgggtacagccacacaggtggtggacctcatggcccacatggcctccaaggcgtacgagccctggaccaccagccccagcaagagcaccagaggaagagagagaccctcacatgcctggagagtccctgacacgacgtcagtcaccgagcaacacggaatctccgcctcctcacagtcgccatgtagacgcctgaacgagggccagggcctagggagccggccctgccatgtcccagcacaacgctacccgtgcgactccacccatgacacaccgcaccactggcacccagacagcgcgcccgcccacagagaccccacacacggggccccacaacgacagcacgacccggccggcgccacggggcgcccacatcggcacgccaaacgcaccggccagcgaccggccgcacgca

SEQ ID NO: 705425 - DNA, 304 bp, Homo sapiens
  misc_feature (68)..(68): n is a, c, g, or t
  misc_feature (85)..(85): n is a, c, g, or t
  misc_feature (99)..(99): n is a, c, g, or t
  misc_feature (122)..(122): n is a, c, g, or t
  misc_feature (258)..(258): n is a, c, g, or t
  misc_feature (289)..(289): n is a, c, g, or t
ctcccctttctttagccctcactccccccattccccaagcagcccactgatatgctttccgtgatganagtttgcattttctagntttaaataaacagnatcacatagtatctactctttgntgtctagcttaactctgcataattattttaagattcacccatgtcattgcatgtatcaaaagtccatttttttgctgagtactattccattgtacagctgtactacaatttgttattccagtcatctgttgatggncatttggtttgtttccattttggggctattncaaataaagctgtta

SEQ ID NO: 705426 - DNA, 482 bp, Homo sapiens
tcatcaaacaagctcattcagtgggcagtagcagtttgcaagtccttagagaggattatgatgcgactgtgagtgcgttcgtagtttgagtttgctaggcagaatagtaatgaggatgtaagtccgtgggcgattatgagaatgactgcgccggtgaagtttcagggggtttggatgggaatggctgttactcacgcagggctatgtggctgcattgaagcagtatgcaatgagcgcatttcaggtctgtttgtcgtcaggctttgcatggcagcttgtcataattcatgcctccatcaagggatagtacaaggcaaggggtcggctcatgtgtatagtcaaggggggttgcagcaatgcaggtgtgcaggcggtaatcatacccatagcccgcctacagttttacagagtactggcggcacagtactcttggacccagcaggattggggggctccgccatgggctttagggagtcatacgt

SEQ ID NO: 705427 - DNA, 1229 bp, Homo sapiens
gcggaaggcggcggcggcgtgcacctgcgatcagcggactggggcaggttataggtagatgcggactgctggtgtgagcaagatgctggccacggggcccgccaatgcagccgtgcaggcccatgacactggagctgccatgacgggtccaaatgctcggtggccatgtggcccattcagcacatcgagcagagccaggaggacggcggaatcagacggcagcaaggacgctgagcaagcgtttggtgccggcgcatcgggtgccgagactgtgaccccccgttcgtacttacacagcgccgacgagaatcataatgatatctactgatgcaggcatgggggatctggactcacgagatatctatgacggagacaatcgtcacgcaagacacgggcagaagcgggccaagctgaggcgagtgcataagaatctgcattcctcagggcatcagtgaagctggatcacccccgacatccacgtggacattatcccatgatgatccatctatgaggtgtgaccctggagaggtggcagacagaagcaacaccccatgaacaccggcaagaaactcccaggctcaatcaaggtgtgggcttccatttgaggaagccccaggcttggggccaaaaagcctgaaataaactctgattgggccataagctttcagcttgtgagcgggatcaggaaccacaagaatgggtatgagatgtaggaattgcgtgtggaccaaagacgggtgcgaagggagggggtggaggaaagggctaatgcgcacgaaggatcacggagcaccacaactacgcaagccaccacatggacagacgaacacagacaggggagtataccagccggggaaatggcgcgtaaccagtgggaccgagcacagggacccggaaacgaatccaaaggtaaggcccttggagggcaccatagacgcgtgaaagaaaggggaaagcaggaagctgtatacaaggagagagggaaagcgagaaacccagagccacaaaggaagagaggccacatggagacaaagaggacagtcggtagccatcacgaatgcctgataacccgtaaaaggcgatatcagcgagagggaaacagaagccacagagagaaaaacgaaggaggaaccacagcggcaacgcaagcacagccgaataccacaaagagcaaaaggactgaagaggagacgagaagcccacgagagcggggaaccaagagaacagac

SEQ ID NO: 705428 - DNA, 369 bp, Homo sapiens
ccgattctgggcgtgacagcagtctgctgtgcaggcagactttgtgactgtaaaggcctgacgggaggcagaggctgtgcctggcagtgtggccaacattatgcaggagctgggcctggagagtgttgggccgaaccatgagctgggcctggtgaggtcgacttgagaaagttcagggtcctggacagaaggctgggacgcaggatctgggtctaaagaggccattgtaacgatggagctgtgcctgtggaggctgttgtggggcagtaggctcatctgcggagactgtcgttacgtagggtatgggcctgaataggccattgtgagtcatgagcttggtctgtagaggctgactggagaaagttctgt

SEQ ID NO: 705429 - DNA, 925 bp, Homo sapiens
tcttgagggggttgcccgcccgtggtctgtcgccaaacgcttgtttttggagttctgcgtccgccccacgttggcgggggcgcctcgacatttgtgtgtttgatgccgctgcgttttttacggggccccgctcggcattacatgtttggccgccggggccttgcttttatggacaatggttctagaggtggggtttcatcatgcccccgtagtgtggctgcggtccgcgtgatgcggctggctgccacgccctgtatttaggttcatgcagtcctgctctatgcatttccaaatagaattatggtcctacgagcaccatgctgtcttataacattctagacgcaggcttacaaatttgtcattttcttaaactccagcgatgctgcgtcatcctgggtaaagtgtcaatgcttttaacacccccactctttttttcccgggtaatcatccacacgagggaaattatcctatcttatttcttccgtcggaccgagcctgtttgatatttccagtcttttcccatacctcttctcaccagcaaactctcactgattagttttcattagaatccaaccttgatatttcgtcccgtgatttcaactgctggagaatattctcttcagtcaaggtaaaatttcttaccatatctatggctttgataaaactatctggcaattaatcgttataaaaacgtgcaccccacttccttctgatgtccgcaaaccacgtcgtgattaattcttggtaccagcatggattaagctctgaccacaaatccccctccacttatctctcctcctcgcagctattctttctgctccaccaccctcctcgccctttcacgctttcattagcaacacaaacaacaaagctacatattacgaaacaaaaacaatagacaaaaaacaaaacaaacatgacacaa

SEQ ID NO: 705430 - DNA, 689 bp, Homo sapiens
  misc_feature (405)..(405): n is a, c, g, or t
  misc_feature (477)..(477): n is a, c, g, or t
  misc_feature (539)..(539): n is a, c, g, or t
  misc_feature (689)..(689): n is a, c, g, or t
gcttttggtattttcatcatgaagtctttgcccatccctatatcctgaatggtattgcctaggattttttctagggttttatggttttgagttttacatgtaagtctttaattcatcttgagttggtttttgtataaggtgtaagaaaggggtccagtttcagttttctgcatatggctagccagttttcccagcaccgtttatttcaccatttcacctttcaccattgcttgttttggtcaggtttgttgaagatcagatgactgtagatttttggtgttatttctaaggcctctgttctgttccattggtctttatgtctgttttggtaccagtatcatgctgttttttttattggagccttgtagtgtagtttgaagtcaggtagcataacgcctgcagctntgttctttatgcttaggattgtcttggctatgcggggtcttctttgattctacataaaatttgaattagttntttctaattctgtggtgtcaatgcttaattgatgggaattgcattgaatccataaactactnttggcagtattgccattttcatgatattgattcttactatacatgaagatggaatgtttttccatttgttgggtctatttcttgagcaatggtttgtagtctccttgggtcctttcacatacttgtagctgattcctgtatttttctgcn

SEQ ID NO: 705431 - DNA, 931 bp, Homo sapiens
  misc_feature (137)..(138): n is a, c, g, or t
  misc_feature (142)..(142): n is a, c, g, or t
cacaagcacgcaaacccccagggctattatgatatgaacagttggtacgaacattgcaggctggttacggggctcgcaaataccggggagtatcagtcgaatcccacgctgttgcgactttattactcaagagcgtnncagngcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcggtattcaggatctcatcacctttgcccgtgttttagactttgtcatggtaaatcctggtcttcataaacatgagtaggtcccttggtgctgtcacttgccctttaatagtgttggatgtatcaaggcccgtgccctttttttattggagacacagaacaatgtttttgaattccagcttgggggttgaagacttaggggggacatccaaaactgctttccttttttagacggtgtacagtcccctggaattacccagctttagtgctgagctttcaacagtgacatgtggcctaggtataag

SEQ ID NO: 705432 - DNA, 125 bp, Homo sapiens
ctatcggttagggcgcccttttttacctggcccagcccagaatcagtcatttctaccagaagccccggttcactattagttgaataatagtatattagaatctaaggtctagggtaggtatatgg

SEQ ID NO: 705433 - DNA, 1075 bp, Homo sapiens
acctcctaccccacgaccgtaattcaagaaaatttgctataaaatatttacaggtctgaagagttcttacctttatcagtgacatcatgagttggtggcagtgtttacagagcctgaaaataattcagacaggggctttgggtgtatgacttctaggcattatagcatatgtgtgttttatatagtatataatgtaggctttatatgaggtcatacatgtaaatatttaggaaattttagctgtcattacttgtaattaatcataagatcacattattgttccaaagcaaatatggccttcagtaaagttgttaattgttgctttgttgttgtttttgtttttttcttttctctagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcggtattcaggatctcatcacctttgcccgtgttttagactttgtcatggtaaatcctggtcttcataaacatgagtaggtcccttggtgctgtcacttgccctttaatagtgttggatgtatcaaggcccgtgccctttttttattggagacacagaacaatgtttttgaattccagcttgggggttgaagacttaggggggacatccaaaactgctttccttttttagacggtgtacagtcccctggaattacccagctttagtgctgagctttcaacagtgacatgtggcctaggtataag

SEQ ID NO: 705434 - DNA, 591 bp, Homo sapiens
atttgctcctcatattctctccatcttcttcgatgatggccatttagtggcaaacaatgccggttacggggcgcaggcctcctaaggagagtagaggtgcattgaattaaaagtgtcagtcatgtcaactcgttgcaagtgcgacatactcgtatggttgtgctgctgcatttcatagttgcttagtagagaatgcggtagtagttaggataatataaatagttaaattaagaatggttatgttagggttgtacggtagaactgctattattcatcctatgtgggtaattgaggagtatgctaagattttgcgtagctgggtttggtttaatccacctcaactgcccgctatgatggataagattgagagagtgaggagaaggcttacgtctagtgagggagagatttggtatatgattgagatgggggctagtttttgtcatgtgaggagaagcaggccggatgtcagaggggtgccttgggtaacctctgggactcagaagtgaaagggggctattcctagttttattgctatagccattatgattattaatgatgagtattgattggtagtataggttatggttcatt

SEQ ID NO: 705435 - DNA, 255 bp, Homo sapiens
gtcgactgatttttttttaaagtgattaaatgattttgttggagcacatatatgcttaatggcgttggcaaattagtacaattaatcaggagtgtaaatgagttattgatttagcgcttcaaaaggaaaacattccattccggcgttctagcgaggtagctatgaatcatgatgaaatgaccaccttgtttactttaccttctcatactagttcataatcaattgaggcattatataatcatttactcaccctta

SEQ ID NO: 705436 - DNA, 215 bp, Homo sapiens
gcaggtgggcgtagccacactaacggaaatcgtgccccgatcagtcgctcggagcctagcagcctcaggcggaggcacacacgtcagccagagcgccctacggtgggcacacagccaccgcgcacgcacagatccccagtacgccaccgtgatgaaggctcaaactagacggacagggtcagctacacgagaatcaggagccacgtcgctttacc

SEQ ID NO: 705437 - DNA, 549 bp, Homo sapiens
ggaaaacatatgagcaaaggtctctgtgtcataaataagttggaggaaaggggctgtgccttgatgtgcatgtacacaaacatctcggtgcattaaagagcagtatggccaccagcatgtctcacctccagccccaagggggttttctcctatctcagtaaatagaacgtacagtcgggtcttacaccgagacattccattcccaaggatgagcaggagacagatgccttcctcttatctcaactgcaaagaggccttcctctttcagtaatcctcctcatcacagaccctttaagggtgtggggctgggggacagtcaggtctttcccttcccatgaggccatatctcaggctatcagatggggagaaacctgggacaatatctggctttcctgggcagaggtccctgcagccttccgcagtatatgtgtccctgggtactcgcgagtagagaagggcaatgacttttaccaagcatactgcgttcaaacactttttttaacaaagcaaatcctgcacaggcctaaatccattaaaccttgagtcaat

SEQ ID NO: 705438 - DNA, 459 bp, Homo sapiens
cagaggatcccagtgaggcgcgtctggtcacgggactataagaacgtgcagcctgctcacttagttctgctctgaacttgttttttctttctttctactaatttggggttctgttgttctgtctatctagttccttgaggtacatcattaggttgtttatttgaaatctttccacttttgtgatgcaggcatttatggctataaacttccctcttagcatggcttttgctgtatcccataggtttgggtatgttgtgtttgttatgttgtgtttcagtttccatttgtttcaagaaattttggatacccttcttaatttcttcattgacccaatcatggttaaggaacatgctgtttaattttcatatgtttgtacagtttccaaagttcctctggttatggctttctagtcttagtctaccatggtctgagaagatacttgacatgatgtcagtattt

SEQ ID NO: 705439 - DNA, 1057 bp, Homo sapiens
ggcgagaggcgggagccggagaggtgaaggcaggacccgggctccactgccagcctctccgagctcttgtgacgcggacctcagtgccaggatggctcggtggcgagcggcgtgcgccgcgcagtgccggcagagggagtgcggacatgcctgagagggctggctctgagggagtgcccctgtggcgactgggacggcctggggctgtgctgtggccgacgtagcactggctggaggagttggctctggccgtcgtggtcctgtctttggcccttgggtatgtcggggcgctgggtgcatagggcagttgaggtaccagtagcagcaggcgggagcatggtcacggcatggcaactccagcggcaatccttagatgtatgccaccctgacggacctacctacgaaggcacccgcacgataggcccccggaaccctcattcttggaggacaccatacacggaaccccctcgacgttcttacctttcgtggcattgaaaaggaacgcacggcaaggaccccgtacaagcgccatttcccttcgcaggcggggtaacattggattgattggaggacgccaagacacgggagcaaccacacaacaaccggggggaacacttgccttaaaggcctacaggggccagcaaacgatatgttacaaggcacaagtgggggtgcaacgaggaaggatggggagaataccccccataaatgagagcattacgaggaaagatattcccaaggagacaaaggacagccatccatacccgtcaacggaagggcgacacaaaagaacaagatctacaagagaaaatgggggggcacgataataaaggggacatccaaagcccaacgtgatgacagcttcgagcgataccacaacgaagggcccaatttgagggaggagatctacaggaccaacgcggaaagtgggacgaaaccatggagacgaccttgcgacgaacgctgagacgatgctagacaacgaacctccaagagaaaataagacaggacaacagtataattggacgcagtaacccgatttcgagagtggacccac

SEQ ID NO: 705440 - DNA, 223 bp, Homo sapiens
cgacgtataggctttgggagtgagcagctagacaccaatgacgagagtcctgtagcaatatcactaagttacatcttacctatatttctcagccgttaacctaggatgtgaacctcactggtattaccgttcattaaactggcaaccacaggaacacgcctggcacagattcaaactgtaggcacaaaccggcagagactgaatagagtcctcatgggcccaa

SEQ ID NO: 705441 - DNA, 92 bp, Homo sapiens
  misc_feature (12)..(12): n is a, c, g, or t
  misc_feature (18)..(18): n is a, c, g, or t
  misc_feature (59)..(59): n is a, c, g, or t
  misc_feature (65)..(65): n is a, c, g, or t
aatgctgacttngccgcncccgtctgtgttttgctgaatgtcctggacttcaggaacanacccangagaagacaccgtggcagaaactttga

SEQ ID NO: 705442 - DNA, 178 bp, Homo sapiens
gtagtgaagggagacagaaaatgggagatggcggcaattcactttcttggttttttcatcttttctgttttgttatggggggatagccgcccgttttttcgtttctcgaagaaaacaacatttgagggggtgacttaaaaaaaaaaggggtgcaccccggttctttatattttttaaa

SEQ ID NO: 705443 - DNA, 1675 bp, Homo sapiens
gccaccgtagccagggttccggccgtggccagcctccgccgtccagggtccctccgctgtcgtggcccggagaatcgcacgagtgctgctcgagcaaggaactgcggcccaccgtgtgcactcgcgtaaccaatgtcgggcacgaagaagccgatggcatgagcaagacggacagcagctagaggcgccgaaggagcagcgcgtgtcacggggagaagaaggagaggcaagagtgcgcccgggacatggcacagggccagggacgaggaaggaccgaacggacgaggcataggtcgggcttggcatgcgcatgggaaggggacgggaacgcagtggtggacttggaagtggatggaagacgaagaggcagacctagagactggcttcgagcgcctaggggcaccagagggacccacttatcgctccgaaccgattggccaccagacgtagaggtagccctattatgatcaggtaaaggaagtggactagtattttaaacaggcggccacacggattagcttcgcaagaagtggaaggggatccgaactagcaatctacgttagtggtggtgacaatggcccgaaatattctctccatggcgggggacgaccaacacattattggaagtatacaagggaagcggggggcattgtcgggtcgcccgttgggtggcggctaccttccaacagaagggtaggttccgacgttgcgccatggacagaagggagaccttccatccttcgagggaccccctttcaacgtggagggcgtgggctagagatcgttccaattcacacgtggggtacacatgggttcccatggctggacctttggtgagagaaaatgacctgggagggtgaacatgggaaaactggcgccgtttacagccaccaaaaggtggttgcaaacatacccttttttctattggcgaaagccccataaagccacaaattaacgccatagtccttcaccaattataacacgttgagaggaccggttccatggggagaggattcctttgcaccaggaacggaggccccaaaggcggcatggcatttgggcccctttttcatcccctggcgcgttggaacgatttccaccatcggcactttgtggtggccatcggcggttgggggaacataaacagaaagggttctaaacttaacagaacaatgttggcggccggcggaaaaaaccatgggagtcgctccccgtgggagccaatagcatcgaaaggcgcattgaataccaccatatggaatcaggccttggcgctctcctgacagcgacggttaccttattatttcacccgttgaggagaacggggggtggcagccctttatccacacacgccaatagttttgggagccaaaataggccttttcacaacgtccacggggccgcaacgcggagtccttttgcaaccggttggtacccaattctttctttggcccagtgatcacaccatataggatttggccctagctcgacattgggtccccctatttacagggggaacacataggcgggcgcccttcagcagccgcaacgtgggaccacttttgggacagatccctcaggcgcccaccagaagtacgaaacacagaccaaacacaacacctgtagcagcggcaaccatctcgcggagcagacgagacagagacgacaagcgatg

SEQ ID NO: 705444 - DNA, 515 bp, Homo sapiens
  misc_feature (376)..(376): n is a, c, g, or t
  misc_feature (408)..(408): n is a, c, g, or t
  misc_feature (446)..(446): n is a, c, g, or t
  misc_feature (456)..(456): n is a, c, g, or t
  misc_feature (461)..(461): n is a, c, g, or t
  misc_feature (481)..(481): n is a, c, g, or t
agaatattggatctagggacaattttgtgtctcttctaaacccactaattctaaatttagtatgaagttctttcatatacttaggctattatacaaattgaaaaggaacatttcctttttttttttttttttgagacaagagtctcgctctgttgctcaggctggagtacagtggtgtgatctctgctcactgcaacctcggcctctgaggttcaagcaattctcctgcctcagcctcccaagtagctgggattacaggtgtgcaccaccatgcctggctaatttttgtatttttagtagtgatgaggtttcaccatgttggtcaggctggtctcaaatttcctgggcctcaagtggatccgcccgcctcagcttncccaaagtggctggggattagagggttgagtnaccacggcccagccgaaaagggaacatttttctttggnaaaatattantcagnagtttttaggactaaggggnttatggctcaggcaaggaaattttttttcatccc

SEQ ID NO: 705445 - DNA, 344 bp, Homo sapiens
  misc_feature (69)..(69): n is a, c, g, or t
  misc_feature (74)..(74): n is a, c, g, or t
  misc_feature (77)..(77): n is a, c, g, or t
  misc_feature (237)..(237): n is a, c, g, or t
  misc_feature (267)..(267): n is a, c, g, or t
aactggaccacacttaattcctgactctcattttaattataaaggcaggccattattataacttacttngcttncantctaatgtgtgcttgggccctataggaaagacagccttgggatgctttcccagaagagatcaaaatcaccgatttaaaatataaaggggccaggttatggggctccacctgcaatccccagcactttggggaggtcgaggtaaagagataacttgtagantgggagtctgagaacaaaccctggcaaaanagggatgagctccctaagaccccctccctgccccctactacaccaacacttaaaccttctgattaacacccggctcc

SEQ ID NO: 705446 - DNA, 173 bp, Homo sapiens
ccagaagatatgattacctgcctgaccagaggacatcaacaaggaaaaacgcactccagcaccttgagcctgagccttgtgaggcgtctgagctgcagcaaagagattgaggagctcagaagagcccacagagaatgtgaacctccatgggcagttacagtgtgaatggacca

SEQ ID NO: 705447 - DNA, 434 bp, Homo sapiens
cacctgttattaccagtgtggagtgagtaactcgatcactttactccagcctccacttcccgggttcaagggattctcccacctcagccttccgagtagctgggatcacaagcatgcaccaccacacctggctaattttttttgtagagacacggtttcactatggtctggtcttgaactccttacctcaagtgatccacccgctgcagcctcccaaagtgctgggattacaggcgtgagccactgcgcccaccctgaaccttactttttttgctcagtttctggtaattcagagaatgcctcctgagttgtcctacacccacctcatattccatgggagggctgtacagggcttttttaacgaggcctctaaggacaggcatttgtatcctttccagcctttcactattacaatgttgtagtgaataacttta

SEQ ID NO: 705448 - DNA, 729 bp, Homo sapiens
  misc_feature (640)..(640): n is a, c, g, or t
acgtaggtgtgaatggggggcgccgggtatataggctgactgcgacaaactcaatacttgacgattactttcgatcgcaacgaggcgatgaatcatcatgtccgatagactgtatgcctaggagcttgtatcacatcatatccttctgcacttgctgttgacaggttatacagcacaggctgctctgactccgacaaatgcttatgttcacgaagaggaacctatatcgccgggaacctcaagacatattcactatgccgagccgctctgtacttttgggggaagaaatacacactcaatttatgcctggattacagatgcctctctgatgcttaacatgagaaacggtgaatggttcatatcaacttgttgacatttaatgtataagtggtgtctggcagacagtctcttttgatcctgcgtagatgatcctgcaagcgtacatatctgcggaggaaatgcctttttagtgtgagcaacctctctgatgctcatagtgacttggaaagtatgtgctgtacacactgacattagtggtgctgggaggactcagataactctgacttttcaaagtgtagttggaaataagaaccgttgccaaagtcgacactctggacatttcaggaaagcctggtccaanctaggtgctaagcacggcctacttccgtcagcagatgccctcagctggaaggtcatgttattcagattgctgggccaagcatctagcaa

SEQ ID NO: 705449 - DNA, 1178 bp, Homo sapiens
ggacgcgtgggtcgacccacgcgtccggcaagtcaacagagttggaaaagatttctaaactggagcaggaaaaagaacattggctaattgtgcttccaacatccaagtgtacttatccctgctccacgctttagaacattggactgtgcgaacgcacgaattacgcccaatctcacagctacacgacaacgacacatccagcgcaattcgcagactaagcgtagaagaatacagggtagtgcccagctggcttggcgcctggcccagcgaccacactgcctgctgatgctccacactaactgctggcccaggcatgaacagcccacagctaacgcgctgtgcttgcgagcccacttcagcagcacccaagctctaactcgcagaacttctaccccacggcacactctgcaccgctgagcgtttccaccgactgctggcacctctcgcctgcacgaacctgcaacacaccaacaacatccaacacacccctgagccacccgccatcaccccgcgaaccccccagcgctcacaccaaatccgcccagcactgcgctcacaccagccctcacacccaccccagcaagacaactcccccacacctcccccgaaagcttgacccgcaccaccacccgacccacacacccaccgaacctgggcccccccagagccccgcaccccacagccaccctaccccgcggccaccccaccccgacccccgccccgccacccctgaccaccccaccaccccacaccccacccaacacccactcacccccacccacccccctccacacgacagacccctacaccaaacccacccacgcacgcgcaacaccaacacgacgcggacttaacacactacaccactcccagcaccagaccacaggccaccacagcactgaacgacacaccacagcacacacgcaacagccccgcaaaccacacgacaccaatacacccgcacgcaccacttggactctaccattctcaacgcatactcacccaccacactggaccaccctccctaccccacccgtcccctcactcacccccactccccctcctccgcacgctacccctgcgcatagccgcaccctacctcactgccacaatcacccacccccctcattcctgtcacccatctaccaccttcgcgccccatcacatcacttgctaca

SEQ ID NO: 705450 - DNA, 519 bp, Homo sapiens
gctgtggaaatttttaataaaataaggacatttgaaatggggtttaataaaaacaagctggctcttggaatttagtagatttaccaataaacttcctatcctgtggctttaggcagtttagtccacagaccaataaggaggtttgttttgggaaaggaactgttattgtcattgtttcgaagctgaacttaaaactaggttcctcccaaagttcattcggcctatgcccaggaatgaacaaggacagcttggaagttaagagcaaggtggagtcagttaggtcaaatcgtttttcactgtctcagttgtaattttgcaatggaagtttcataactttaaatcatgactatcacagtttttataaataatctaggtaaacaattaataaaataactaggtaaatgtaatgggataaatacttatagaccaactggacataatttagaatataaagtcatattaaattaaataatagataatttattatttgggtattttccaataaatatatcttgtagg

SEQ ID NO: 705451 - DNA, 1244 bp, Homo sapiens
acatcatcaacaccaaactgctgaagcactattacttgctgaccgtacaacaatggctagattacggtaacttaattatcggattctatgaaggcgaagattactgcatatgtgatcactacttgccttgcaccatacatgacttccaaattgacctgacagctgttacagagggacttgaagctcagtgagaaaaggatgactggtcgatagccaaagccatgaggctgaagatctccaaaagaagggtgtctgtggccgcacggcagtgacagaagatcacacaactgggcacccatgtacccatcccgactgcactccagaccagcactcagaccgcctggacaaagcaggaggcagattaccatagacgcatgctttccagacagggcgtctatggctgcaatcacagacactggctggtccctacttcagttctcccattcttaaatgtattgtattgaccacagcaaaacggtccggcggaatggctgcgcatcgcaccctgaaacactacccagaaacactacaagaggcacggcacgcaggaaccgcaagactccaatcagaacgatacagacaagatttagccaaaccccaagctcgtggcagacaaccacatgcagacacaaaccacaccacatcctcacacagcacaggcaaaacagaaacagcaacgacacacggcaaccacaagaggacaacagacgacacaaagtaacaaccgccacagcaaacacacaaaacaacacactgcccagcacaaaaacacaacacacaaacaaaaacagaaaccgggaacgaagcaacccacaccaagacgagggacacaacagacacacaccaagccgaacgcgcgcaagcaacaccaacaagagaaggcgcgacaacaaccaaccaaagcaacgccgaacccaaccacgacccccaagaagaacaaagcacgacacacaaggcacgcccaaacaccccgcccccccacaggccacacaagacccaatggcacgcaacgcgaggcacaggaaagaacgaaccaccactggcccccctacataaagaagaacgaacgaacaccggagcgggcccgattacagcttacatgccagacgcgcacacgacagacgacagccctagactacccgaccacccaccacacttcgacacagggacgaaaccacccacagaaccaacgcacgccagcgcacaaaagacaacaccagcacagagagcaagcagccaacgac

SEQ ID NO: 705452 - DNA, 371 bp, Homo sapiens
  misc_feature (263)..(264): n is a, c, g, or t
gctcgaccacgcccatcagcttcttggcctgtacggccctggccagcgcggtcgggcagacggccgggcactgggtgaagccgaaaaacaccatcggcatcatgcgcggtaactggacagcgttttgacgttgcccgcggtgtccttcagcttgaaggtccgcccgaggatctcgtcgctcaggtccttgccgtatttgtacgacaagcggttggagctgtcgcagccggtcagcgcgccgaggccgagcaggcaaggccggnncaacgacctggcggcgagtcagcaattcattcatgttctgtagtccttcgtatggagcgatgtcgcggcctggcgttgccggataaatgcacattgacgcacatgtc

SEQ ID NO: 705453 - DNA, 610 bp, Homo sapiens
ccgatgaaaagaaacgaaaagaaaaattgtgtagtgacaagttggctgtgaagattaggcccaccacacaccccaccctaacccgtttaatgggatgcaattctgtttgcctccaagtcctctaggcctgggttctattggtggagtctgtgtgttgtcctgtggcccctcaaatgcactaaagagaggtcccaggcagaaactagctgttaaaagtttggattgtgggattgaatgtagtaaccggtgctttatattactactctctggctaattccacagggttctttttgaaagatacagcaagtgttttgcttggttgtttgaaactgtactttgagaacccatttacagtacagtgcctaccagagccctgctggttctccatgcctagttgtttttgacataacacacacctggactgaccccaccacttatcagtggcctctttgtaagtttaattagcaacagacaaaatttatttctagtacaacaaacacctttctctgctgactgctttggccctgtactttcaataataggttttacagttgattttggaacttcacactagctacagagagctagatagagaaattggcgggtgttc

SEQ ID NO: 705454 - DNA, 316 bp, Homo sapiens
ggccttgaagacagagcaaagggcccacccaggtcccccgactgcctgtttccatgaggtactggtcccttccttttgttaacgtgatgtgccactatattttacaggtatctcttggaaggcatctttaataaacgctcttttttaagtggggtgtgcaaagcgtcctgccctcccccctcgggggcctgtggtggctccccctttgcttttcggggtccagggcattttgtttcggaaaatgattttctgtggttttttttgaatccaaatctgtcctctgtagtattttttaaataaatcagtgtttccatta

SEQ ID NO: 705455 - DNA, 217 bp, Homo sapiens
tgtatcagaaaagtgaaacaatcctattataccacttcgtccagctgtacatggcactatgtagtcataatatcaacaatcatactgaactaacaaattaaggatatatcactttgggcagccatggatccgtttgcactgagaaggcagagggtgaaagacagctaggaacttcctacctattctcagtgtcaagcgaagagacatcacatgacac

SEQ ID NO: 705456 - DNA, 157 bp, Homo sapiens
gtatagttaggcatcacccaatgaggctgctgccactccagcagggaaataatgcagttcctgtgttataaagaaccagagaaggctctcttttctcccttgtcattagccggttcttttcctatacacgcaaaagatttataactatatgccgatt

SEQ ID NO: 705457 - DNA, 923 bp, Homo sapiens
ccggatctcatgccacgcgccccacgacgacgcccgacgtggattcccgattgccttttggttccaagtccaatatggcaactctaagggatcagctgagttataagtctgtctagaaggaagaacaggacgcccccagaaataaggattacaggtggtatggggtgtggctgcgtgttggcattggcactgtgccattcagtatcttaaatgaacggacttggcacgatgaactgtgcgtcttgtcgagtgtcactcgagatgacacaattgaagggcgagacgatgagtggagtctccagactagtggcgagcctgtttcctgtagaacgagccgaacagacttgtctcgtaggcaaacgactgataagtgtacatcgtgctataactcgcaacgactggtacattatctagcaggctagtgggacagcgtcagtcaaggagcggagataatgcccgtctgtaattgtggtcgcagacgtaggacgtgaactatgcttgaaatgtcatgcatgtacctagatgtgtgtaagaatagcatgcgccgatactgcgaaagttgcgtctagtgggttatcgagaactctcagtggcatagtctgtgcacgctagcagtggcgtctgcgaagggatgaagatggttatccggcgaaaagacccgatgttgatgtgcgacagactgcgtcgccaatacctggtcattcagttccgggattcgcgtttagcctgactgggggcgaatagggcatgggacgtgtcagcccatgtaatgctcgtccatgggctgggtcacttggaaggaactagtggagaattccagatgtggccctctatggcagttgcgaatgaagtgtctgcatggtgtcttctgctgaagaactctgcacccagattaagcggaactgataaagataagggaacag

SEQ ID NO: 705458 - DNA, 486 bp, Homo sapiens
  misc_feature (466)..(466): n is a, c, g, or t
gatgtcttccatccaaagtaagaataatactctcggaaggtccttttggtgtcatgtcacttgctgtatgtggcagccttacagtgccacacttgggtactgaaaaatcaataaaacgaaagttcatcatcccatggcccgtagactgtgtgggcttgcttccttgtcatctttgaatcttcttactcattagaatgatgagttgaacttgagtccaaattcagtgaaatacattgtctgagtctgacgcacactctttgcatgtgttgtgttgggtgtgcatacagtgaagcacaattgtgtggggttgtggagagggcgtccacactctctgcagctcagaaagcagatatttcacaagtagtgaccaacccacgacgttgaagccattcaccaacaataaattgccactctgagatggactgtttatgaaggtcaccattttaagtacctacttgtatatagncaaggagaagtaataaaatt

SEQ ID NO: 705459 - DNA, 989 bp, Homo sapiens
gccggaagacgctgctgaaggccctaaagaaacttcaggcagaaccggaactccccttgcaggtccagccgcgggcctctgggccctcccgttcagccgaggggcccgaggcgctgttgagttgtctgggtgtgcctctaccaaagcgcctctcagaggggctgtccctgcggccagaggacttgtttgagggcgcctcgcggacaagggacaaaacgcaggccgcttggtgcgcggggggcctctgctggggaacgggcgcggaatattgaacttgaagggccccgcttgcgtaaacgcacccagggcgcggaaaagaatgctttgtctccggccccacgggagacgcctccacatggaaaaagggtgttgtgcccacgcttggaacagccccaataccaagggtccctgtttgccacagggacggggcactcacaactacacgaggggcgtagcaaacagactgaggagggagtattcgccccgccgggtcacacattaatgttggcgtcctcccatcatcacacagcggcggtgacgtgagaacaacacacaacaactagggttggtgtgacacccatccccatcatattttgttagcgtgagagcagccacactttgttgtgtgtcgcccacaggtgagtgcaatacacgagcgccacacatattattttctaccctgctcgtgaggaaacagcgtggtaacaatccgctgcaacgaaccagtcattttgggcggaccactatttatggcgaggccacgtgttggcgtgcgccccctcacaaagaatgttggcaccgcagctctgaacgcggcaagaagccaacacacacacactcggtgctgtggtgggctatagactctaggacagaggaagcacacacccacagccttgtgtctcttatagagcgggcacctctacacacaccattgttggcgccgcaccacatctaattctccagagaggacagatatctctttacaacag

SEQ ID NO: 705460 - DNA, 455 bp, Homo sapiens
  misc_feature (146)..(149): n is a, c, g, or t
  misc_feature (232)..(232): n is a, c, g, or t
  misc_feature (308)..(308): n is a, c, g, or t
  misc_feature (439)..(439): n is a, c, g, or t
tggatgggctggcattgaaacccagagctggtactcttatgatagtgtctagacaatatctgtgaccacacctctgattgtacctcaagaagaaagatttttaaagtgaaattactagagcataagatataaacatttaaaaggtnnnngatacatcttacaaaagtgctttgcaataacactgattgatcatgctcatttgcatttccatgagcactgtgtaattgatcanggactctaaaagttagataagccactgataaatggagatgcccctctaagtccctgggcagtaaaacctgaccagnatagcctccaataacctgcatagtgttgaggagagcttggatttaagagattaagagggtcaaactcttttctgtccattttaaaatgcaagttttatttaagaggaactatctaatatgctgaagacagnatcaggtatctgtaaa

SEQ ID NO: 705461 - DNA, 337 bp, Homo sapiens
cctcacaacgcgcccggccgggcctctctctactccatcttgttgcagttgtctgagaagccagaatgagttttcatgaactggcagacctatgaaagagattgaagaggaagagaagaaatgggagctggcagccctcgtcagctgagcgcgagccgcgtgggcgcggagtcatttgcattccggtctgcgggggctcgggagatgctggtgacaggcccggtctcccggtggctcgcccccatctgcgggcgtcgggaaggatcccttccatctctcagccgcagaggaggccctggcagcgccccggctgtagccatgcaaccccgaggagtcc

SEQ ID NO: 705462 - DNA, 136 bp, Homo sapiens
cgtgatactagatcggaggggttcgggacctcctctcatctggggtcatctcctcctgggtctggtccggaggtgtctggagaccctcctctcatctggggtcatctcctccttggtctggtcccagaggggttgg

SEQ ID NO: 705463 - DNA, 1122 bp, Homo sapiens
gccgcaacctgaacagccatgcccgggcaaagaactcaggacggtgaattggctctcatatgctcctggtgttgctggatgctctcggtggactgccgcgagtggagggcgcctcatgtcttcgtggctcgaggcgagtcctgcgcagagtttcccgtggacaccttctaggagttgctactccagaagagtccagtatttccgagagttgcggcaaacgctacgaggacacgtgctatgccaggctggcgggccagaccatgaggcttgggaaggatttcgaacacccggagccttcgttctccggcccctggcgagttccgggagtacttctactgcacagaagtgcgagcttggagcatccaggtcggaccaccttgtcgaccttggcgttgatcatcatccgatgcgcccagggccatttccccgtaggagggcattccccctcgagggcccttccaccactggcctctttacatacacaggtgggccattccttgatttccccggaggacgattggttcgcacacaaggaatccgcgcaccagttcaagatagggggctcacggattgggaggaaccgagcattggtaacgcaacgggaaatcgccaggacaggttggacatgtagccaggcgatctacaaggaggccatgttcggaagagagtcaccggattagtggtgcccacacgacgggaaaagtacaaccaccatatagaggcggtcgaccggatcagtcccaccgggctcatgtactcacttattcgacgctatatacgcccattttggaagcgttgcacaactcatattggggatgttacaatggacacccacgtcgacacaccaccaggaagacacccggtgattatcatccaggtgttacccacaaaaagcgaactctgcagaggaggggcttaaaaccgcaccccccgaataaagatgacccagtttgcgacccctgtttggtgttccgacaccacacacgtgcaagacaacgaatatttcacccgatctgagcttcacccgaggaatattgccacgcgacgagggagactacaaatgacagggacgatgtcgaacagaccacctcacaccaataaagggtgaaaccattatgaggg

SEQ ID NO: 705464 - DNA, 219 bp, Homo sapiens
caggatgactttgtcacggagaaaacggcagtagatctctgccagcaaactatcttcctgacacttctcgcatcctctcagagatctctgctctgtgaatgtgcagattggattttggacaaaacaacaggctctgcttgcttggtggtggaaaatgagcatctttatcttggtttccacgagcagacgctgaagccatgatgactttgtgctggatca

SEQ ID NO: 705465 - DNA, 174 bp, Homo sapiens
cacttaggtttacgtctacaaagtgctactaataaagtaaggcaaataaattactgcaaatgtttatgcactgatttctaggattgagtataatttaaggaaatagttttagatcataggatttgaaggtaagtcaaataggccattaacaaagcagaattataacgcgttgag

SEQ ID NO: 705466 - DNA, 681 bp, Homo sapiens
gaattattgggtagaaaccatcatgatagtgcttatacacaactgtaaactgtataaactattttgtgattgacgcaacaaacttcaagtttttgtaagtactctcctgaaattttctttctcttctatactttatgcacttactaaaactactgatgtaataaaagagcagggttaaaaatattgtatctgtattcattgtgaatcctgtagcttttctggttaacaaaaaatcgctttctaaaatactcttaatcccattgttttggttaacatcttacccatttgttgtatttcaaatgccattaatcattttagtacaacacctatgtttataaaaattttgaaaacattacatattgtatttaaaactaattagtgaagagtaagaaaaaaactagccaactgaattgtaggtgatgcattagttaaatttcaaaactcataataaaggaactttcagagattggttgaaacccagtggtatccctgtaaattagctcctgtgactggaaaagaccccaaaaaggcagtagaggagattagtgttcacttgctgtggttgtggagtgctgctacttaattataggtaggtgcccactgaaattcttatttgtccaataatctgaagtagttcctatatttatctgtactaaattgctataattgggtctgcaaagg

SEQ ID NO: 705467 - DNA, 923 bp, Homo sapiens
  misc_feature (196)..(196): n is a, c, g, or t
attttcggtcatcgtagtagtagtagtagtagtagtagtagcagcagtagtattagtagcagtagtagtagtacgtagtagtacgtagcacgctagcagtatgcagcacgcatgtatgcatgtagtacgtcagcacgtatgcatgcacgcacgtatctcgcgatcgcctcgccgccatcgacgtatctctctactnctccctcctcctcctcttttctctcctctatattctctcttctctccctcctactcactactcctactcttcttctcctctcccctcttctctctccctctcctccctccttcttctcctttttcccctctctcttctcccttctccccttccctcgccctccccttcctctctccctccttcccctctctcttctccctctccacctccctcctcctcctctccccttcttctccttccctatctctctctcctcttttttctccccttctctttttcccttctctccttttctcctctccccttctcccccctttccccctcctccccctccgccttttcttctcttcctctccctcctccctctcctttctccctccctcccttctcccctccctcctcttcctcctctctccctaccccttcttctctcccctccctccctcctttctcctccttcctctctccacttcacttccctcccttccctccctctcccctccctccatctctaccctccttctccttctcttctcctcttccttcgcccctttctcttccctcctctcctatccctctacttcctcttctgctctcctctcctctacttctctcctctatcctctctctcttctctactctcatctctttcctttccttctcctcttcttcttcctccctcttctctcctctacgttctccctctactctccctctgctttctccg

SEQ ID NO: 705468 - DNA, 708 bp, Homo sapiens
  misc_feature (11)..(11): n is a, c, g, or t
  misc_feature (25)..(25): n is a, c, g, or t
  misc_feature (39)..(40): n is a, c, g, or t
  misc_feature (88)..(89): n is a, c, g, or t
  misc_feature (96)..(96): n is a, c, g, or t
  misc_feature (99)..(99): n is a, c, g, or t
  misc_feature (123)..(123): n is a, c, g, or t
  misc_feature (125)..(125): n is a, c, g, or t
  misc_feature (129)..(129): n is a, c, g, or t
  misc_feature (140)..(140): n is a, c, g, or t
  misc_feature (146)..(146): n is a, c, g, or t
  misc_feature (173)..(174): n is a, c, g, or t
  misc_feature (184)..(184): n is a, c, g, or t
  misc_feature (273)..(273): n is a, c, g, or t
  misc_feature (308)..(308): n is a, c, g, or t
  misc_feature (311)..(311): n is a, c, g, or t
  misc_feature (313)..(313): n is a, c, g, or t
  misc_feature (346)..(346): n is a, c, g, or t
  misc_feature (356)..(356): n is a, c, g, or t
  misc_feature (361)..(361): n is a, c, g, or t
  misc_feature (366)..(366): n is a, c, g, or t
  misc_feature (370)..(370): n is a, c, g, or t
  misc_feature (401)..(401): n is a, c, g, or t
  misc_feature (423)..(423): n is a, c, g, or t
  misc_feature (507)..(507): n is a, c, g, or t
  misc_feature (513)..(513): n is a, c, g, or t
  misc_feature (600)..(600): n is a, c, g, or t
  misc_feature (634)..(634): n is a, c, g, or t
  misc_feature (679)..(679): n is a, c, g, or t
gaagcgggctngcaccgacgaggtnctgccggaggaagnngctccgaggcggaagatgaggacgacgaggactacgtgccctatgtgnngttacgnagngccggcagctactgctccagaagntnctgnagcgaagacgnaagganagctgcggaggaagaacagcaggacannggtagtgaancccggggagatgaggacgacatcccgctaggaccctacagtaccaacgtacagacctcctggattcagcaccagcaccttaaagagaangctgaagcgcgcaaagagtctgccaaggaagaagnagntnaaggaaaaagagaagatcctggagagtgttgcngagggccgancattnatgtnagtnaaggagatggctaagggcattacgtatgatnaccccatcaaaaccagctggantccaccccgttatgttctgagcatgtctgaagagcgacatgagcacgatgcggaagaaataccacatcctggtggagggagacngtatcncaccacccatcaagagcttcaaggaaatgaagtttcctgcagccatcctgagaggcctgaagaagaaaggcattcaccacccaacanccattcagatccagggcatccccaccattctatntggccgtgacatgataggcatcgctttcacgggttcaggcaaganactggtgttcacgttgcccgtcatcatgt

SEQ ID NO: 705469 - DNA, 181 bp, Homo sapiens
  misc_feature (167)..(167): n is a, c, g, or t
cccgggattagtgtctaaaatatagaagagactaaaactcaaaacaaacaagccaattcgaaaggaggcaaatttctccatagaagatatacaaatggccagccaggcgtggtggctcaggcctgtaatcccagcactttgggaggccaaggcaggcagattgcccnaggtcaggaagaga

SEQ ID NO: 705470 - DNA, 387 bp, Homo sapiens
  misc_feature (5)..(5): n is a, c, g, or t
  misc_feature (23)..(23): n is a, c, g, or t
  misc_feature (35)..(35): n is a, c, g, or t
  misc_feature (39)..(39): n is a, c, g, or t
  misc_feature (232)..(232): n is a, c, g, or t
  misc_feature (322)..(322): n is a, c, g, or t
  misc_feature (352)..(352): n is a, c, g, or t
  misc_feature (371)..(371): n is a, c, g, or t
ctagnctaaatataaagtgccgnactgttaaacgncagnccaatttttttaaggcaggaatatgaggaacacctaagtatttctctttcataggcagttcctataaagggattaaacacttatttctgtgttatggttcttattcatatatttttataggcacctttttttgggaacctatatttgtgcttgaaggtgtttttgatatttgggaaacagtataagccatttngagtcatgattggggggcaagtgggattcaagctaaaatactaagaccagcattcttagtggcgcttataaattagctctcaccgggttnccaactgcttttaacaatggtagtgctccngggccatccttccaagctnctctaagggcaatttt

SEQ ID NO: 705471 - DNA, 225 bp, Homo sapiens
  misc_feature (100)..(100): n is a, c, g, or t
  misc_feature (131)..(131): n is a, c, g, or t
accccgtctctcctagaaatgcagaagtgggccggccgtggtgcgcctatagtcagctactcgggaggctgaggcaggagaatcgcttgaactcgggagnctgaggcacgagaatcgcttgaactgggagnctgaggcacgagaatcgcttgaactgggatgcagaggctgcagtgagccatgttggtgctggtgcactccagcctgagcaagaccttgtctcag

SEQ ID NO: 705472 - DNA, 122 bp, Homo sapiens
tgacgcagctcttccaatgatcatcatgacttagttgtgtaataaagcaagaggcttacacaaagaagagcagcaatctccagaacacggttctgtcttgcatgtaagactgtaccaactca

SEQ ID NO: 705473 - DNA, 128 bp, Homo sapiens
agattggcacaaagcagcagctgtattgtccgcagttctagtttaccttaacgatgttttccttggttaaaagggaattaatcagtcttcaagtttgaggtatttagaaacaatggtaagggagagca

SEQ ID NO: 705474 - DNA, 917 bp, Homo sapiens
  misc_feature (590)..(590): n is a, c, g, or t
atggacatgcaggcgctggtgggtctacaaggatgctacttcccctatcatagaagagcttatcacctttcatgatcatgccctcatattcattgccttatctgcttcctagtcctgttgtgcccttattcctaactgtcaacaagaaaattaagctaatactaatcgatctcagatcgctcgaggacaagtagaaagccgtctgatagtatcctgcccgtctagtcatccctagtcctacatcggccctcccatccttacgcttcctttacataaaatgaggatgtcaccgatactctcccttagcatcaagtcacttgccagcaatggtattgactctacgagtacacgcggaatacgggggacgaatcttcaatctcctatcatactttcccccagtatcctagaaacctgggaactggggactccttgaggttgacaataccgagtaggacctcccgaaattagagctgccatcggatattactcacatcagagatgacgtcttggactctatgagctgtccccatcttcagggttataaacatcagatgcgattcccggtggtctaaactatgcactttcctcgnttacacgatcggggtatcctgacggtcaactggtctgactatctgtgtggcgtcctgacagttacgtggctagcagtgctagaatgagtcgctagaatcttggagctaggggccgtatgatctttaatatctttacccttttgagaagataggagtgaatagcagaaatttgggcggcacgctccaaccggtacgcacctgggcgcgcgattaaaaggcaccggtccaaaccgcggaatcgggctcaaccaagcggggaacgcgaaacacagtggcgcgttcaggcaccacgacgacaataaaaccgggcacacttcgacaacatcg

SEQ ID NO: 705475 - DNA, 423 bp, Homo sapiens
tcagtacggggagatcaccgtctacagactcatgttactaatataagacaagattaactcatgacaaaagtaacgcagaaataaattcacataaatacagaaatggatgccattaaacaacttcagcgcatctcatctttaaaattcttagatccttttcactgcaggctatagttacctgctccagctcaccaatggattattgttcaactttaactacagtacattataaaccctcttatatccttaaagaaaattttaagtgaaaattacaattacttaccaaaaggtttagggttttccaaatttcaaatatatgcttccccctcccccctttccagtcaaacatttcaaataaactaaaaataaccacatctcacctgcaacattcaataatagcaatcacttgagtattgtataaag

SEQ ID NO: 705476 - DNA, 115 bp, Homo sapiens
gcaagatggcgggtgaaagttgaggaggcagatacttaagaggaggacccgaaggccaaggaggtttatttctgtgtgcaagggtaaaaagggaaccctaagctctaaagcccca

SEQ ID NO: 705477 - DNA, 652 bp, Homo sapiens
caccgaagctggagtgcagtggtgcaacgatagctcactgggatctcaaactcctgggctcaagcaatcctccaccccagcctcccgagcagtcacaaccacagatgcacaccaccatgcttggctaacccttctttttggtagagacagggtctcgctatgttgccgaggctggtcctgaactcccgggctcaaccgatccttccaccctggcccccttaaagtgccaggattgaaggcatgagccaccacttatggcccataaggaagatttttaaaaattaattcgtgccttacatttatctggagccaccttagactatgacaaacaaatgcagctggtcaaggtggctcacacatgtaatcccaacaattaaggagcccaaagcagaaggaccgcttaagcccaagagctcaagaccagcctgggcaacatagcgagacttcatctcttaaaaaagagaaactaattatgtaagcatggtgacatgcacgtgcggttcagccactcaggatgctgagatggcatgataaccccgggccaaagggttgagctgcatttacccagaatggccacttggattcactctgggcaacaaacagaaactgtttggaaagagaacaattactggtaagggtcctttgccggctt

SEQ ID NO: 705478 - DNA, 381 bp, Homo sapiens
cgttctgtttctgggtgtgtacctcaaagaattgaaagcagggaatcaaggagatctttgtacaccagtgttcatagcagcactctccgaaatagccaaaaggcagaagcaacctaagtgtctgtccattgatagttgaatggataaaaggaaggaaattctgacataggctctaatgtggaggaaccttcaggacattatgctaagggaaataagccagtcacaaaaggaaaaatactgtatgattccttccattcatgtgagatatttagagtagtcgaattcatgaagacagaaagtagcaaagtggttgccaagctttggggagaggggatcaaagtcagttactgtttaaagcgtaaagagtttccctttatcctg

SEQ ID NO: 705479 - DNA, 414 bp, Homo sapiens
gttcggcgctaggggtttaaagggcggtgtatgtggcgttcgtttctttgaggtgtaggtgattaaggcagctgaaaagtagattgccttctagacactgaaggcggatcggctttgtccatttgcgtggaaaccagaatgattttgacatacaggagagctgcagttgtgaaagcacgatcatcatagaggatgatgtaattaaaaaatggtcagtgtgcaaagaggagaactgcttgcatttctgtatttcgtgtctcgtagttgtcggaaaccagaattaggtcgggttcggtagtttctgtaattggcttttggatcggagaatagggagacaatctagaagatagcttaggttggagatggcagaggtgtggttgatttgaggtggagagagaggttcgtgttagtgtt

SEQ ID NO: 705480 - DNA, 884 bp, Homo sapiens
gctgttccgagatgtgcgcgcccagtggcgcccatccgaaggtggaccccaccgcgtggtctgttttgaggactttgcgacccagaatgacaactaagggtgggcgtatatccgtgcagcaacccacatatggtgaagggaccacgggaggaccgcaccccccgggtggtcccgatcgtggaagaaagaaccaacggttagaggtgacgcagcggtgtccacaaacccatagggaccgtttccagtatttaaccctcaagaaatttgatgctccacaacgtggaaaccccgtgttaaaatggctcaccggtatgtacaacaccgccgccctccactaaaggtgtactgttagcatttagtcccatatggacccattctgaggccaaacaaccgtgtgacttttgccttgattccctggaaggtcccgcccccctgataaattgtaaggtaatctttttttctctagagtagaggtataattgtgtgatatttccagaaataccagatataatgagttccaaaagtcacccgcttataggagaatcatgttctctttgatcactggataactgagtgtagtgaagtcttgcctcatattttcctcgagtagcactatgaccaaagttttctaaggtacccacgatgaggaccaagataaagattgtgtggtgttttggagtttggagagagaatattttaatttttataaaagccgttacccccattataaaggattcataatattgtactttttggttaaaagcaagagtgcagaattggttagattttgtgtttatttttgatggaaagactttgtttgtttttgtttttaagtttgccactccaatttttaggaataaatccccccctgttttccagcccca

SEQ ID NO: 705481 - DNA, 1129 bp, Homo sapiens
  misc_feature (456)..(456): n is a, c, g, or t
  misc_feature (489)..(489): n is a, c, g, or t
ctctgtgtggaggataattacatcctaccctgtgtttgtcaccagtatactttcaaaagcagtgtgcctgctgagagtccggattttacccccgctccggacgtggtgctatattaaaggaaatataagtgaaaagccttcaaggtcagaggttccccctcgacattgttcacaggtttatagagaactaatgtgagactatttttttcgcgcccccaaacccacagagagccttgttcccccggccctcctggacacatagcccctatccgtgattccttggccttggcattctttagctccaggaaaggtagaagagaatcttgtgcccatgggtctccctgcggtcaaacccttcgtggtttcaggacaataatgtgattggttatctggttaagggatgggggaccagataatatgaacgaagccaagtgaccgtataccggccaagcatgngacagcatttccccctgggcttgctccttggcnttttgacgctataagacacgaggcacggccaacacatgtggccaatttgctccccaatttttgaaaagcttctggggcctccttgcaaggcttttggatctctggtccagagtgaactcttgcttcccgttattccaggccagctccagacgccagaaagttaaggggccaggagtcaataacagttgtggcccaggaagattagcccagggtgaacaagagactcggtgcgggccagggagaatagcctgggggtccctcacctggcttagggagaataaccgaagcctactgtggtactgaagaactttctgggttctttcctttctgctaaccccgggagggtcctaagaaggaaggtgacattcttctctgtttgtcttaagattgccactgggggatttcttgacattgaggccccatctcttcccagcccagcccactgccttcttttgtaatattaagtgccttgagctggaatggggaagggggacacagggtcagtctgtcgggtggggcgccagaaatccaatccagcccaaggatatagttaggattaattacttaatagagaaatcctaactatatcacaccaagggatacaactataaatgtaataaaatttatgttctagaagtta

SEQ ID NO: 705482 - DNA, 474 bp, Homo sapiens
  misc_feature (27)..(28): n is a, c, g, or t
  misc_feature (39)..(40): n is a, c, g, or t
  misc_feature (52)..(52): n is a, c, g, or t
  misc_feature (56)..(57): n is a, c, g, or t
  misc_feature (74)..(74): n is a, c, g, or t
  misc_feature (79)..(79): n is a, c, g, or t
  misc_feature (86)..(86): n is a, c, g, or t
  misc_feature (92)..(92): n is a, c, g, or t
  misc_feature (101)..(101): n is a, c, g, or t
  misc_feature (107)..(107): n is a, c, g, or t
  misc_feature (117)..(117): n is a, c, g, or t
  misc_feature (121)..(121): n is a, c, g, or t
  misc_feature (126)..(126): n is a, c, g, or t
  misc_feature (129)..(129): n is a, c, g, or t
  misc_feature (134)..(135): n is a, c, g, or t
  misc_feature (137)..(137): n is a, c, g, or t
  misc_feature (139)..(139): n is a, c, g, or t
  misc_feature (146)..(146): n is a, c, g, or t
  misc_feature (149)..(150): n is a, c, g, or t
  misc_feature (153)..(153): n is a, c, g, or t
  misc_feature (168)..(168): n is a, c, g, or t
  misc_feature (247)..(247): n is a, c, g, or t
  misc_feature (259)..(260): n is a, c, g, or t
  misc_feature (264)..(264): n is a, c, g, or t
  misc_feature (345)..(345): n is a, c, g, or t
  misc_feature (347)..(347): n is a, c, g, or t
  misc_feature (349)..(349): n is a, c, g, or t
  misc_feature (361)..(361): n is a, c, g, or t
  misc_feature (370)..(370): n is a, c, g, or t
  misc_feature (379)..(379): n is a, c, g, or t
  misc_feature (381)..(382): n is a, c, g, or t
  misc_feature (414)..(414): n is a, c, g, or t
  misc_feature (470)..(470): n is a, c, g, or t
ctgatttgacagacttgctgtgattannatgaaagtagnnatattttggagntgannaggatgattcttttatntgaantattgancatttntttcctgtnagtatncagtgggatngggnagcgnagnttggnncngnggcctgnggnnagntgctgcttcccagcnaattagaagtaggagtgaaaacatccacaccaggtggtcgtaagaagactcctgctgtctgactggagggtgcgggggnaagggggggggnnaganggggtgatggggagaggaaagaataaggttttatgacacactaatacttctgcatttattagttgataatcagatcaacanantnaatggtaatgantgcttagtnaaactagtncnnatactgatatttgctcctttctgagggagagngcctgcgcttggaactgtccaaggtgctgatgtgaactaacggaaacacttcattngttc

SEQ ID NO: 705483 - DNA, 185 bp, Homo sapiens
agggccacagccaaggggaagcttttaaaggacagaagtccatgtaagcagcttttaaacaaggtttgtaagtccctagatgatcacagtagccgtcgagggctatctggtgtagaagactgtggtaagttagcatttgcagctagtgtgaagtttagcagtcttcagtacgtgctttccatacg

SEQ ID NO: 705484 - DNA, 117 bp, Homo sapiens
ccctcaggatcccccgtcgctgcgccaccgtgagcgttggcggcggcgtcgatgcgttctaccgtcccggccaggtggcgcacgccgacggcggcgagctgcgcggaaatgtccggg

SEQ ID NO: 705485 - DNA, 117 bp, Homo sapiens
taaaacccttatcaattgatggggacctaccgaaattggcaaaccacatttacaaaatgccatttttaagcggggggttttaaaccaaaagggggtttggatttaaagtgaaatttt

SEQ ID NO: 705486 - DNA, 340 bp, Homo sapiens
atgatcatatagagatagactttatttaatcattcccctactacgagacatatagagtgttacgacgtcctcttccatttggaaacactccaagctactgtactcgggaaccggcaacccatcaatagaagactcaatatgaagtgcttgcataaaactctctgataaagagctatatgaaagcagtagcctaagctgtctacaatataatatgaacagttcatattgccagtctctaagagaataacctaccagccatctcgtaagtcaatacataatgtcgtcgatagttatcgcgagatctcctacagagaggccagaggcatgattgtctatcctg

SEQ ID NO: 705487 - DNA, 228 bp, Homo sapiens
tctagaccatgcttataaattagcgacggcacagccacggaagtatcagatcaagccatgtctgtgatctacaccacagctcacggaacgtcggatcttaacccactgaccaggccagggatcgaatctgcatcctcctggataccggttgggtttgttacactgagccactaagaaaactctccagaactttttaattattgaaaattgcgtcggctacattttccg

SEQ ID NO: 705488 - DNA, 253 bp, Homo sapiens
acccgccctctagcacacacactggggcctaattgagggtggagggtggtaggagggagaggaccaggaaaaatgactaataggtaccaggcttaatacctgggtgatgaaatgatctgtacaatagactcccatgacacacatttacttatgtaacaatcctgcacatgtacccctgaacttaaaagttgaaaaaaaaaattcagtcttgcctttggtttttagcatttttactatgatatgactagagtgg

SEQ ID NO: 705489 - DNA, 1098 bp, Homo sapiens
tcgccgtggccaggcagggttctgccaggctctatcgccaagggagcaggggtccacctggggcctagtgacgcctgcagatagccctctcttagccccaacggcgcgcgggcttcagacgctccccggctccctcgctctgcagggtcttcccgggtaccggcaggccgcggcgggagcatgcttccggctcttaaccttgcaggtcgctgttgtgccgctgggccgcccggggcaggcaggacgcaaaggaggaggccgcccgccaatgcccgggcctgcgggcttccccgcctcggtttcccgtccgccagcccccggggaacgggccttgctcgcagccccttgtgcaagcaggaaccaggcgcgcggcgagcagcgcgcgaaggaggcaggaaggcagccgccccccttgtggcaaagcctcccacgaacccggagggcctccggcagggcacccgagtgcggcggatcccatcgacccagaaacgtgtcacctgcgggcaaagcgcggcacacccacgagagccgcccgcggggccccctcggagccccccatttcgcacgcacaggctggggacatcgggagcatccgggagcatccccagaggcctcccgaagagcacggcacgaagctctagatcagcatgaaagccctttgcgcccgagaaccccaaaagaccccgaatccgcacaccgcgaacaagccaccccgaaccacaaagcgtctgcccagggcaccaccccaatatgagaccgacaccacggagggcacccaatcagaaacccgcccacaatgttgacaagccaccccggggagacccccggagacggcgtgcgtcgaacaagaccgctgtgcaagaggggccacattcaggagcgccatcacaaagagtaaaggggagtggtgcaccagcataggggccaaccaggagactttaccacagagggtgcccccacattacagcaacgtggtttctcgaccccaaacggcaaatgggaacataaaatctcccgttggaccgacggacaaaacactcttgtgggcaccacttcccccgagtagttatatattctatccacagcagatgacgaccg

SEQ ID NO: 705490 - DNA, 231 bp, Homo sapiens
gacgatgcgttttcgcaggatttttctgagccgttttacactccagcctagcccctaccccccaattaggagggcgactggcccccaacaggcattaccccgctaagtcccctagaagtccactctcctaaacacatcgtgattactcgcatcaggagtatcaatcacctgagctcagcatagtctaatagaaaacaagcgaaaacggcatctgcctcggggggctcctca

SEQ ID NO: 705491 - DNA, 226 bp, Homo sapiens
gaaagtgggtcagagccgggccggggagcgcgcagcgggggctgcagattctgtccaccgagggtccagacgcccccggaacagcaggcctggcacttcgtcctgaggtgcagcccgcgcgagacgcagatgcccggggcgggctctagcaggctccactaactggggctactgactctgatgggcagcacagcgactcgggactcgcgaccccggagtactccac

SEQ ID NO: 705492 - DNA, 502 bp, Homo sapiens
ctcgcgaactgtgttatccgagggacccgcaactcagctacagtacagatcatgacctatgaatgcttcatcacgggacctggttttgctgctccttggtcctggcgtgttagcagccgaagcttcttttcgttccttggcgaggcttctgatggggctcgggacgtgtggagagcctactctgacatgagagaagccaattacatcggctcagacaaatacttccatgctcgggggaactatgatgctgccaaaaggggacctgggggtgcctgggctgcagaagtgatcagcgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggataacacgttcgcga

SEQ ID NO: 705493 - DNA, 358 bp, Homo sapiens
atcctgcacagggaagggcacagtgcagtcgatgtcccaaaggccactcctaagcacagcaatgaccaaggaaggccctgcggggatgcagggacagcagcagccaacggcgggaggtcatcgggatgggagccatgagcaaggggagtaggagaggtgagctcaggtcatgtagggccctgtgggcaacagcagggactttgtcgttcagcctgtgaggcaagagctcctatgggtagggaagatgtgatgtgacctatttcatttcatttcattaaatgaaataaatgactcgctctgtcgcccaggctggagtgcagtgacgtgatcttggctcgctgcaaccttcacctcccgg

SEQ ID NO: 705494 - DNA, 203 bp, Homo sapiens
gttcccccagaattcagagcggacttaaagcggtcagtgtaattcattattaaaattaggttaaggggcacttcacttatttatggaggcggtttggcttaccttcatgaagatccaggggtccaaaaagggaaggaattacctttaataacaaggcagatacccaattcctaaagtaggtccaaataacggcaaaaaaaggg

SEQ ID NO: 705495 - DNA, 681 bp, Homo sapiens
  misc_feature (65)..(67): n is a, c, g, or t
  misc_feature (72)..(73): n is a, c, g, or t
  misc_feature (79)..(79): n is a, c, g, or t
  misc_feature (454)..(454): n is a, c, g, or t
  misc_feature (477)..(477): n is a, c, g, or t
  misc_feature (494)..(494): n is a, c, g, or t
  misc_feature (580)..(580): n is a, c, g, or t
cggacttcttggtgtgttgggactataggcacgcccacctatttattgtagagataataaatctnnnataannctatgntgcccaggctggtctcaaactcctgagctcaagcaatctacctgcctcccaaagtgctgggattgtaggtgtgagccaccatgcctggccagggatggtttcaataagggtgcaaccctaatccgatagggctggtaccctcatgagaaaaggaagaggtaccagagcattctctttgctatgtgcaactctaaaagacagcccgtaccaggcagcaatctgtcgggcaccttaatcttggacttccagccaataaatgcctattgcttcagttccccagtctaaggtagtctgttgtgacagcccgagcccactgatggtgagaaagactttattccctgtgtggtggaagttgcagcacactaagaaacaggnactagcaaaagagctttcctgcnccttcagttttttttgnttttgtgtttttttttgagacagtgtctcactctgtcacccaggctgcagtgcagtggcatgatctcagctcactgcaacctccanctcccaggttcaagtgattctcctgtctcaacacaccaagaacaacacaccaagaaggtcggaccttctggtgtgttggccagtggccgaagcgtttctgc

SEQ ID NO: 705496 - DNA, 190 bp, Homo sapiens
ttcaggagagagaactgacatctcgtgctcagccttggctgtcgtgccggtcaggaattgaacgtgagattccgagacggctaccacgcgataccgggtgaagtcgtcttggtgaggattggcgtggcgccggcccctgtccgcggcagaacctgtggtcctgtgggaactgggcgctagcgcaccctgg

SEQ ID NO: 705497 - DNA, 208 bp, Homo sapiens
tagggtacctccctgtggcccacgccaaactatagaaaaaacccaagcctgggagtgtactggggaggggaggtagtataggggaaacccctgtgctctaggctctggcctgggcagtgcagacagagagggctcatgtggaaggagtaggccagtaactccacctgcagaggacatggcactaggctagggatacgttgaggggagg

SEQ ID NO: 705498 - DNA, 218 bp, Homo sapiens
gcagtatgatcgtacttcataatatgtagccaatcactaactaagttatttctgtaagccaggaacattcctgactaacaactttgttatcacctcctcttgtgatcacctcctcctccgatttatgctcttttctttttttttttcttttctctcccttcggtctcggtctctctttttctctttctcactttctttctttctcattctagggtggt

SEQ ID NO: 705499 - DNA, 820 bp, Homo sapiens
agtcttctcgtgaatccacggccggtcatgagaagaaccgaggactgtgacgcaggcatgcgagtgctcgtgtgatgacgatggaggcctgggaagggtcgacgggcatacgatttgaggctgccaacgctaataggatacctcgacctatagcatacttatcgtcgatttgcactgcctggcacacggggcatcagggcacgcataggagttccatcactacgcgagcaagcacggacgttgcgcacgtggaatgcaattggttgaaagcaggccctgtcccgcttgtcactctacggagaaacttcgccaagcgctctggaatccgcggatagctcacatccgctcacataggcgtgaaacaagtggacatagcccttccaattgatgaggaatcaaccatctggacactggccccaaccacggcacccgcaacacacttataacacacgggtgaaaactatgaagcaccgtgtgctacgggacagtccgacctatgaagatcagcggctcagcattcatgcggacaaaacggcagccccttatgcaccccatatgaccctcaacggactaccccaaactgatgggaccacgtaacctcacagctcaacgtcgtcggaggcacacaaacacactggggggcatcgccggaccatacgcaccgcttccccccaattggaacgacacccgattggagtcgcactgacattcatatgagcaaccaatcccagaactttcccaggccaagtggtccccggttgagagctccctcgcacaccaacagctcgtagtctgcacccattatgccaaacgtaagcat

SEQ ID NO: 705500 - DNA, 512 bp, Homo sapiens
aaatcaagcaatctcctgccttactacccactagatgggattacaggcactcgtcaacaagccaggctgatttatgtactttaagtagagatggggttacaacatgatgaacaggctggtcttgaaatcctgacctcaggtgatccacccaacctggcctcccaaagtgctgagactacaggcgtgagccaacacacccagtcaaatgtagtgtatcaatgtgagtagtcctatatatttatttatcttaaaaatgaagtctggttctaatcacccaggctgaaatgcaccggtgtaatctcggatcactgcaaactccgcctccttggttacaactaatagtcctgcctcagactcccaagtagctcgggcataaagatgcatgcccagctaatattggacataaataaaaaacagaagagttttcgccacattggccaggctggttacaaactcctagactcagtagatccgcccgcctcagtctcccaaagtgtcaggattacaggctt

SEQ ID NO: 705501 - DNA, 326 bp, Homo sapiens
tttactcggggaaaacctcacctctcttcagatgcagactggattctggtccccactcccttttaggtcttgggctagtgctgggagaggccgtggaggtgttgaagtccgtccttgcttggtctcttgccttctctcatccctttcttctctcgtggagaatgcttgcaaaattatcctaagaaagcttattcaggatattaactttttctaatgtcttaagagcacttcttactgcaaatgggcgaactgctctgcctgagggtcacgagaggaagcaccccaacaggcctccatcatcccaaggcagctcaatccggactctt

SEQ ID NO: 705502 - DNA, 539 bp, Homo sapiens
agtaagtatgcctgtcatcaaagtgaaaacatcaatattgaaagtaaattccaatgaaattgttatgtttctccaacatctacctacatacatgtattgagaatgaaggaagactaaaatcagatttgaagatcttgtttagatggttctgaaaacagatttgaatataagagatcaaagtttaccaacttcataagttaccacttcataagtcacaggcattcacaggcaaggttccaggacatgctatgctcctgggagcgcagtactggcattgtaaatcagaccacgaggtcaatgtcatggcgtttcccatatgagggtccccaaaccagaatctttacaaagcagccatgtaattctggggcccttgagggtggacgcaacctccgagccgccagtccctggcgcagggcaagcgctgcggtgtcagtcccggccccagtcccggtcccattcacaagtcagcggcggctgcgagcggcccccgcggcatctgctcctcggcccgcgacgctcccctcagctggcggcggccg

SEQ ID NO: 705503 - DNA, 140 bp, Homo sapiens
gagctcgccacccaacaaccgtcgcgaagcgctgcgtgcctatgcccgggcctgcgtcgactgcattcactcggcggctcgcgggtttgatactggcgcggtaacgctggcgatgattgaaggcagcgctctgggcggag

SEQ ID NO: 705504 - DNA, 403 bp, Homo sapiens
cctgtcactgtcacttttctccctcctcattccctgtggtactgatggcagtgaacctgagaggcacctggagaagtgagtgcaggcttggtgttttgattaggggaggggtcagtcaagaagatgagctgaggtgtgaccatgctcctaaccctgccttcctggacactccaggaacctttggactaaggtgggaccaagcctaggcctctcccttctcctaccctctcacgtcccattagggagcccttgagggatggggttagcactcacctctgaggtggaggagggaagagggacctgggctgcggaagaacctccctgtaaatcaggtgcagtactgggaccatctgttctgtgaccccacccacctctaagaaataaaaatcaggtttgactctga

SEQ ID NO: 705505 - DNA, 472 bp, Homo sapiens
  misc_feature (115)..(115): n is a, c, g, or t
  misc_feature (291)..(291): n is a, c, g, or t
  misc_feature (355)..(355): n is a, c, g, or t
cagccgcctttgtccctaggccccgcccaaacccacaaggaaacaattcagcccctcccgcccaaggaccctggccccccacccaataaattttggttttggcccaaaaggtgcntagggatcccccattcccccccctgggaaataagggggtccccatgtgtttttccagtttttttggaattgggggcccccccccaaaaaccaagcccccggttccccccatcattgggtttcctttgggctttggggaaatttttaaattttgggagcccccccatccccaagggnggggatttgtggcagggattccactcaaaccctttttggaatttgggcctaatggccctccccngggattttggggttcccacccccccatggggattttggggggccccttttgggttcccccccccattaaaggaccccttttttttttccccaaaaagcacaaaattttggggggcca

SEQ ID NO: 705506 - DNA, 705 bp, Homo sapiens
  misc_feature (229)..(229): n is a, c, g, or t
  misc_feature (399)..(400): n is a, c, g, or t
  misc_feature (413)..(413): n is a, c, g, or t
  misc_feature (432)..(432): n is a, c, g, or t
  misc_feature (435)..(436): n is a, c, g, or t
  misc_feature (439)..(439): n is a, c, g, or t
  misc_feature (442)..(442): n is a, c, g, or t
  misc_feature (450)..(450): n is a, c, g, or t
  misc_feature (453)..(453): n is a, c, g, or t
  misc_feature (584)..(584): n is a, c, g, or t
  misc_feature (592)..(592): n is a, c, g, or t
  misc_feature (624)..(624): n is a, c, g, or t
  misc_feature (702)..(702): n is a, c, g, or t
ctaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcnaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgcccatgggnnggcaacaaatggnacgctgcgccaccccgtcncannccncgntcccctgnaangcgcaaccccaagctggggccaggggaaaagtatgaattgcacgcagcgactgacaccactcccagcgtggtggtccatgtatgtgagagtgatcaagagaaggtaggtaagaagaggaaatggtaagtangaggtganctaagccaaaaattatccagtaccagaggccngagtacacgccgatccacctcagctgaactggcacgcgacgaggacgcattccaatcatactcacgggaggaatctcntac

SEQ ID NO: 705507 - DNA, 162 bp, Homo sapiens
cagtatctagctccaaggtccgggttatgctccaaggacagcgataacagacatatatttgaactcatcgtggtctgaggttaaagtgtctccactaaccctgctaggtctcttgccggatcagtagctgtaaaagaacttgactgtgtgttggcatctgga

SEQ ID NO: 705508 - DNA, 785 bp, Homo sapiens
agcggctctttccgtctcaggtcgccgctgcgaagggagccgtcgtccatgtctgcgtcatctgcaatggatggtcgtgcggaaggtgctccagtttcctgatcaggatggaagtaacgcagacctacagcactgagcccaataacttgaaggcccggaattccttccggtacaacggactgattcaccgcaagactgtgggcgtggagccgggagccgacggccaaggtgtcctggtggtcattaacgcggagatcctggccagcggaagcgctgccaacgtcctattgttgcggaccatacatgcaacatagaattgctcgagccaggctcaagaaggattagagcacattgatcccgtaagaacaaagtaccggcccgaactgcgcatgtgagccagtccgcgagggctcagcggcgcatcgcgtgcgcagaccatgaaggcctgtgattggtgaagaaggaaagctggagccgagcccaacgatgagctcctgaaacccgctgactcccatagcaatataagtcaggcatggcttttcgtcatcccggtaatcagaacacattaagagctttgcagagcaggaggacgtgggaattaaggggcgcagagaaactgttccaggggagggggacgcacgagaaatccaggcgttattgcttcgccttttacatcgagaacgggaaaatgtttccagacttgggagctttagatacctgtggcctatagaagtgtgtacccagcgtctgaagaattgtaaacccgtttcaaagttaccaaacat

SEQ ID NO: 705509 - DNA, 402 bp, Homo sapiens
  misc_feature (11)..(11): n is a, c, g, or t
tatattcaggncagcatggtggctcacatctgcaattccagcactctgggaaggccgagttgggcagatcacatgaggccaggagttcaagaccagcctgaccaacatggtgaaaccccgtctctactaaaaatacaaaaattagccaggcatggtggcacgggcctgtaatcccagctacttgggaggctgaggtaggaggattgcttgagccaaggagtttgaggctacagtgagctgtgatcgggctactgtactccagcctgggtgactgagaccctggctcttaaaaaaaaaaaaaagggcttatgtatgtatttggtggattttggactaaggtacaagggttattcaatggggaagtgatagtgtcgtgttttagagctagaagaactagcttct

SEQ ID NO: 705510 - DNA, 138 bp, Homo sapiens
ggtgtcagtcggatgtggaaccagcacctgggctacgtgctcacctggccatccaacctgggcactgggctgcgttgaggcgtgcattgttacaactggcgcaccgtgagcaagcaacccaagttcgaggtagatcct

SEQ ID NO: 705511 - DNA, 455 bp, Homo sapiens
ggtcggacgggttccttgtctataaatatcatagcttctaggtacagcagatgtgacacaaactggtataccttgctaacatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagagacaaagggaaaca

SEQ ID NO: 705512 - DNA, 1616 bp, Homo sapiens
  misc_feature (738)..(738): n is a, c, g, or t
  misc_feature (831)..(831): n is a, c, g, or t
  misc_feature (1616)..(1616): n is a, c, g, or t
gagcccaagcttaccacctgcacccgtgagagctgtgtcaccatgtgggtcccgggttgtcttcctcaccctgtccgtgacgtggattggcgctgcgcccctcatcctgtctcggattgtgggaggcttgggatgtgcgagaagcaattcccaaaccctggcaggttgcttgtggcctctcgtggcatgggcagtctgcggccggtgtcctgggtgcacccccagttgggtcctcaaagttgcccactgtgcatcaggaacaaaagcgtgatcttgctggggtcgggacagccgtgtttcatcctgaagacacaggccaggtattttcaggtcagccacagtttcccaaaccgctctacgatatgagcctcctgaagaatcgattcctcaggccacggtgattgattccagccagaactcatgctgtccgctgtgtaagagcctgcgagtcacggatgccgtgaagggtcatggacctgcccacccaggagccagcacttgggaccaacttgtaacgctacagggtgggcagcattgaaccagaggagtcttgaacccaaagaaacttcaggtggtgtgacctcatgttattccactggcgtgtgtcggcacgtcaccctcagaaggtgccaagttcatcgggtgttgtgacctcgaccgtgggcaccagcttggcgtggcttggggccttgttgcatgctgtccagggtccatgtggggcgcatgcctccccgagcnccgaccgtgtgtctcggtgcgcccttggtccgcgcaccttggtggtgtgctcctccctctccttcgctccgtctcctctgcgtctcgtgtcgnacactagaagaaaaaagacgagagcaggggcgagagcaggagaagaaagcgagaaagggccacgaaggaaggagaagaggagaaagcagacacggaccaagaggagaggaacgagagacagatagggaagcagggaagaacagggaccgagaaggaatgaagagaggagacgacggaggagaaacgggggggacgcggaggagagagagggcaagaccgacagcaaacaagagacgaggagaggacggagaggacagcagaagcgaagagagggagaacgaaacggaacaagagaagagaagagggagaagagaaacgacgagaacagcagcagaagcacagaggaagacagagaacagcagaatacccgggcaacgagagggagcaccggagaggcagaacgagaagagagagaaaagaaagaagaagaggaggagaggacatagaagacgagacaaggcaagaacaaggagagagggaaaggcgagaagagcagagagagagaaaggcgacggagcagaagggagagaagcagagggcgagaccggagaaaacgaagatcagaacggacgaagagaagaaacgagggaagacagagggaacacagacgagagcgcggggaggagcaggagaagcaagtcacgaaggcacgcggggagaagagtaaggaacaagggaacagagaggcacgaacagacgacggacacagcagcaagcaggaggcacggaggaaggaagaggagaggaagaggagcgaagaaaagcaagcgcaagagatagagaan

SEQ ID NO: 705513 - DNA, 1038 bp, Homo sapiens
ctggaagctgcgtgaggacgggagctcgagagagctaacaggactagacctggctggacatctggaccgctggatccggagtgtggctgaccccgtgctgacccggaccctaaatccgtccccgccccagaggtgcggaggcgcgctgctctgattccccccaccgctggctgtgctgcctgcctgtttacgtctgcagatctccagggtgagccccaccagcctagtcaacatggcctcggaagacattgccaatgctggcagagacacttgccaagactcagtgtggccgggggacagctgagtttcaaaggcaagagcctcaaactcaacactgcacacgatcgctaaagatgtgattaccagacattgccgcactttgacagcttggcaggctctgcgtctggaaggcaacacagtgggcgtggaagcagccagggtcaatcgacaaggccttagcaccaacaagctccggcacgtcgacagcgctgccactggcacgtgacatgtccacccggcacggcctgcggacacccgaggatcccaccagacccctgactcatcacctagcgccgcaacgacctcatccacacgcctgcggcgccaccacacatgcgtgcgcagcctgggaccttaacgccgacacacagccatacgaggccccgactggtcgttgcaacggacttccgcacgaccacagatcacagacgccttcacgcccctgccctcaccaccccatggccacggaacgctccaagccctccacacagactgtgcgccactggcgccccctcgagtccgagcagcgccacagaacccacctgccatgcaacgcaccccacgacccgcgcaccgtgccaaccccggggaaaaccccacagcagtgccccaccgggcccaggccccaccggggcccgtgaaaccgggcacccacggagggcagggcaggcaaagcccggatcaggccccactcgcaccgagacgccccgcgccctcgcgccacgcacggcccccaccgggcccactccggccacccat

SEQ ID NO: 705514 - DNA, 111 bp, Homo sapiens
gaggatcctgtgcggatgaagtgtctgtaggtacgttttatattatataaggacagaccaaaaatccaggttggtggaagtcgcgttctttacatctgggagcggggctgt

SEQ ID NO: 705515 - DNA, 2488 bp, Homo sapiens
ttcaagccggcgcgccgcggggtgagcggcgccgggcctgaggtcgcccagacgccgtcggggcggagcggggtcgcgaggctgcatcccggccggcggttccggagcctcgcggctggggaggcgcggcccgggacgctcgagcttagggagatctgccttctggagactgcgccgtcctcccgggagagccagaaagaggacatggctgctgggcagcgggaagcgaggccccaggtgtcactgacgtttgaggatgtggctgtgctgtttacccgagatgagtggagaaagctggccccttctcagagaaacttgtaccgggatgtgatgctggagaactataggaacctggtctcactggggctcccatttaccaaaccaaaagtgatctccctgttgcagcaaggagaagatccctgggaggtggagaaagacggttctggcgtctcctctctaggatcgaagagcagtcataaaaccacaaagtcaacgcaaacacaagactcttcatttcagggactgatactgaaaagatccaacaggaatgtaccttgggatttgaaattagaaaagccttacatatatgaaggcagattagagaaaaagcaggataaaaagggaagttttcagatagtttcagccacccacaaaaaaatccccactatagaaagaagccataaaaatactgaattgagccaaaacttcagcccaaagtcagtgcttattaggcaacagatacttcccagagaaaaaacaccaccaaaatgtgaaatacaaggaaacagcctcaaacagaattcacaattacttaatcaaccaaaaattacagcagataaacgctataaatgtagtctgtgtgaaaaaaccttcattaacacttcatcccttcgtaaacatgagaaaaaccatagtggagagaaactatttaagtgtaaagaatgttcaaaagcctttagccaaagttcagctcttattcaacatcaaataacgcatactggagagaaaccctacatatgtaaagaatgtgggaaagcctttactctcagtacatccctttataaacatctaagaacccatactgtggagaaatcctacagatgtaaagaatgtggtaaatccttcagccgaaggtcaggcctttttatacatcaaaaaattcatgctgaagaaaacccttgtaagtataatccgggtaggaaggcatctagttgcagcacatccctttctggatgtcaaagaattcattctagaaagaagtcctacttatgtaatgaatgtggcaacacctttaagtctagctcatcccttcgttatcatcagagaattcacactggagagaagccttttaaatgtagtgaatgtgggagagccttcagccagagtgcctctcttattcaacatgaaagaattcacaccggagaaaagccctatagatgcaatgaatgtgggaaaggctttacttctatttcacgacttaatagacaccgaatcattcatactggagagaagttttataattgtaatgaatgtggtaaagccttaagctcccactcaacacttattattcacgagcgaattcatactggagaaaaaccatgtaaatgtaaagtatgtggaaaagccttcagacagagttcagctctcattcaacatcagagaatgcatactggagaaagaccctataaatgtaacgagtgtgggaaaacattcaggtgtaactcatcacttagtaatcaccagagaattcatactggagagaaaccatatcgatgtgaggaatgtgggatatcttttggccaaagttcagctcttattcagcatcgaaggattcatacaggagaaaaaccctttaaatgtaatacatgtggaaaaacttttagacaaagctcatcacgtattgcacatcagagaattcatactggagagaaaccctatgaatgtaatacatgtgggaaacttttcaaccataggtcatcccttactaatcattataaaattcatatcgaagaggacccctagaaagtagatttgtatgtgtgaaagccttaaaccaaagctcatcgaagaatacatccttgagagagatgtaataaatgtaatggatgtgaaaaaaactgtaataatttagccctcattaggtatttaattccatggataaacctcagctatataatagatatgaggaaagtgtttgtgcctgtcagacacttaaaaaaataacctgagatgaagaatttacaattgaagacattgactttagccatttgtgaaatgggtttgctttttcccttttcctacagacgtatatgctagatgtcacgtgatcatcagaaacagatatccgagtgggtggggaggtgtgctttagatttctcattagaagaccaccaaactggtaatatttttatagcattttaatagcttgatcaaattgtacctttttagagaaaaggaccaaaataaaagaaaaatgaattatgaacta

SEQ ID NO: 705516 - DNA, 2507 bp, Homo sapiens
  misc_feature (552)..(552): n is a, c, g, or t
  misc_feature (554)..(554): n is a, c, g, or t
  misc_feature (561)..(561): n is a, c, g, or t
  misc_feature (563)..(563): n is a, c, g, or t
  misc_feature (616)..(616): n is a, c, g, or t
  misc_feature (620)..(620): n is a, c, g, or t
  misc_feature (638)..(638): n is a, c, g, or t
  misc_feature (643)..(643): n is a, c, g, or t
agcggccgccttgctcctctaggtcccaggcgctctgcggagctttcgctgcccggtgagcggcgccgggcttgaggtcgcccagacgtcggaggagccgggtcacgaggctggagcttcctgcttgcagagtgcggcggggaggcgcggcccgggaacgcgggatcctggggagatctgccttctggagactgcgccgtcctcccgggagagccagaaagaggacatggctgctgggcagcgggaagcgaggccccaggtgtcactgacgtttgaggatgtggctgtgctgtttacccgagatgagtggagaaagctggccccttctcagagaaacttgtaccgggatgtgatgctggagaactataggaacctggtctcactggggctcccatttaccaaaccaaaagtgatctccctgttgcagcaaggagaagatccctgggaggtggagaaagacggttctggcgtctcctctctaggatgtaagagcacacctaaaatgacaaagtcaactcaaactcaggattcatttcaggagcagataagganangattganangggatgaaccctggaacttcatatcagaaagatcctgcatatatgaagagaanttanagaaacagcaggacaaanatganaatttacaaataatttcagttgcccatacaaaaatccccactatagaaagaagccataaaaatactgaattgagccaaaacttcagcccaaagtcagtgcttattaggcaacagatacttcccagagaaaaaacaccaccaaaatgtgaaatacaaggaaacagcctcaaacagaattcacaattacttaatcaaccaaaaattacagcagataaacgctataaatgtagtctgtgtgaaaaaaccttcattaacacttcatcccttcgtaaacatgagaaaaaccatagtggagagaaactatttaagtgtaaagaatgttcaaaagcctttagccaaagttcagctcttattcaacatcaaataacgcatactggagagaaaccctacatatgtaaagaatgtgggaaagcctttactctcagtacatccctttataaacatctaagaacccatactgtggagaaatcctacagatgtaaagaatgtggtaaatccttcagccgaaggtcaggcctttttatacatcaaaaaattcatgctgaagaaaacccttgtaagtataatccgggtaggaaggcatctagttgcagcacatccctttctggatgtcaaagaattcattctagaaagaagtcctacttatgtaatgaatgtggcaacacctttaagtctagctcatcccttcgttatcatcagagaattcacactggagagaagccttttaaatgtagtgaatgtgggagagccttcagccagagtgcctctcttattcaacatgaaagaattcacaccggagaaaagccctatagatgcaatgaatgtgggaaaggctttacttctatttcacgacttaatagacaccgaatcattcatactggagagaagttttataattgtaatgaatgtggtaaagccttaagctcccactcaacacttattattcacgagcgaattcatactggagaaaaaccatgtaaatgtaaagtatgtggaaaagccttcagacagagttcagctctcattcaacatcagagaatgcatactggagaaagaccctataaatgtaacgagtgtgggaaaacattcaggtgtaactcatcacttagtaatcaccagagaattcatactggagagaaaccatatcgatgtgaggaatgtgggatatcttttggccaaagttcagctcttattcagcatcgaaggattcatacaggagaaaaaccctttaaatgtaatacatgtggaaaaacttttagacaaagctcatcacgtattgcacatcagagaattcatactggagagaaaccctatgaatgtaatacatgtgggaaacttttcaaccataggtcatcccttactaatcattataaaattcatatcgaagaggacccctagaaagtagatttgtatgtgtgaaagccttaaaccaaagctcatcgaagaatacatccttgagagagatgtaataaatgtaatggatgtgaaaaaaactgtaataatttagccctcattaggtatttaattccatggataaacctcagctatataatagatatgaggaaagtgtttgtgcctgtcagacacttaaaaaaataacctgagatgaagaatttacaattgaagacattgactttagccatttgtgaaatgggtttgctttttcccttttcctacagacgtatatgctagatgtcacgtgatcatcagaaacagatatccgagtgggtggggaggtgtgctttagatttctcattagaagaccaccaaactggtaatatttttatagcattttaatagcttgatcaaattgtacctttttagagaaaaggaccaaaataaaagaaaaatgaattatgaacta

SEQ ID NO: 705517 - DNA, 1042 bp, Homo sapiens
ccatcagttggtagagaatactgatgagactatcgcgttgacaacgaggcccgctatgatatctgcttgcgcactctgaagctgatcataccaatctacggggatctgaaccacctggtgtcagccaccatgagtggttgtcaccacctgcctccgatttccctggccagctcactgctgacctccgcaagtgtggcagtcaacatggtccccttcccagcgtgtccatctccttatatggcctggctttgcccctctcacgcacgaccgttggaagctcagtcagtatgcgagactctcacgagtgccgggaactcacccagtgaggtctatcgatgcccaagatacatgatgggcgtgcctgtgacccccgtcctaccgggcgatacctcaccgtggtctgctgatctatcccgtggctcgcgcatggtccatgaacggcagggtctgatgacgcagatgcttaacgtgctgatacatgaacaagccagctactttgtggaagtggagtcgcccaacaatggtcaacgaccacgccgtctgtgacactcaccaccttcagtggcctcaagatggcatgtctaccttctttggcattacgcacagccatcgaggagctcttcaggcgctctcggagcagttcactgcatgtccgccggaaggctttcctctcactggtacacaggcgaaggctggacgaaagggagttcaccgaggctgagagcaacgatgaacggacctcgtccggagtatccggggtccggatgccgcgcaaaagcaggagttccggaggcggcgcacagaggctagagagagcccccagcaccgaaggggatcggtccggagccgaggaaccagaagcccctccctgcccggaaatgggatgcgcccgacatgtgcagggatctgggggccgacagccggcgaaatggcgccaaatggtggggcccaaagaggccgcaaacggcgacggcccgtaggcacgattaaaggcccacgacacgggacggatgcaccacataggcgcggtggtacagagacg

SEQ ID NO: 705518 - DNA, 356 bp, Homo sapiens
cggcacgagctgagcgccagtacatgtagggagctgttcgccagagacagtgctgtgttctgcgcctcttctacatcggctacattcatgaggacacggttgtgtcaaaggcacaggtatttgaggctgtgcaaaggttcctcctgtgtctgcaggacacacgggcgagcgccccccacatgggggcttcggctccatctatctggttgcgatctggcacggacacaagacacatacccttcgtgagacatatgggcagtgccatcagtctggtcaaggtctttctgtgggattcagagcttatgagtaggtatgggcaccgtgtgctggaactttgggtcttctggggagagccc

SEQ ID NO: 705519 - DNA, 2607 bp, Homo sapiens
agaactcagcggcgtgggcgagccctggccctggtgggctcagcgggtcgctgctgccactgcggtccagcgtcccctccgtaagccccaagcctgtggggcctgggcctgccgggcggcccagcgctgctctggtccgcgggctcctggctcctcccgaatccctgtgagggcgcgcggggtccttctcagcgggagtcggggttttagagctgcggattccagggctggaaagcagaaggggttcttcctggctccctttttcttgggagatctgccttctggagactgcgccgtcctcccgggagagccagaaagaggacatggctgctgggcagcgggaagcgaggccccaggtgtcactgacgtttgaggatgtggctgtgctgtttacccgagatgagtggagaaagctggccccttctcagagaaacttgtaccgggatgtgatgctggagaactataggaacctggtctcactggggctcccatttaccaaaccaaaagtgatctccctgttgcagcaaggagaagatccctgggaggtggagaaagacggttctggcgtctcctctctaggatcgaagagcagtcataaaaccacaaagtcaacgcaaacacaagactcttcatttcagggactgatactgaaaagatccaacaggaatgtaccttgggatttgaaattagaaaagccttacatatatgaaggcagattagagaaaaagcaggataaaaagggaagttttcagatagtttcagccacccacaaaaaaatccccactatagaaagaagccataaaaatactgaattgagccaaaacttcagcccaaagtcagtgcttattaggcaacagatacttcccagagaaaaaacaccaccaaaatgtgaaatacaaggaaacagcctcaaacagaattcacaattacttaatcaaccaaaaattacagcagataaacgctataaatgtagtctgtgtgaaaaaaccttcattaacacttcatcccttcgtaaacatgagaaaaaccatagtggagagaaactatttaagtgtaaagaatgttcaaaagcctttagccaaagttcagctcttattcaacatcaaataacgcatactggagagaaaccctacatatgtaaagaatgtgggaaagcctttactctcagtacatccctttataaacatctaagaacccatactgtggagaaatcctacagatgtaaagaatgtggtaaatccttcagccgaaggtcaggcctttttatacatcaaaaaattcatgctgaagaaaacccttgtaagtataatccgggtaggaaggcatctagttgcagcacatccctttctggatgtcaaagaattcattctagaaagaagtcctacttatgtaatgaatgtggcaacacctttaagtctagctcatcccttcgttatcatcagagaattcacactggagagaagccttttaaatgtagtgaatgtgggagagccttcagccagagtgcctctcttattcaacatgaaagaattcacaccggagaaaagccctatagatgcaatgaatgtgggaaaggctttacttctatttcacgacttaatagacaccgaatcattcatactggagagaagttttataattgtaatgaatgtggtaaagccttaagctcccactcaacacttattattcacgagcgaattcatactggagaaaaaccatgtaaatgtaaagtatgtggaaaagccttcagacagagttcagctctcattcaacatcagagaatgcatactggagaaagaccctataaatgtaacgagtgtgggaaaacattcaggtgtaactcatcacttagtaatcaccagagaattcatactggagagaaaccatatcgatgtgaggaatgtgggatatcttttggccaaagttcagctcttattcagcatcgaaggattcatacaggagaaaaaccctttaaatgtaatacatgtggaaaaacttttagacaaagctcatcacgtattgcacatcagagaattcatactggagagaaaccctatgaatgtaatacatgtgggaaacttttcaaccataggtcatcccttactaatcattataaaattcatatcgaagaggacccctagaaagtagatttgtatgtgtgaaagccttaaaccaaagctcatcgaagaatacatccttgagagagatgtaataaatgtaatggatgtgaaaaaaactgtaataatttagccctcattaggtatttaattccatggataaacctcagctatataatagatatgaggaaagtgtttgtgcctgtcagacacttaaaaaaataacctgagatgaagaatttacaattgaagacattgactttagccatttgtgaaatgggtttgctttttcccttttcctacagacgtatatgctagatgtcacgtgatcatcagaaacagatatccgagtgggtggggaggtgtgctttagatttctcattagaagaccaccaaactggtaatatttttatagcattttaatagcttgatcaaattgtacctttttagagaaaaggaccaaaataaaagaaaaatgaattatgaacta

SEQ ID NO: 705520 - DNA, 640 bp, Homo sapiens
  misc_feature (62)..(62): n is a, c, g, or t
aataaagctcttgggcaaggggacgtctcagctgatgcccgtggaggtcccagccccccctncggttctcggaggtccggagcccctgatgcagtgcacagcctggctgaatgctatttccaccagcccgaggctatcgaagagttccccgtgccggctcttcaccatcccgttttccagcaagagtcgttcaccagacaggtgttatggaagctgctgaaggttgtgaaattcggagaagtgattttttccacgcaattagcagccctggcaggcaaccccaaaaccgcgcgagcagtgggaggagcaattaaaggcaatcctgtccccatcctcattccgtgccccagagtggtttgcaacaacggagccgtgggcaactactccggaggactggccgttaaagaatggcttttggcccattaaggcccccggttggggaaaccaggcttgggagggagctcaggtttggcaggggcctggctcaaaggagcgggagctacctcgggctccccccctgctggccgaaactgagtatgtgcagtaggatggatgttttagcgacccccccgtgtaaccctgcatcggatgcggggggtggaggcccccctgtattaaaggaagtggcagtgtcctggga

SEQ ID NO: 705521 - DNA, 2822 bp, Homo sapiens
ttcaagccggcgcgccgcggggtgagcggcgccgggcctgaggtcgcccagacgccgtcggggcggagcggggtcgcgaggctgcatcccggccggcggttccggagcctcgcggctggggaggcgcggcccgggacgctcgagcttagggagatctgccttctggagactgcgccgtcctcccgggagagccagaaagaggacatggctgctgggcagcgggaagcgaggccccaggtgtcactgacgtttgaggatgtggctgtgctgtttacccgagatgagtggagaaagctggccccttctcagagaaacttgtaccgggatgtgatgctggagaactataggaacctggtctcactggggctcccatttaccaaaccaaaagtgatctccctgttgcagcaaggagaagatccctgggaggtggagaaagacggttctggcgtctcctctctaggatcgaagagcagtcataaaaccacaaagtcaacgcaaacacaagactcttcatttcagggactgatactgaaaagatccaacaggaatgtaccttgggatttgaaattagaaaagccttacatatatgaaggcagattagagaaaaagcaggataaaaagggaagttttcagatagtttcagccacccacaaaaaaatccccactatagaaagaagccataaaaatactgaattgagccaaaacttcagcccaaagtcagtgcttattaggcaacagatacttcccagagaaaaaacaccaccaaaatgtgaaatacaaggaaacagcctcaaacagaattcacaattacttaatcaaccaaaaattacagcagataaacgctataaatgtagtctgtgtgaaaaaaccttcattaacacttcatcccttcgtaaacatgagaaaaaccatagtggagagaaactatttaagtgtaaagaatgttcaaaagcctttagccaaagttcagctcttattcaacatcaaataacgcatactggagagaaaccctacatatgtaaagaatgtgggaaagcctttactctcagtacatccctttataaacatctaagaacccatactgtggagaaatcctacagatgtaaagaatgtggtaaatccttcagccgaaggtcaggcctttttatacatcaaaaaattcatgctgaagaaaacccttgtaagtataatccgggtaggaaggcatctagttgcagcacatccctttctggatgtcaaagaattcattctagaaagaagtcctacttatgtaatgaatgtggcaacacctttaagtctagctcatcccttcgttatcatcagagaattcacactggagagaagccttttaaatgtagtgaatgtgggagagccttcagccagagtgcctctcttattcaacatgaaagaattcacaccggagaaaagccctatagatgcaatgaatgtgggaaaggctttacttctatttcacgacttaatagacaccgaatcattcatactggagagaagttttataattgtaatgaatgtggtaaagccttaagctcccactcaacacttattattcacgagcgaattcatactggagaaaaaccatgtaaatgtaaagtatgtggaaaagccttcagacagagttcagctctcattcaacatcagagaatgcatactggagaaagaccctataaatgtaacgagtgtgggaaaacattcaggtgtaactcatcacttagtaatcaccagagaattcatactggagagaaaccatatcgatgtgaggaatgtgggatatcttttggccaaagttcagctcttattcagcatcgaaggattcatacaggagaaaaaccctttaaatgtaatacatgtggaaaaacttttagacaaagctcatcacgtattgcacatcagagaattcatactggagagaaaccctatgaatgtaatacatgtgggaaacttttcaaccataggtcatcccttactaatcattataaaattcatatcgaagaggacccctagaaagtagatttgtatgtgtgaaagccttaaaccaaagctcatcgaagaatacatccttgagagagatgtaataaatgtaatggatgtgaaaaaaactgtaataatttagccctcattaggtatttaattccatggataaacctcagctatataatagatatgaggaaagtgtttgtgcctgtcagacacttaaaaaaataacctgagatgaagaatttacaattgaagacattgactttagccatttgtgaaatgggtttgctttttcccttttcctacagacgtatatgctagatgtcacgtgatcatcagaaacagatatccgagtgggtggggaggtgtgctttagatttctcattagaagaccaccaaactggtaatatttttatagcattttaatagcttgatcaaattgtacctttttagagaaaaggaccaaaataaaagaaaaatgaattatgaactacctctcagtctctggggttgtccttttcctaccctgatgtcaaacttatgcatggatttcattaaaaagaacagaaacacaacacgacgaaacagaaaaaccacgtgtgtgggcgcgcatgggcctcggaaaagagttttaaacccacatcgatggggggcgccgggccccaatggtagacggaaaccgggtgaaagaggaggtcacacagagaacaccgggcgaaaaaaaggcaggagaatccaccagaaaaaccgcgggggccccgggcctgcgagaacaccaagaggagtcaggaggcacgaggggcataaaaggcgccaaggggcagaca

SEQ ID NO: 705522 - DNA, 1090 bp, Homo sapiens
gagccgaacctggggttgctcaggaacgtgggccaggcaatgtggaagtcgttgacattgcctgggccacaagagtgggacatagtttttctcccctcagcccactcctggtagcacctgtcgccagcctggtacaaagccaggcctttttcttctgtgagcatctcatcactgtccagcagcaggtggaaaaagggggacaacaaccagacctattacttctcccccatttcctccaaatttcgctgtgccaaatgtttacaatcttataaactatgacatctattgaaatttccttaatcaagagcttcttcgtgtaaacgtcgctttctttagctatagacacaagacacaaccgtaactatctcttaatggcatccagccttgcctgagctcacctttctcctgacagaacgggctacgcgagtgaaatatctcatgtaaacatccaccaagtccctttaccctaactctgacagctgccattaaacccaactcactaacacagggacatgattgcaccctagtcctctgctgggccacgaaacttccagacgcattaccaaaaactacgctgcaagtactactcacttctcaccacgtgcgcgctagacgtcagttgcgctgctctcgtccctcgctcccatacattcccataatatgcacgtgcccccccgaacggaaacacaggctacactgggcaccgtacactccaccatcacgccagaagcacaccatagactccacacctcacagcacctgtacaatccctggtcaccagcacagcgggccaaccaccgtccacgcacaagcacgacatatgacgcacatacagacgtaaggcaaccgggacagacaggacaacggcggacaacaccagtaacacacacaaccggcgactaacacgtacaacggcagcccagcaacacaaccgccaacagacccgcaaagcacccaacaccacgccacgacggccgcaccaacaaaagccgcgaaacgcggcgacaccccccaacaaccaaacacgacacgccaacccacgtcatcaccccgcgcactcacacacagaactaaacaacaaccgcaacac

SEQ ID NO: 705523 - DNA, 621 bp, Homo sapiens
  misc_feature (398)..(398): n is a, c, g, or t
  misc_feature (414)..(414): n is a, c, g, or t
tgtggtggctcacgcctgtaatcccagcactttgagacgccgaggtgggcagatcacaaggtcaggagatcaagaccatcctggctaaagtggtgaaaccccatctccactaaaaatacaaaaaaattagctgggcgtggtggcgggcacctatagtcccagctactcgagaggctgaggcaggagaattgcttgaacccgggaggcagacgttgcagtgagccaagatcgcaccattgcactccagcctgggcgagacagtgagactccgtctcaaaaaaaaaaaatacatctaccaacacatgaatggagaaaacgcactgctatatctatacgacagaatattaactacaggtgcagacagcaacatggataagtcttaaaaacatgccgaacanaggaagcgagacacanggatacgaactgtctgattctatttatacaaaacacacggaaagactaatctgattcacagtgatagtgcgcagatagggaaggagaggatgcctgggaagggcgcgagggacctttctgggtcatggtgtcctgatattggatgcagtggtcacatgtgtgcatacatttgccaaactattcagtacacttgtaagggtgtttttt

SEQ ID NO: 705524 - DNA, 390 bp, Homo sapiens
  misc_feature (32)..(32): n is a, c, g, or t
  misc_feature (51)..(51): n is a, c, g, or t
  misc_feature (141)..(141): n is a, c, g, or t
  misc_feature (151)..(151): n is a, c, g, or t
gtaatatacgtgcacacatgatgtatattaancacatggaaagattaaagnctaagacttttttcactgtaggaactgtacctgttggatgtgttttgggtacagaacaaaatataaatgttataaaccttgacgtaaggnaataacaganaaaagggtagggaataaggagaaagcatatcatcttatctctagcaagggattaactgatattatctaaacaagtatatagtttcttaaaatgattatataaactttttaatgttcctgtatttaaaattcctttatatttttgtttatattttatagtagacagtgtcttttataaagaagcaatgcctttagttttttttaatgttggattaaaataatctttaagccttttatttc

SEQ ID NO: 705525 - DNA, 306 bp, Homo sapiens
tccactagtgtaggttaattattattattattttttaagaccaagtccactctgtcacccaaggagtgcagtagtagaatctcggctcactgcaacctccacctcccaggttcaagcgattctctggcctcagcctcctgagtagctgggatgacaggtgcatgccaccacgcctggctagtttttgtatttttggtagagacggggcttcaccgtgttggtcaggctggtttcgaactcctgacctcaggtgacccaccggccttggcctctcaaactgctgggattacaggcatgagccaccta

SEQ ID NO: 705526 - DNA, 199 bp, Homo sapiens
gaagagctaaggaagaggaacataatcctgaagatccggaaaaagtttaattatgaaaaacaaaaagcaacattagaagagtctgggtggccaggcacagtggctcacgcctgtaatcccaacactttgggaggtcaaagcaggtggatcgcttgaggtcaggagttggagaccagcctgaccaacacagcaaaaaccc

SEQ ID NO: 705527 - DNA, 869 bp, Homo sapiens
cagtagtgcttaaaaatactacataaagcattattttaaaggttatactggaaagtgcaattttaaaatgagcaaaacctctgtatttctgctggcattaagggttgatggtgttaccatgtatcatcatggcggtactatttttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgttgggcaagcctaggactgataagtagctctgatcagaggagctggtggcttttatacttcttcctgggtttcagtggggttgtaggttcgttgtatgaagtaataatggaaggttcgggtgggggacagtatggtccttgctacgggtgctatttcacagtagcagagtaagcaaaggtttaaatcgagtggcataagaaatcttggcatagctatttaattgcccaaggtcaaatttaagggccatttctaaggctttatccatttcggacgtatgagtcactagggccacagaagggtctgttatccgtagacaaagagccccagagacctcttaacagcacgcacgttatggattctagttggcctatacactgtttctggcaaaactggtcatggtccataaagcgtgttggaacaattagtgtcatagaacgggcgctctattccattggtgtgacttgaaaggtgaaccgggataggggtgttgacatacaggaagaagagaataaacgttagag

SEQ ID NO: 705528 - DNA, 1014 bp, Homo sapiens
gtgctgccccaacattgtaccggacactggattcctggacccccttcatgtctcaaaccgacgatgagcgtctggtctctgcttatgatggtgggtataccgagctcctttccctgatccacctctgctgcctgccccacattgtaccgtacaatgtggattcctggatcccccttacctccttatcctttctttaccttcaaggtcgacggcaggactcctgtactggtatccagcgaggacagccaggaaacctcagtgttcatcctctgcaggttatgcgcggagtcgacaaggagagccctctatgggtatgcgtgaacaaagggcatgtctcacttaccgtagcatgtttaactcccagagacatgggcgtgtctgctcgatcttcattcacagatcatctcctgagaagggagagcccctttggaggtcaggggatggtgacgtgactttccaatctgcccatcatcgcggctggatgggtagggaagaggggaggcgtaatgactatgtccttagccttcatgtttgtgggtaaggggcttttcagctagtcatggtataaggtaagcatgttagcgagcttagatgattggccacagagctaacattatagcatccttcatcttttctggaagcacacttgaaagttccggcaccgagtgataatctgtggagcaaggcatgtgccacagagttggcagggaggccatcgaagggttaaccacttcaagattctaccatcgtgccctggtggactcccaagagccttgaggataaggatcgaagatgccttgcccgagatccctcgttgtcatcctatcctttcaaggtgtggtcccattggccatataacctctgggacatctagacattcagaggtcctgggttgcctcagcccgtggagggcaggtgctctttagccctctttctggccttgtgaagcaagggcctacagaaaaaggcctccacgcttgcccaactgaaccttgggcaaaaaagggttgcccg

SEQ ID NO: 705529 - DNA, 804 bp, Homo sapiens
aataccacggcaggacgaggcctggttcaaatcaggccgagggcctccccgtcccatactcggcgagcctccctactactcggcactgtcctttctgcccagcccctctctgggtgccaggtacgacgcttgccccgggtccacctacaccatcgccacctacatacccactctcaatatagctagaccaatatacatcacgccaatcgaccgtaatacgacagaatgaaacaaagcgatacccacccggcatagaaacacgatgcacacacagacatgatgtcagatgatatgagggactacgtcatctcgtgtccactgctttctgcttgatggccatgagggaaggctgatgcaacacgcggccaccacagaccacgcattgatgatcatggagtgctgagatccagatgtggagcacctaatccatacagaactagctcaccctccaaaaaaccacctgcaccacaaccatccatcccaccacatccacacacagatcccatatgcacacacccatgtgcaaccaccgttaactactactcccactattcaatgcaatgttctctaccacagatctaccactccatcccacaccctcacacacaatctagacgcccctctccactcaatatcccatatacccaagagcaacccatcatttacaatctcatcttctctcaccattctcacaagcccgcactgcatacatcctcacgtccaaaaaccctactcgccatcaacaagctttcttatactcctcatccttccttcccttcccctcagttcccgtataacgttcct

SEQ ID NO: 705530 - DNA, 282 bp, Homo sapiens
acgccggtgcagctgggggggccctggaggccctggtgtccctgggatggggaaccgctggtggcttccgcggaggtctcggcagtggcattcggggccggggtcgcttgccgtggacggggccggggccgaggccgcgaagatcgcgtaggcaaggccgagggatcaggagtggattgcccgtcaccaaggttgttggccgtccttgctcgaacggacatgaatgatcaatgtccctggaggaagattctatctcttctccctgcccattaagggaatcag

SEQ ID NO: 705531 - DNA, 191 bp, Homo sapiens
tagcctggatattgaaccaggtcacctgtgactgtatcagtaatgctacaccccttatgatatgatcctgaatgaaaagagtaaacacaagtatatggtacagacaatttttgctccaccaaacacttccgatctggaagactgtgtggaacagaggcaaaccctgtatgcattactggctaccaaattga

SEQ ID NO: 705532 - DNA, 134 bp, Homo sapiens
agttttccaaccccctaacgttttcagatctttgagcccagagagacctcagattttaaaaatataaattttgagtaccttggaaaccatgaggcttctcatgggttccgccaaattagttaggacccatcctt

SEQ ID NO: 705533 - DNA, 1474 bp, Homo sapiens
  misc_feature (157)..(157): n is a, c, g, or t
  misc_feature (164)..(164): n is a, c, g, or t
  misc_feature (947)..(947): n is a, c, g, or t
tcgggggcagccgccctgttgttggggacgcaccaactgtgttgtgtcaccccagcaaggcacgcgcgggtcgtggtgtgtaaccccccgctttcgccgcggggtatttttctcccccgcgcgggagtatttcctgtctgcggagccaccccgcgcnggttccnccgcttttagagggagacattgtgaagagtggtttggagccgtttgtgaatgacctctgtggtggcgcctgtttctccgcgtcaggggtgtttcactctcgtccctcgaagagagaagggggcgcattctctctgtgtgggggcctcccttctggtcggccacgaggtggaggaaccgcagttctccgccaatgggggggagggcccccacccacacacctttctgttatggcccttgtggcccaaaccgccccgcgacagggggattttgtgaacccgcgccgcacgcccctcccccgattatagaagcggtttctctctcccccagaaaaagagtactcttgcaacccctcctctcggtgttgccccacaacaccagcaagtaggtttaataggtggtgattacaatagaggaggggatatcctttggttttttccccgcggcaactatttgggggagcacccccaccattgtttcctagatgaggcgcacacacgcgtatgccccaacaatttcccccctctgtaggcgcccctcctattatttttgtaaaaagaaaatcgtaaatggggatttgtaaaatttctcccccgcgataagagggcccacaagctcactcccacgctatatttcctgcgcacgctttcccctctatagataagggggcgcgccttgagagagaaagtctgtggacccgggggcctttttatcacgcgcggtggccactcttctttcttcgtggggccctcgcgctcggtagagccaccccacgcgcttgggcnccccacgcgctaatctctcggttggggagaccgcgagagaccccaatatattttctcgggggccctcgcccacgtttctttatcgcacggcctctttccctctgcgattgattttgagctcccacgagagattgacctttcaccacagagggaggccgcctctggccccacagctcgccacggagcccctttctctcttctcattatcccctgccaccacccactcacttggactgcacccaaggagcctgttcctataagggtcttgaaatccacgggagaaagctatttgcacgaggagctccacagaaaaatgattggccaccgccatatataaggagagaagaaagcttcacgtttaactcgtttccactgcttaacactgagtttataaccacgctcacgaggctggaacactaatttaatatctaatttgaggttcccttaaagagtcttggttttccactgaataccgcatgtataataaaaattttaagaaataaatgttattttactttatttaccca

SEQ ID NO: 705534 - DNA, 254 bp, Homo sapiens
ctaatcgctggttgatgggttctcgcaagcctcgtagcgtcgcttgaccccacagattaggctactgggatcacgctcggtgctagtacccaggtactcctgatcaaatatcacgctcctacatagaggactcaacatactagtcacagccctatactcgctctacatctttaccagaacagaatggggctcactcaccgaccagagtaaacaagctaaaagcctcattcagacgagaaaagaaccctcatgtt

SEQ ID NO: 705535 - DNA, 217 bp, Homo sapiens
cacagtgctgcaaggagaatgtagagctttccatgaatatcttagaaaagaagaaagacttaagatcaataatctgggccaggcacggtggctcacgcctgtaatcccagcacttggggaggccaaggagggtggatcacttgagatcaggagtttgagaccagctgggccaacatggcaaaactcttgtctgtactgaaaatacaaaaattatccc

SEQ ID NO: 705536 - DNA, 727 bp, Homo sapiens
ccgggcgcggtggcgcgtgcgtgtagtcccgagtagctaggattacaggcatgcgccaccatgccggctaattttgtattattagtagagacggggtttcttcatgttggtcgggctggtctcgaactcctgacctcaggtgatccgcccacctcggcctcccaaaatgctgggattgcaggagtgagctaccgcacctagaccctaatttcaattctcttgggcacatacccagaagtggaattgctggaccatatggaagtttgatttttaatgttttgaggagctgccagaactgttttccacagtcgctgtaacttttcgcattcccaccaacagtgtacaagaattctagttactctgcatcctcaccaacacttgatattttctgggttttcatgagagtagtcatcctactgagtgtgaggtggtaattcattgtagtttcaaattatatctccctgatgatttagtgaggttgaacatcttttcatgtgcttattagccatttgtatatcttctttggagaaatgtctattcaagtccttttccatctttcaatttagtggttgcttcttttcttggtaagtttagggattctataatattttgatataaatccttatagattgccattcaaatttctttctattccgaagtgggcttttattcatactctattttttgtgaacaaacttttcatttatcaaggagaagttttcctaag

SEQ ID NO: 705537 - DNA, 1006 bp, Homo sapiens
  misc_feature (25)..(25): n is a, c, g, or t
  misc_feature (71)..(71): n is a, c, g, or t
  misc_feature (91)..(91): n is a, c, g, or t
  misc_feature (146)..(146): n is a, c, g, or t
  misc_feature (173)..(173): n is a, c, g, or t
  misc_feature (180)..(180): n is a, c, g, or t
  misc_feature (198)..(198): n is a, c, g, or t
  misc_feature (203)..(203): n is a, c, g, or t
  misc_feature (210)..(210): n is a, c, g, or t
  misc_feature (236)..(236): n is a, c, g, or t
  misc_feature (242)..(242): n is a, c, g, or t
  misc_feature (250)..(250): n is a, c, g, or t
  misc_feature (264)..(264): n is a, c, g, or t
  misc_feature (266)..(266): n is a, c, g, or t
  misc_feature (268)..(268): n is a, c, g, or t
  misc_feature (270)..(270): n is a, c, g, or t
  misc_feature (274)..(274): n is a, c, g, or t
  misc_feature (279)..(279): n is a, c, g, or t
  misc_feature (282)..(282): n is a, c, g, or t
  misc_feature (287)..(287): n is a, c, g, or t
  misc_feature (309)..(309): n is a, c, g, or t
  misc_feature (317)..(317): n is a, c, g, or t
  misc_feature (326)..(326): n is a, c, g, or t
  misc_feature (329)..(329): n is a, c, g, or t
  misc_feature (338)..(339): n is a, c, g, or t
  misc_feature (345)..(345): n is a, c, g, or t
  misc_feature (354)..(354): n is a, c, g, or t
  misc_feature (375)..(375): n is a, c, g, or t
  misc_feature (392)..(394): n is a, c, g, or t
  misc_feature (407)..(407): n is a, c, g, or t
  misc_feature (413)..(413): n is a, c, g, or t
  misc_feature (432)..(432): n is a, c, g, or t
  misc_feature (438)..(438): n is a, c, g, or t
  misc_feature (440)..(440): n is a, c, g, or t
  misc_feature (448)..(448): n is a, c, g, or t
  misc_feature (479)..(479): n is a, c, g, or t
  misc_feature (501)..(501): n is a, c, g, or t
  misc_feature (571)..(571): n is a, c, g, or t
  misc_feature (604)..(604): n is a, c, g, or t
  misc_feature (653)..(653): n is a, c, g, or t
  misc_feature (665)..(665): n is a, c, g, or t
  misc_feature (756)..(756): n is a, c, g, or t
  misc_feature (824)..(824): n is a, c, g, or t
  misc_feature (980)..(980): n is a, c, g, or t
actcccatcctggtatatgcaaganaaatgttttaagaaagggccagcatttcttactaaaatgctttgcnagtgtatttggcagatttgnttttatattctcctattccacataccactcaaagcactcgatgatcaaacatctngacccaaatcaagagaaaagtataaanagatatnaatttaaaaaaaggaagnaatanaacaaanaaaaaaaaaaagaaactaaaaaaagnatcatnaaaaaagntcaaataccagcantnananctcnctgcnggnattcncggctcagcaattaagcccaanacgggatnaggccctcnggnaggcggccnnggcgtnggggttgcnctagggggtggcgggggactnagtactccgctccactnnnatgatagtttganaagggnttcatactcctttaagtanatagtncntccaccanttttttttttttttaattaacactgattctnattccccaagcctgtgcatttntaaagctcaaggggcttcataaagtatactaaacagtaacattttcaccttttattaaggcaagtttgtnaaaataatttaatacaacaagatctcttcatgnactttcaacttacaacctttttaatgtaagaaacatacaaaaaattgtnttttataaaatntcgcctcaataccagaaaatagtaatgaaagattttgaacccagttttactctttaaagaatgctctttcgtgtctcaaattccaagtgcnactcatcatccttagagccagttttgcttaaatgcttcacaacatcaacccagttccagcctcgaggnagttctcctttgtgatctgttttgtctgccagcttacgcttctgggcttttgaaagttgttcttttttgtcttttttcttacttgatgggggctgtattaggagtttcaattgagatgatattgcttagcgatgttgcgggattgatgggattgtnattctccatgaactgctctttattgt

SEQ ID NO: 705538 - DNA, 546 bp, Homo sapiens
acgaagggcgactccatacgggcatggcggctccacagcgggcctggaaacacccttctcctcaggccagagtagctcatcatggggtctgggcctgcttcaggttctgccaggaggacctggaacttgtctgctgagagggacatgggaagaggctgggctggggtccctggggcagctggcaccgtccatgccgcaggtgcaccatgggctcttcgcacggattgcagcaggctggagctcagggtgtagtccacccggcagaccagacctgccaagctattcactgtgagatggggtgggtggctctcaggatcaaagcaggcaagccaagtagatctcagtcgataccctggtgtcagctctcaaccattcaaggctacgtggcctctaagaagctcccatcctgctgacccaggctcagaacagggcaggtgcccgataatcagttctgatcacccacagcagacctcagtgacaagaaaccttggggggagtcaggagacccagggccaggtcccagctctacggctgctagtaaccatg

SEQ ID NO: 705539 - DNA, 320 bp, Homo sapiens
  misc_feature (141)..(141): n is a, c, g, or t
  misc_feature (170)..(170): n is a, c, g, or t
actttgagactcccgtttggatggcacaggcagactaagcccaggtcaaagccctccccttggatgttcattttatcccaagctctttctggaccctggaatttggcatcccctaggccctgggtgggacagctgagccangttttagataacatgtctagaaaagtggncccctactgtgtgcctggcactttccgcacatgatcctctagctagaatatccaagggtcatggagagaaatacccagttaaaatatcagaaatgaaaaagtgataccattagagacactaaaaagacgattagagatactaaaaaaaaa

SEQ ID NO: 705540 - DNA, 104 bp, Homo sapiens
agtgatacattgtgtcatatacttaacatttatcttgccactagaaggtacacttctgaggaccagggtcatccattggccccagcacattgcctaatattaag

SEQ ID NO: 705541 - DNA, 112 bp, Homo sapiens
cacgagggctgtgcctagggagaatcctccgatgggggatcagtagcccaacgctcttgaggctcaggacgcacgcccacttatgtacaatagtactgactgcaacctaaag

SEQ ID NO: 705542 - DNA, 200 bp, Homo sapiens
  misc_feature (46)..(46): n is a, c, g, or t
aagactgcaagaccaacgccttctcttcctccccatctttctccgngctctgcctactcaatgtgaagacaatgagaatgaagacttttatgttgacccacttccatttaatgaatagtaaatatattttctctttcttatgattttctaaataacattttctctagcttactttatggaaggaatatggtgtataatac

SEQ ID NO: 705543 - DNA, 194 bp, Homo sapiens
aagcaaagatgctactttctttctttctatttaaatgtcatttatttctctcttgcttggttgctctggcccagactttcaaaactatgttgaataggagtggtgagagagaacatccttgtcttgtgcccgttttcaaggggaatgcttccagcttttgccccttcagtatgacattggttgccctttcgcct

SEQ ID NO: 705544 - DNA, 208 bp, Homo sapiens
  misc_feature (5)..(5): n is a, c, g, or t
gcagnggtgctgagatcacaggggtgagccaccacgcccggcaagattgtttctttcttttctttttgagatggagttttgctcttgttgcccaggctggagtgcactggtgcagtctcggctcactgcaacctctgcctcctgggttcaagcagttcttctggctcagcctcctgagtagctgggattagagacacacaccatcatc

SEQ ID NO: 705545 - DNA, 1541 bp, Homo sapiens
gtcctggtgaaggaagtgcattctcaggcctgtggctgtagcaagctgtctgcccttgggtgcaatgaaccagactgtggagccaaaggtgaccgcagtgggccccaggtctggagccacaaggataccctcactttgcgatgaggagctgaaactgaccagttgtccagatgttagccgcccacgatggggctgctcttgatatctatctaagaatgataccacgcagattacgcccgcttattccatcaggggcatacgagatggagtatctagaaaccagaatacccacagaggagtggtctaaaagcacagaataagtcaacaaaaaccttaattacaattacattgggtattagccgcgtagtgcaataacgattaccgtggtggatacaaggttgtcatgaaattagtgcaaccgttagaggcagatttgaccacggaagtaacataaatgaagtaacaaattgtaacggaaaattacatggttaagaaacaagcaacacaaaacaagaggcagagaagcaggcgacgaaagaagaaataccacaacacaaggtggccaccgacaagagacaaacgcggaatcccccacgagacatgtgtcagtgtgcagacacacagaggtgggactcacacagaaaaaggagaaacaaacggacatacaatagaaccacaggggacagacgatgcaacgcacacaccgactacacagaccaaaacgggtccgaccaggacagtgggacgaaaatacgcgtggacacaaaccgactaggcaggaaaacacacatggacgagacggcagaacacccgctaaaaaagaccaggacaggcagagcacaacaaatacgacggggggacaaccacagaggggcgaaacagggaagaacgtcaaacgcgcacgcaaacaagcgagcaaacaaaatcgaacccacgcaaaaaacacggcccacacagagggtgttacaacaacaaacaacgagcaagacaagcgccacggcaggcgaaagaaaaagagaggcgcacgacaacacggggacgagacagacaacgaacggaccgaacacaacaaccaacaaagcagaaccccaaacaggaagcaccaacaaagcacagagacaacacaacccaacaacacaccagcgggagcaagacagaagcaaagcgaaccaggcgacacagaccgctagaaagcccacaacacacaagaagacagagaacagaaagaagagagcggaggaagcgaggcacaaaggcgaagcggcagaaaagaaaacgcgaacaacagacagaccagaagagggcgacacgcagaacaacaagaagacagagaacgaaaacagcgagaaaaaaggagagcagaagaacgagagaggagaacgaaaacaaaaaagaggagcaaagaagcagagaacagaacgagaaagaagaccggacaaccacgaccagacgaagacaaaagcaagcgaagcacgaaaagaagagacacacgaaagagaagacgaagcgaaagacagagagagaatcaaggaacaaaagat

SEQ ID NO: 705546 - DNA, 85 bp, Homo sapiens
ctggagagcagcagccatggccctacggtaccctattgccgtggctcaacaaggccacaaagtacccacgacgtgagcaagccca

SEQ ID NO: 705547 - DNA, 143 bp, Homo sapiens
tgattctagaggatcccgcctagtttagaagtacatagccctagtttgagaagtttcaatagcattgtctgtggttcctatgtcagtaggggcttgcatttttcacattacaggagggaaatgctaagctgggtaccggagct

SEQ ID NO: 705548 - DNA, 130 bp, Homo sapiens
agtgtgagtccgtggggaagttttcctcaagtggggttcagtctgtaattttcctgtctgtttttagtttgttttgagttattttggattttgttctttagccaaataaaggcaatgtggtttttcctga

SEQ ID NO: 705549 - DNA, 582 bp, Homo sapiens
aggaaaactgattttctctctgctttttactgcttcccatattctggtggaagttaccaaaacaattcaaaatgtgttcaggatatatgtaaacttacctcggggctaataaaaaataaaaggacataattttgaggaggttctgctatatttagcagagattggattattttgaactaagattgtaatgataatccagcaaatctcccttttttgatgaaaccatgtcaagtcattctgttggatatcattggagactgttatctaagatatttaatgaaaaaaatggaaatcaatagcttggaggttagggcaaactgagctaaataataaagatttcatttggaatcctgtttgtcattaaatatcaaaaaaatttgaaagacttaggaatgtcccaggaacatagtaggtgctcaacaaatacattaaatgtgtgtgtgtgtgtgtgtgtgtgtataacactaagggtgtgcctactagtcttctatgggcaggaagaaggctttgtacatggcctgtggcttcttcagggttttcccctgagaaataatgcaattcgtgcttatgtctagtgggtaa

SEQ ID NO: 705550 - DNA, 117 bp, Homo sapiens
aagaacggaccaccttcgcatcgacaagccttccttcgcgatcgatcgctacttgcaaaatgagcgaaccgtagattttgcccttagcttcgctcgaatagttgagcgttccgatct

SEQ ID NO: 705551 - DNA, 122 bp, Homo sapiens
agaatatcataagcatgttaatgatattcatcttcaagtaatcaaatcatcattgcatattgaatgaaaagaaaaatgtagaactgacttcttaatcaagggctgtcctccctcagcatctg

SEQ ID NO: 705552 - DNA, 308 bp, Homo sapiens
cccatttcagcctcctgagtagctgggactacaggcccaggcccccaaacctgggtaatgtttaaattttatgtaaaaatggcggggggggcgggggtctccctatgttgcccaggctggtttcgagctcctgacctcaagtgatcctcctgccccagcattccaaagggctgggattacaggggtgagcccctgcctggcctggccgtaggtttggaactgttttataaaaaagccctggagaagacagtagaatgagcctatttagtttaaaaaataaaaaagcccgttggtttcccccccgccca

SEQ ID NO: 705553 - DNA, 877 bp, Homo sapiens
gcattaactgaaagaaaagttttcatgatgcttttttttttcccccgcagacaaggtctccctctgtcatccaggctggagtgcagtaacattgtcacagctcactgcaatctggacctcctgggctcaagtgatcatcttacctcagcctcccaagtagctgggactacaggcgtgcaccagcatactgggctaatttttcatttttggtagaggcaggggctcactatgtggcccaggctgtcttgaactccgtggccttaagcagtcctccgttgtctcaacctcccaaatggctggaattacaggtgtgagccaccacacccagccgtatgatgcatcttaaagaaagcatgcttctacttacctttaaggaagttttaatttcaccaagtatagtgtcatagagcagtataacagccattttcatgcctgaaaatggcaaaatttggatatctgagtgaggagtactgtatctagtcctcgattctacaaaaatatggagtactatctataaacagtaataattgatgcatgtgtagtcctggttctcaaatgcgtaataagatgttctttcacgtagtgctatacttacattcatagtatcttacagcgtattgtggtagtcactgtgtacttaatttttcacaaacattaataggttttgccacggtttgggggctgaacccctatccagtccttggaggctgggtggcgaatgtgggcctgatttggattgtgctggcacttgggaactccttgtctcagacccaattccggtggggggcctggccccaggaggggggggaaatggcccaagggtggggacaatccacgggaaagggccaaaaaaaaatggcgccgaatgggagaaatg

SEQ ID NO: 705554 - DNA, 256 bp, Homo sapiens
aagctttgctcagaggagcagattgtcagacagtcgtctatgctgcactgcgggctcgcagtcagcattcgtgttggttatattgtgtccgattcgtgttggtacgatcatggtgttgctgtcgcttgatgcatgactcaatcagttgacgcgcaaagtgagtaggtcaggtcttatgggcctagtatctttatatatcaggacacattggtatcgacggctgctcatcgtcaagcttgtcgctgtaccgagttgg

SEQ ID NO: 705555 - DNA, 785 bp, Homo sapiens
ggggtaccgggattgaggaccaggtcggggccgggttaccgggtcggggagcggctttccgtggcggcagctatgaggcgggacgtgcgcatcctgttactgtggcgaggcccaggtggggaagacgtcgctgatcctgtccctgtgtgggcgaggagtaccccgaggaggtccctccccgcgcggaggagatcacgatccccggcggacgtacaccccggagaaggtgtttagcgcacatcgtggactactcagaagccgagcagacggacgaggagctgagaggaggagatccaaaaggcaaacgtggtgtgtgtgggtgtatgacgtctctgagagaggccaaacattgagaaggattcggaaggtaaggtgggatcgaaaagtggatgaagtggggggaacacaagacagtggacaagaggatggccgatagatacctagatggggagaaaaaagatgaagagcatagctggatcagaggagtagatgcaatgggagggggcaggaggagtacggcacaagataagtgaagacgcgagagaacagccgggacgcgacatcgcggcagacgaccatgaggcgatagaagaggtggtaatagagggacaacaggagaaacaccgcaggaaaggaacacgagatcatcgaggaaaggccgggaaaagcaaccaaacacgacacacaaagacgaggacaaggagaacatgcagaataaaccaggaagggacacaacacagacgaagagggcacgcacagaaggaaccagagacaggagaagcgaa

SEQ ID NO: 705556 - DNA, 734 bp, Homo sapiens
gagcatgttccggctcctgagctggagcctgggccgaggcttcctgcgggccgcggggcggtggtgccggggctgctccgcgcgcctgctcccgggggctggcaggcaggtccggtggcccgaggtgccggtgccgccatcccggagtcgcgccgcacggccggggccccaggcctgctgccgctgctggcaagcgcttcgacctggttctcgaggcccgctgcggcagaggaggaggagcagcaggtagccgaagggggctcgctgcccgaggcagggggcgggacgaagggcctaggcagagatcatccgagctgctgaaagcggagccaaggtggagccattatgaaaggatgagccagaagagggttgagtaaatttaggcatgacggcttcttcggtcgtcggcctatcagaattgattaaacaagaagggcaattcattttaacagattattgatttgtgagtgggcccaattttaacgcaattaatacgggggggtcgaggtttggagatattgcttgaaacaaacattttttaaaggcacacaatgaggttacgcttccttggaagggggggtcatgaccgcagggaggacaaatgacattaattgtgaaattttcccctaaagggtggcagtatctatgctgggcagaaacagaccaggaatttgctagtgctgggtaatgaattctggatttacaagttctagaggacacaattgaagagaaaa

SEQ ID NO: 705557 - DNA, 153 bp, Homo sapiens
ctcttctactcaatacaaaaaattagccgggcgcggtggcaggcacctgtagtcccagcctacttatggaggctgaggcaggagaatggcatgaacccgaacaggcagacgcttcagctgagccgagcatcgtgccacgtgcatctccggccc

SEQ ID NO: 705558 - DNA, 230 bp, Homo sapiens
  misc_feature (2)..(2): n is a, c, g, or t
gnatatgctgtctcaagcaatgtcagacaacacagaaatgagtgtgaggggctaggaaatattctaggcaatatatcagaagccttcgggtgggggtcagctttagaaaaacggaggtcaggaattcgagatcgagcctgatcaagatggagaagcgcccatctctactaaaaatacaaaattagccggccatggtggtgcgtgcctctaatcataactactcaggaggc

SEQ ID NO: 705559 - DNA, 297 bp, Homo sapiens
ccccataatacgcaggcatatagaccaatggaacagaatagaaaacccaggaataaagccttacacttaaaaccacctgatattgtaaggctgacaaaaacaagcaatgggggaaggactccctattcaataaatggtgttggggtaactggctagcaatatgcagaataatgatactcgaaccataactttcatcatataccaaaattaactggagatagattaaagatttaaatgtaagaactcaagtgataataatcctagaagaaaaactcagaaatacccttcttgacattg

SEQ ID NO: 705560 - DNA, 948 bp, Homo sapiens
ttttgggggggaaaaaagattttggctctttgtggcccaggttggattgcaatgacgtgatctccgctcatggaaacctccacctcgggggtttaagcgattcttcgtgcctcagccgtggccaaccagtggcaaaacccttactaaagatacaaaaaaaaaaaaaaaattaccccggggggtggggggggggggctgggttacccccgaggtctcacgtgggaagggcgggaggcgaggaaatttcttgtggaaccccgagaagggcgaagggtggcggtgggaacccgaaaacatcctgtgccgtgtggttcgcctctataccgggggggtgcacaggagagcctaagaatccgcgtttcttacaaaaacaaaccacaaaaacaacaacagaagagagcctgactgtcgagaccagcgggaggaacagcggcgggtcccccgcggtgtgtgtgctacaacgagcgcgcggcgtgttgagaacctgcgcgggggccgacggggtgttttctcccccacgtgtgggccccccaaaagtgggggggggcaacgacggcgggggggaaccacggccgtcgctggggggcacgaaaagacaccacaggttttctctgaaaaacacagttgtgttggtgtctctttgttgtggtgcttccctcttgcgagcgcagggggggccgggcttcgagagaatactccttcgcgtgttggccccctctgttgttgggcgccccgagttttgtttgttttttcaattcccgcgtttttccccccccgatgtgtttgttttctccggtgttgttcccccgagtttccccaggcgtcttggtagaacagagggtgggtgctcgggaacgactagtgttttttccgcctacacgtcttgggggcgcggtgcagggagcggcgggagcccaccctctaatactgtcgggaaatttgtgcggc

SEQ ID NO: 705561 - DNA, 258 bp, Homo sapiens
cctcgtgaagactttagccagctctgtaaaccttacccctggcgacctcctggccaggcactcccggagggtcgatcctctgaagcttgagatcatctcaccgacgagactacgagtttgcactagacatgacgagggatgaatacaacgccctgcccgcctggaggcaggtgaacctcgaagaagccaaggcttgtactgagtgggaggacgccggaggagtctcacggttaacgtccaacaacaccctgaacaggg

SEQ ID NO: 705562 - DNA, 153 bp, Homo sapiens
caaaaatagctcggtaccgtcagcaccggaggctcacccacaccttcagcacgcccggccctgtgcccgcggcttgcggggggtgtgccactgtgtatgctcagttgacagggggcaacttcagtatttccttccttttcaaaatctctccaa

SEQ ID NO: 705563 - DNA, 407 bp, Homo sapiens
  misc_feature (316)..(316): n is a, c, g, or t
aacgaggcagccagccaagccacccaagacagccagccagccagccaagccagccaaatagccaagccagccaagcaagccaccagccaagccagccaagcctgccagccagcagagccagccaaccagccaagccagccagccagccaagccagccaagccagccagccagccactcaagccatctaagcaaaccagccagccaagccagccaagccaccgaaacattgtagccctggaacacattcagccagccaagccagccaagccagtcaaaccagcctgccagccaaaccagccaagccatccagccagncaagccagtcaagccacccagccagccaagccagccaagccacccagccagccaagctggccaagccactcaaccagccaagccagccagc

SEQ ID NO: 705564 - DNA, 638 bp, Homo sapiens
tgagctgtgctgtctgtgctgggctgtgctgtactgtgctgtatgtgctgtctgacgtgtgctgtgtgtccagtgctgtgatgtgctgtatgtactgtgctgtctgtgatgtgctgtgctgtgctgtctgtgatgtgctgtgctgtgctgtatgtgatgtgctgtgctgtctgtgctgtgctgtgctgtgcgatctgtgatgtgctgtctgtgttgtgctgtgctgtgctgtgctgtctgttctgtgctgtctgtgctgtgctgtatgtgctgtgctgtgctgtatgtgctgtgctgtgctatctgtgctgtgctaagctgtgctgtgctgtgctgtctgtgctgtgatatgctgtgctgagctgtgctgtgctgtctgtgctgtcttgctgtgctgtgctctgtgctgtgctgtgatgtgtgtgctgtctgtgctgtgctttgctgtgctttctgtgctgtgtgtgtgtgtgtgtgtgtgtgtgtgtacatgcatgcttatatgcatatgtgttaatgagtcatataagtgattgtagttgtgaatgttctaggcagaattcaagcagctgcaaaggccttgaggtcacaacaccctgtttcatttatagatccgaggtccacctttcagtagaccc

SEQ ID NO: 705565 - DNA, 385 bp, Homo sapiens
  misc_feature (1)..(1): n is a, c, g, or t
  misc_feature (10)..(10): n is a, c, g, or t
  misc_feature (12)..(12): n is a, c, g, or t
  misc_feature (35)..(35): n is a, c, g, or t
  misc_feature (57)..(57): n is a, c, g, or t
  misc_feature (74)..(74): n is a, c, g, or t
  misc_feature (86)..(86): n is a, c, g, or t
  misc_feature (102)..(102): n is a, c, g, or t
  misc_feature (113)..(113): n is a, c, g, or t
  misc_feature (121)..(121): n is a, c, g, or t
  misc_feature (128)..(128): n is a, c, g, or t
  misc_feature (143)..(143): n is a, c, g, or t
  misc_feature (166)..(166): n is a, c, g, or t
  misc_feature (182)..(182): n is a, c, g, or t
  misc_feature (201)..(201): n is a, c, g, or t
  misc_feature (205)..(205): n is a, c, g, or t
  misc_feature (210)..(210): n is a, c, g, or t
  misc_feature (214)..(214): n is a, c, g, or t
  misc_feature (222)..(224): n is a, c, g, or t
  misc_feature (237)..(237): n is a, c, g, or t
  misc_feature (249)..(249): n is a, c, g, or t
  misc_feature (251)..(251): n is a, c, g, or t
  misc_feature (255)..(256): n is a, c, g, or t
  misc_feature (260)..(260): n is a, c, g, or t
  misc_feature (264)..(264): n is a, c, g, or t
  misc_feature (277)..(277): n is a, c, g, or t
  misc_feature (291)..(291): n is a, c, g, or t
  misc_feature (294)..(295): n is a, c, g, or t
  misc_feature (298)..(299): n is a, c, g, or t
  misc_feature (304)..(304): n is a, c, g, or t
  misc_feature (358)..(358): n is a, c, g, or t
ngggaatttntnatttttttaaaaaaaaaattctncttaagtccaaaaatgttgtcnaaaaaaaaaaaaaaaanaaaatgtttaangtaaataagcacgaanagtttccacancctttcanactattnaaaatttcttcttgnggtttctttctttcccccccttnggataaattttctttntttgcttcccattgggggntatnagggntctncacagggnnnccctgtgtttccnaaaattctgaananaaannatgngggngagcaagcaaacnaggggggggaccanggnnggnnacctnaccccgacccaagaaaataatttcatctccataaaccactgtggaaaatttgtntccaaagaaaaaagaagtcctgttttt

SEQ ID NO: 705566 - DNA, 336 bp, Homo sapiens
tggcccgagcctccagggaatccctttccttttttccgtttaaaaaaaggaaagttttccttcctatttatttgcaaaaaggaaatttaaacctccttttttatccataaatgggatgggccaggacaaaaaatgcctcagcccccaaacctaaaaggacctttagtttccttcctggggggaattttcccccctccatccctcccaaattgcctgtattgaaaaaggactccctcattctgtaatagggggttaaacctggacccccttggtgggggggcctgtggtgaaggtttgcatccttccccctttgtcccaaaaaagtatgggggttta

SEQ ID NO: 705567 - DNA, 302 bp, Homo sapiens
cttgaaaaattgggcttttcataaaacccatcacatgtcattggctgctttttagaaaaacccttccaaggcagtacatttgtattgctactgaaaagggccttttcccagaacacagatttttttttgctttttgacattttgaaaacatctgttttttttttttaaaacaaaactttgggctcaagacaatttttacatgaaactttcataaaccatgaaaatgtagctggccttggggccttaggcatgaaataagcatgaggaacattttcccctaatttttcccccctttaaagcca

SEQ ID NO: 705568 - DNA, 619 bp, Homo sapiens
aatgccccatctgagtactatcgtatggcccaccataaggaccagcatacttgagacagtataccgcataaggcaacttgagctagtaaacacagactgccagactaccttcctcaccaaagcccataagggtctgacttatcccatactctgtgagccaatatgagcgaagctttgtacgttgaatcaattgtcacgacaatcgtaggcctaccggccgcaatactgatcattctgtccacccgtatattggtccccacctcgaaatattgtcattagcaaccgactaatgaccacccaggaacgagtaatcaaactgacctcagaccatatgagagccatgcacaacactaatggacgaccctggcctataatacgtagaatccgtaagcatttgaattaccacatttaacgaacggggactcacgcctcaatgacttacaccatgcaaccaactgtttattaacctaaccgtggctctgccattatgagcgggcgcactcggaattggcttacagtgtacgattcctaggtattaatggaaccataaggctacttattcaaccaataaccctggcagtacggctcgggttacatttccggatggccatcttgggct

SEQ ID NO: 705569 - DNA, 333 bp, Homo sapiens
  misc_feature (12)..(12): n is a, c, g, or t
  misc_feature (89)..(89): n is a, c, g, or t
  misc_feature (235)..(235): n is a, c, g, or t
  misc_feature (278)..(278): n is a, c, g, or t
  misc_feature (322)..(322): n is a, c, g, or t
ctggtacatgantttataaaaacatgtcacgcccggctctgtggctcatgcctgtaatcccagcactttggaaggccgaggcgggcggntcacaaggtcaggagatcgagaccatcctggctaaaacggtgaaacccgtctctactaaaaatacaaaaaattagccgggcgtggtggtgggcgcctgtagtcccagctactctggaagctgaggcaggagaatggcatgaacccngaaggcggagttttcagtgagcagagatcatgccactgcactncagcctgggtgacagagcagagcggggactccggagcaatgggnagtacaatcct

SEQ ID NO: 705570 - DNA, 252 bp, Homo sapiens
atttttttttttaggggggggccctttttggttggttaccgcttttttcagccttattccaaaaacctgcctttttagggggggtttgggcatttttactttaaatggggctccttatgggaggggccgactttttttggagttttccagagggggggtttttgacccttttttcaaaattcggtccgccccccaaaaatgggggttttggggttgtttaaattaaaattaacttttttaatttcccccgga

SEQ ID NO: 705571 - DNA, 819 bp, Homo sapiens
taacgatggcggcgctgagggcttatgtgcggcttccggggtcgtcgcggtccaggtgctgcggcctggggctggagtccgattgccgattcagcccagcagtaggtgttcggtccagtggccagccagtatgtgggaatgggcacagcagttagggggagctagttatgtacccagagctaaagaaacagtccactgtgaagcctccgaccttggaatgtatgtggaccgctccgaagaggacacaattgtgaagaacattacccgtgaactttgggccccaacgacctcagctagagcatggtgtcctgcggactagtggatgggaatggagttgcggcaagaatgctgcgaacagtgtggatcctcactatcaggagtgctccgtgccacctgagcggcactgcagcaacctcattctgaatacaagaacctaatcttcaggccgcttacagtactttagaccggctaggactatgtgtccatgatgtgtcacgaactaggcgcatatactcatagcatgtggagaaagcttgctaaaccatccggactccgtcctcggcgcacagttggatcccagagtgctgtactggacgacacttcacacggttggtcgaacccacattcagtggcctgtgacccacacaactgccctggaccacttggggccccatgacacccgtttcacttctgggctgctagtgaccgaaacgggaagaccgatggtccgaaggttctacgagccagaaatgtctggagcccagcacatgcatgccgcgctatatccggccaggagggaatgcaccagggactaaccct

SEQ ID NO: 705572 - DNA, 744 bp, Homo sapiens
gggactcggattcgacggaattgactccagcatctccagaggtgaaaggctattgggcaagttaggatgcatcatacttctaagaccaccctatagaacttcaacactattcctaagataacttaatatggcttgcataatcagggctgcacaaggctgcctaagctattaatgagatcgcgccagatgtccgtgggtcccagaattcaacaagttcgtccaagctccatgctggcaatggactccatacatggatacggcagagttactatcactggctctgctgccagtataagtctaggaccagtatctaatcaatgccaggctttcctctgagaatgggcatgggagtgcgagcatagaacaggagtaggtccctcaataacccgctttctgctgttcgttccatgatccagacatgtgtaagtttctggtctagtgattccaggttttaatagtaactctgtaagtgttcagttatctacacacacatttctcatccgtctaaggaagttgaagaatcacattctcggtatcagctgtaaatgctgggatccatattcagtctaatcagcgtttcccctgttgtctacgcaaagataacgggtatcagggctcatgaattgaatttactgttgtcgatacgaacctgtactgagtggcatgttaatcacatctcaagaaaagtacattgtaagtgtcacgaattcatgaacttcaactcaaacagggacttgggtctca

SEQ ID NO: 705573 - DNA, 956 bp, Homo sapiens
gcggagcaagatggcggacatctccctggacgaactcggtcagtgaagcgcggggcggcgagcgaaaggacggcttaatgccagacacgggagttggaggtgtccagatctcgagttgggatccagacaaggccttctcaggccagtcaacacgcacagccaccttccagcagagatttgatgcccggcgagaagattggactctcagatgcccgggtcaaactgggagtcaaggatgcccgggcgaagcttttgcagaaagatgcccgatttcgaatcaaagggaaagtgcaggatgccagagagatgtagaacatctcgcaagacaagagagaccacggtgcccccagaagacccagccagggtagctgatgcccgggagaaagatcagctctgaagaggagtgccaccatgcatgccttcataaacccacacatagggacaggagacacccatgatctgaaagctcacacaaaaccatccagaacttgaatatgaacctggatgaagatgactgatggtatagcatatcacgtatcctactacaacagatgaaagtatagcagactcaggcggcttactccagcaacatggctggggctaagaaagataccaaggcataacacaatgatgcaaaaggcacacaaccccatagtcaagcaaaaggtggatacagcaaggaatgcattacgaaacgaatccatgaatcataccacatgtccgtcctaaaggccgacacagaaaaggccataggaacccagacacatggaaccaccggggaaaacatgcgtagaaacaacgggaaaaagacacaccacaaaaagggaagcatgacaagcataggacgaaagccagcgagagacgtcaagagccaaaaggagaagggaaccaaagaatgaagtgaagaaatacaacagagggacacaacagagcaacaagagacagacggaccagag

SEQ ID NO: 705574 - DNA, 122 bp, Homo sapiens
tctagcacactcttagatgtatgtgaataaaaaaaacacaaaaaatcttttaaatttggttcatttatctttttatgtatccccaaatgccatctatcaaattaatatttattattcatgca

SEQ ID NO: 705575 - DNA, 865 bp, Homo sapiens
cagcatttaacaaagcttagagaaacctccaggagactgctaccatggccgagaagcccacaagatctgagtgaaatgagcaaaagtcacctgcccaataaagcttgacaagacactcaaaaaaaaaaaaaaaaaaaaaaaaaaaaaaaaaaaaaaaaaaaaaaaatacgaagaaaacattacgaaaaaaatgagactaaataaaccaataatgacttataaaaagaatttgacgctgaatattacgtaggagatgttactgctgctcaagtaaagcgtcgacatgtatcactcacggtcgaccgggaacaaaagtagcacacggggaaacattgaggcagggaacctttaacatttgcgggtgcgcccacatcagtcccgacaccacgataacgactctatcacagaaacagtttaagaacaacctcccaaacagaagcaactaaataaaacacatcttctacaaggacagtatatatatacaagtgtctcaacaacctatacacctcgacaaatatccacctccacactaatgaatagtaaacaaacctatctctcactcaacacacgacagactaacataatctatattccgacacaaaagacctacttataaccacgcgcggggcaggtgacaatggaggagataaaccacatcggcagcgagagaaatgatcttaacgaggaagattgtacgagaaacaaagagagatcgaacaccgagtgcagatgcacggagcagagagacgagccaaatgacaatacgaatgcagaacaaggacgaaccgcagagaggccgagcataaggagcaggtcaacgtctgtcagacagagaagtagggtgagacgtcgaacaagcgaagat

SEQ ID NO: 705576 - DNA, 181 bp, Homo sapiens
tgtcgccagccaacaggatggtctcaactctcttgaccttatgatccgcccgccttggcctcccaaagtgctgggattaccggcatgagccaccgcgcctggcctacacaaacaattcttaattttgagaacgtccagttcatcctgtctcctgttggctggatcctgttggctggcgaca

SEQ ID NO: 705577 - DNA, 128 bp, Homo sapiens
acattcatggacatctaccagtgggctcgtgcacaaacggtgttcactggatttgcaactgaccctgtgtcatattccaggcgcctcatcatattggttacatgtaggtggaagctgctgctaggggg

SEQ ID NO: 705578 - DNA, 749 bp, Homo sapiens
  misc_feature (62)..(62): n is a, c, g, or t
  misc_feature (120)..(120): n is a, c, g, or t
  misc_feature (125)..(125): n is a, c, g, or t
  misc_feature (141)..(141): n is a, c, g, or t
  misc_feature (170)..(170): n is a, c, g, or t
  misc_feature (178)..(178): n is a, c, g, or t
  misc_feature (182)..(182): n is a, c, g, or t
  misc_feature (191)..(191): n is a, c, g, or t
  misc_feature (215)..(215): n is a, c, g, or t
  misc_feature (221)..(221): n is a, c, g, or t
  misc_feature (252)..(252): n is a, c, g, or t
  misc_feature (254)..(254): n is a, c, g, or t
  misc_feature (287)..(287): n is a, c, g, or t
  misc_feature (318)..(318): n is a, c, g, or t
  misc_feature (333)..(333): n is a, c, g, or t
  misc_feature (395)..(395): n is a, c, g, or t
  misc_feature (401)..(401): n is a, c, g, or t
  misc_feature (430)..(430): n is a, c, g, or t
  misc_feature (441)..(441): n is a, c, g, or t
  misc_feature (497)..(497): n is a, c, g, or t
  misc_feature (520)..(520): n is a, c, g, or t
  misc_feature (525)..(525): n is a, c, g, or t
  misc_feature (528)..(528): n is a, c, g, or t
  misc_feature (543)..(543): n is a, c, g, or t
  misc_feature (567)..(567): n is a, c, g, or t
  misc_feature (625)..(625): n is a, c, g, or t
  misc_feature (664)..(664): n is a, c, g, or t
  misc_feature (670)..(670): n is a, c, g, or t
  misc_feature (721)..(721): n is a, c, g, or t
gcggcaggttgcggcggcgccggaacgggtctccaggctggcgagcgcccaggacaggcatnttgttagggactggcggccatggagctgaaggtgtgggtggatggcatccagcgtgtngtctntggggtctcaaaacanaccacctgccaggaagtggtcatcgcacnagcccaancaanaggccaaantggccgctttgtgcttgtgcagcngcttcnggagaaggagcggcagttgctgccacaaaantntccaatgggcgcccagaccacctgcggacagtntgccagacaatgtccagtttgtcctgaggcncacaaggcccaaccnagctgggaagccctcctcaaacagctgtccacccccggaacgctgcctaattcgtgccatcntccctntaaaaccacgggctgcgctgggctgtaanccccgcaaaanactgacccccgagccagcacccaacctctcacgccctgggcctacggccctgtaanacccacaccaagctgctgcacanacctncanggcctggagctcaangtgcagagagaatgctgaggagcngggccatgaggccttctgggagcaagagctgcgccgggagcaggcccgggagcgaganggacaggcacgcctgcaggcactaagtgcggccactgcngagcangccgcccggctgcaggccctggacgctcaggcccgtgccctggaggctganctgcagctgggcagcggaggcccctggg

SEQ ID NO: 705579 - DNA, 316 bp, Homo sapiens
attccttcttaatagcactgccgcttttatcacacgaggagctggtaccatctctactgaaactattctaaacaatggaaaaagagagactccaccctaactcattttatgagaccagcatcatcctgatactaaaacctggcagagatacaacaaaaaaaggaaaacttcaagccaatgtccctgatgaacatcaatgcaaaaatcctcaataaaatactagcaaaccgaatccggcagcacttcaaaaagcttatccaccacaatcaagtcagcttcactcctgggatgtaaggttgatttaatatatgcaaat

SEQ ID NO: 705580 - DNA, 155 bp, Homo sapiens
aggtggcagccatctccttctcggtaagtgttaatccctggcaattcgcatttcttcgggtttcatcttggcccgtcggccagttgttcggaggccttccctttagcgcggtaggttcctttggtattttttattttcagctttcttggggctgt

SEQ ID NO: 705581 - DNA, 123 bp, Homo sapiens
  misc_feature (5)..(5): n is a, c, g, or t
agacntaaaaaaaaatatttttacgttagatgttgattggttttgttgtccgagagtcaaagttactcggggaaatataatattaacattagatacttcatattttatgtatgtgtattacac

SEQ ID NO: 705582 - DNA, 866 bp, Homo sapiens
tatatctaacattgagcatctcagtgctagggaatagagtatatcgtcaacctcactatcctccgctaatagtgcctacgagaggattgaatagctatcgcggtgtggcaatgatagcctaatctcagtaaccctactgacatccaatcccgtctgtaggccgacatctggtggcctagtagctatgacatattgcattgtggccgcactggcgaagacaaacggtggacctataccctactaatgtcgccaatcatccgggaaatgagtgtgactgaaagcgtagcaagtaatataaccataaacttatatccaaaagttgcttaaaatagctaatcgttctcccaaacaacttgatcttaccctatgcgatgtgacactgaacttacgcaaagagaccatcacttacaacttcgagagtggaatgactgaagcaacccaaggaaggacctaacgtctactgagtgataattcccctggctagtaatgctggaacccaacatgtcaacatatgaaccataggtaacgcgttgttcgcaacacatccgtttttgcgtcggaaccccccgtaaaacgaaccactccactgggttaagactgaaatttatacatgaagctccatagtgcttgacgaatcatggtcaagggcgaggacacacttgctggagatgtaaagccaatatcaggaaaaatcaaatcctagccttttctactgcaaaggctcgctaagccaatgttcttaagtataacgcttcggcgcgcacgacacatagtccgttgtcttgccttcccttgtaacctgcactgaacggacctggcttacatcacggtggggcaccagaacagacgctcgacgcagcgccacg

SEQ ID NO: 705583 - DNA, 889 bp, Homo sapiens
gtctttgttatatatacaaaataaataataataaaaagaagaacaaaacacaagccacaaatgacaggagtgggttctttggaactatctacaatctgattcagagctgcctatgtgttctgggtcaatccccccggtgtatatgcttggacacagtaaatgtctgtgaagtgcgatcgcacgttcttggcaaacctggttaagggccaggcaaattgtgaatcccatgcctggacgcctttccaaaattttctagcccctctgagggtctctcctggtttcttcaagtatcattgggggttccacccgaaggctgccctgttccgagaccaaacgggggaccccctgccgcagaaggggagcgcctgcccccccctgagacggggggactacacatcaagaggcaaagtattcaatttgggagcccgaagagccgacccaccccgagccggcacccgttttgggttctcccttggccctgagttgttgcggacagtgaagtctccctagcaatctgtgaaaagcaggatgatgaatggtacaattttttttttagggggagagaaacttttgcactcgccccgccacgccaaatattgggggagagcaacccaaagaatcattgtctccaaaaccgaagagagagcccatcattcataaacacttcccaatgctttattccgcaggacaccacaaatcgtagagtcttttcctggaattcaactatagtcccggttgctcaagtcgcgcctataatattacaccttcatacatgatgcaaaactacactcttttctatatatatagctctctcccgtcaaatcccctgcagccccatgaagcaggatgtgactttaacattaaaataaagcaacccccccacaaaaca

SEQ ID NO: 705584 - DNA, 161 bp, Homo sapiens
tatcccctctcgtccaccaagctaatataaaatatataagatacaaaagtagatgaaatgctgaattacaactccttactttgactgtttcctttattctagggcctcacacctaatgatcttatcgcggtaaatatattctgccctgttattctataaag

SEQ ID NO: 705585 - DNA, 149 bp, Homo sapiens
attcgcggccgcgtcgacgcttagtgggccacccctgggccgctccctgggggtgggatttggaggcggtccctgccttgcaccctgtacagtgggtgggccgcgactgctgctcgttattgtattgtagcaggacgactgtttaatat

SEQ ID NO: 705586 - DNA, 536 bp, Homo sapiens
taggcgcatgacagtggtgcagaagcctgcccaaaggcagaagtgaagtggcaagggagtgtcatctgatcatgaggttggctttcaggagcggcatcttgatgatggtcataggtcatcacttctagtacagttgacaatggcattacgagcaacattgggagaggtccctttccagaggccccggaacccttcctctcgggcaatggtcttgtaggcattgacggtgctttggtatctccgaccacctccagcccgggcctgagcttggaatcggacctttaccacatccgtgggctgggccacagccacagccagggcacctgtggtgctgcctgctaggaggcggctcccaatgctggcatgcttagagcccttggtgtagaactgtttgacagaatcatacaggccgatgcggacagaggcaaagctcatttggcgctgcgggccggcaaccagcccattgtagaggcttcgggggccctcagtacgcaccatggtcagaatggtgcccatcacaccgcggtactgggcgc

SEQ ID NO: 705587 - DNA, 143 bp, Homo sapiens
cgtgtagtgagtgtcagtcttcggaataggataagctagacagagtaggtccatggaatcctgaacccactatctagcttggggtcagcacagatctcctatggcaaaaatggtctagaagatcacagctatctttgggacac

SEQ ID NO: 705588 - DNA, 605 bp, Homo sapiens
  misc_feature (444)..(444): n is a, c, g, or t
gatctgactcttcagtaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagggttcatctgataatgtaaatttaaatgcctctacatttgatacgaaacccacattcaggtgacactgaacgaggtggcttttgttccaccagtgcctcattaaagtgaggggatttctctctggtttaggaaaatgatttttcccctaaacttgtgcaaacattaacaaatntcctagatcttatggattggagaactgttggtgttcctaaattaattcaagttctcgagaggatttagaattcaccctgggcttgaatgggaataaagaactgaggggctttctggcctcttttttgggttatccactaagacttgggaccaaccgggttt

SEQ ID NO: 705589 - DNA, 819 bp, Homo sapiens
gagtgcccattacgagccggtatccagctccatcgttctttgcagcctgtgtggctatgggtacttcgtggccgcacatcctatctgctcgtgaaatccatccagagtccatgttccaataaactagtgaggtcgtgtacaaataaattcttaaataggctttatcgtttatggcttaaatccctctctcccccttcttaaatatgtctcaggatcatatcaatacataatgtctctgggtaggtgttgaagaggagcgcgtgtacatccctcagcatgacacgtaatttgaatggtgccggaaaaaaaacacaccccgggatcccgcactttctgtgtgtttgtatccccccaaaataatccgccgcccaggttcacaacctttctctatctcgacagacaagtcttcagtgggaggctcaccgggcgtcaatgccaccaggggcacgccagggcgtattatatgcccgcggcgggcgtgaccagactcggtttcgagtcaatttgcctgggtgggcttcctacagatttaaacaaggaccgtctactaagctcaaacgggcaaggctccggggggatcccaagccgggctgtcaaccacccggccagacccacgggtccgagcggtgcactctgcgtaacactcaccagatgggacaccttttaacaaaacccaatacaaagcctccagataatagaagaacagagccattccagtcacgtgccacgtcaacttgatgtcacacagaccctgtgtccacatcgaaaaccggcttcaagaacacacaccacaagagcacaaagaccaagatcaaaaga

SEQ ID NO: 705590 - DNA, 144 bp, Homo sapiens
gcttctgcggtcgactctgacggactccccggcgtggtggtacgggcgttacaggcggacagaactcagactgtgcgtgaaggtgacattgggccgcggtggctgcaacctgccgccgtccctaagcacagcagaggcaggaca

SEQ ID NO: 705591 - DNA, 306 bp, Homo sapiens
ctgtacagagacgaaaacgacggtcagcatccaacaatctgaacgtgaccttactcgagagctgatgacatggcagggtccgcggacagtactatcccgtcggaggacctgcaggagcagatctaactgaatcggacgcatgctgaacaccatctacacgcagcgcgtgctgacccttcgacgacaacatctgcctgcgcgagaccctgagagaaaatacatgaagtgcgtgtccgttctgcgacttcgacagctccgcgcccttcctcagctccaccacccgtgctcttccgtgccatccacccc

SEQ ID NO: 705592 - DNA, 796 bp, Homo sapiens
ggatagtgaatcattctttacatgcaaacatattccagttactataactgatcagtttatatattgatacagtcactccattaatgtaaagtcactagtgtcattattgctatatcagtaatctcttggactccgttaaatattttactgtgtgtaatatagagaagaattaaagacaagaaaatctgaagtattgtcttgtcatttaataagacacatacagtgtgcctagtagtatagagaaggtcacttaatattgtctcatttatgccacctggaaattaggaataatgtagaaagttgcgaggcagtgaatttcctttgtggaaaggactctgaaggcagaataagaagggagagaacctcatgggcagaatattataaacacgagtgtcatacttccagcattgagaactcggaagagagaagagtgaagatccctagttgccattattaatctgccctgtgtctatttcctattgaacaatcagtttgagcgtgctgcagttatgagtttctcatcatagatgacagccctacctattgtaaacgtcaaatgccgatttaagactttccgtggctgtttataagaaacgaaattgtcttcatgagacgtggtgactatatcatttggtttggacctgctcaatagtaggtcgaatgggcagcactccctttgccccctgttcctggggttcatgcagggaatacttttaagagtctatatagggcaagtggttctttcctctgaaattacaggatggacaaaggtcatatccttttgtccgcgaaaata

SEQ ID NO: 705593 - DNA, 171 bp, Homo sapiens
tggaaacagtgtctggtttggtggcctaagcgggaaggcaaggtcacaatctgggctcacggcaacctcaacctccggggctcaaggtgatcctccggcctcagcttctcaagttagctgagaccacaggtacaagccaccaggcccagctaattttggtgagcaggtggg

SEQ ID NO: 705594 - DNA, 265 bp, Homo sapiens
  misc_feature (121)..(121): n is a, c, g, or t
gacctgatgttcggtcggtggtacaattggctgaggtgctgggctttgggaatgcattccccgacggtattggtcgtcgctctcgcaagagcctgcctcccgcagtacaagcgtccccggntcgggtgggaggagggcactccggtaggagaaacatggcgttggtggacctcgctcttcattcctgatgtgaacatggactccaagggggtcttcaagttatgtgctgatccgagtcgtctcggctccccgctcgggggccctc

SEQ ID NO: 705595 - DNA, 175 bp, Homo sapiens
  misc_feature (65)..(65): n is a, c, g, or t
actgtgcctggctgtctcttgggaaaggtaggtaagttggacatacaaagtgcaagggcttggangggatgctgcttggtgaagaaccctggcgagggaagccgacagaggaggctggaagcacgtttgttgcgccaggatgtttctgcctggccgtgccacggagtgtggggat

SEQ ID NO: 705596 - DNA, 1539 bp, Homo sapiens
  misc_feature (180)..(180): n is a, c, g, or t
  misc_feature (892)..(892): n is a, c, g, or t
  misc_feature (921)..(921): n is a, c, g, or t
  misc_feature (949)..(949): n is a, c, g, or t
  misc_feature (1214)..(1214): n is a, c, g, or t
tttggacgtccccttctcgtgctgctcggtagatcacatcccacactactgccgtgtgtgtgtcgagacctcctatcgattagaaaacccccgcgcgcgtgtctcagttatcccactgccctctcccggtggtttttatattccctttgtggcccccggggggtgcggggataaataccnattgtgttgcaccgcccacggggtaaaccgcgttattggcacccactttgggcccccatacttttttaggagtgaccaccagctatattgagaacacaagggttgtgggaccaacaaaaaaaaagcaacagggtgtggtgtgtataccccggtgttccccgcggagagttattccccccccggggaattattattttcgctcgctgagccccacacacggcgcgtgtccccggccgttttttttctctcgccggcccacggggagtcccctctagaagggcctcctgttaaggagcctcacacccaacttgtggcgggctcccacaccccggggagattggggcccaaatggggtctccttgtgaataagccccccccacccttgtgccgacaccacaaagggagctttgtgtgggcacaaccagggtgcggccgagttggtgccccacaacacaggggggtgtcctacacccacaagccccgggccccccggtgatagagttcccccgcccaggacaggtaaaggcccccccgggcacaaagcccacaaaaggcgcgcgcgctcccgcaaattctgccacacccacgcggcccaccccgcggttctcggggtgccgccccaatcaccggccgcacccaatctcgttgcacctttgccccccaccccgggtttcctcggtgagccacacacacgaaaaaggtgtgccgccgnccggggcgccgccgggcgttttcacaccnctctgggagaggagagctttcacaaggngtgtgtgcccgcgccaacatttcacacacacagagatagagtgtggccccgggagccacttcgcgcactattttctctgtgggatatcccgagaggagagggccggagaaacacaaggttcccaacgcgagagtgcccctctgcacaggccccacacagtgtgcacagcgcggctctgagaaggagagtgaccccgctctcccaaacatctcatctccttgttctccccccagagatagaccccctctgtgcccccccacagaanagagggagaacccagattcttgtcctgtgaagagaacactgtataacatgtgcccaacacccagactgtacccgggacaccggtctcaagtcccctctccggaacagtttataaagaaagagagaaaagactctgagatctcatccactgagagaagaagaaagaaatttccaaagccttctgctaagatttcccgtatggccccgtgcccaacacgccccggcgttttctggccataacacgggccaaaagagcccaggaaacccccaggaccggatgttgtataaagaaaaaattaagccctcctggggacttggaatccaca

SEQ ID NO: 705597 - DNA, 166 bp, Homo sapiens
  misc_feature (61)..(62): n is a, c, g, or t
ccccccccccgttggggaatgggcccattttatcccccagccacccaagaccaggagcctnnaaacatttgggattcaagggtttgcacccccccccagccctgaggatgaacaccctcaaaaaaaaggtggtttaaagcaaggaaaaaaatgaaaccagtgccca

SEQ ID NO: 705598 - DNA, 367 bp, Homo sapiens
tcctaaacacagcttctctcctgagtgtactaattcccacaatgccacaactacatggtgttcggatctttggaattaataagtgttgaaatgttttgaaactgaaaaaaaattttacagctactgaatttcttataaggaaggagtggctagtaaactgcactgctactctgataatgtgaaatgagaagtatttacattggatggccaattgggtggtccttcaagagctgttttgaagtgcatatttccaatggatgatgccttcgtttaatacaccttgtacatttcttgaagaggggctttaatatcctgttgggcatgcccagcttattagttaaaaggtctttttacttagggtgggtaa

SEQ ID NO: 705599 - DNA, 286 bp, Homo sapiens
ggtgttccctttgtctccggctgctcgggagtgctgaggggggagaatcgcttgaacccgggaggcggaggttgcagtgagctgagatcgtgccaccgcactcccccagcctgggcaacagtgtgaaactctgtctcaaaaaaaaaaaaaaaaattccagtatttggctaaagcttccatagggtttccaggattctattctcctttaggagggatgcctttggatctcatattttggttttaagattgatgtgtggcaagagttctggtaagacaaggggaaaca

SEQ ID NO: 705600 - DNA, 115 bp, Homo sapiens
  misc_feature (64)..(64): n is a, c, g, or t
  misc_feature (109)..(109): n is a, c, g, or t
tgcagtttgagcatcaaggaaatcttcttcctcttcctcggttcgcttgtgttttaaaaacaantcagacttttagaagcggctgtagctgtcgtacttcatgagattnaagatc

SEQ ID NO: 705601 - DNA, 1218 bp, Homo sapiens
cgtaagggccaaagtcgcgagcggggctagggcgggcgcgacgttcgaaatgtaatatatgttatgggagactgctcgggaaagctgtggtcagtgtgtgtggccaccatgtactgttaggccagtgtcttcatcagtggctggagacacggacacgaacggcaagagtgtccagtatgtaaagctgggatcagcatgagagaaggtagttccgactttatgggcgagggagccagaagccccaggatcccagcattcaaaaactccaccccgaccacagggccagagacccagctccggagagcacgaggggcgcactccagccatacggtgataccgagggagcattccacgatactacattatggatagtaggatgacttacaccactcttggccttataaacaaccaacgaactttccaatgccacatgagccctatcccagaccgggagtaccagagttgtggaattcttgggaaccacgggatccacccaagaccataacaggactgagccagcgacttccccatacattcccatggatatcctacagcaaaatcctatctatcctaataaccagggctgccttcagctacttcagaagccctaacatgtcctagccatcccattggagaccaacccaatcccaagaccacagacaaacagaacatcacaggcacttggaacgcgggtatcccttgccttggacccccgacttcacagtaaaactcacataggaaccacccacatggaataacccctaccctaattcgccctgacagaagcgcccacaaaaagcacaacacacccccgggctaacccatctatggtcaccaaagagcaaaagtcgacccagggacaaacgcaccaagaaacacagaaagcactccagcgctcacactaccaactgtgcgacagaaagcaccagtcacgacatcacgaagagctccaacacatcagcaaaacccaggaatagtaaaaaacataaatcaatacacctatattggcaaaaaacaccaccatataaacattacaataacacaaatctttcatataaactccccccatcaccataaacacacactataccattttacccccaaaaaattctacacctacatttaaaaacctatccaaaaaagctcaacaacaaacaattcacccatcatataacaaatacatacaaccaattacccatcattatcaaaaacaaaaac

SEQ ID NO: 705602 - DNA, 271 bp, Homo sapiens
tagggaaggcaggaacactagctacattaaaaatcatttcattaaacttatacagaaaacattattcatatacttaggattcccagagtaacttatttcccttaccagtataggtatatcaataatactagtctttctttactttatcgtggtcatttcatattaaaaatactttttccagcatgactcaactaacacacatgtatatgtttatgaacataaacactactgaaacaaacgtttcagacaacgtttttcttactgcactctg

SEQ ID NO: 705603 - DNA, 226 bp, Homo sapiens
acctacttttcacagggtgacatatttctttttcccctctattcaccgatttgccacttcgcttcaacagcatgccctgtttaattgggatggctcggccgctcccaatgctgtccgctcgactctccaggcctttcgttctctttgtctgggtcgctccctttccgagaagtgaacaggttggaccggcgcttagactgcttgcgaacgggcgtgcgcgtgtggt

SEQ ID NO: 705604 - DNA, 219 bp, Homo sapiens
  misc_feature (87)..(87): n is a, c, g, or t
  misc_feature (105)..(105): n is a, c, g, or t
  misc_feature (146)..(146): n is a, c, g, or t
  misc_feature (163)..(163): n is a, c, g, or t
gctaagttttaagaccttcagtagttaacaaagcagacagagactggccaggcacagtggctcacacctgtaataccagcactttgngaggctgagttgggtggntcacaaggtcaggagattgaaaccatcctggccaacatggngaaaccccgtctctacnaaaaatacaaaaaaaattatcgccatcacgaggaggcgcgggcacggagcccgaac

SEQ ID NO: 705605 - DNA, 585 bp, Homo sapiens
ctctcgaggagtttggaggcaggacactggaccccagagtctgtctgggaagtcgacccccagccaccatcaggcaagacaaacccaacagtggcgacgtgcaggtgactgaggatgcgtgcgccgctactgacacggaagccatgaccactaaaggacctgctgaaaaagttccagaccaagaagacagggctgagcaagcgagcagacagtgaacgtgttggcccagatactcaagcgactcaaacccgagcgcaagatgatcaacgacaaaatgtacttctccctcaaggagtgaggcttggtccaatacatggctctgacccccagaacttaaggctctcactgccccttcgccatcctagagtgaggctctgtccaatacatggctctgccctccagaacttcaggctctcagtgacccttcgacatcctgcttgatcactgactcccagggccccgtagttagcaattctggaaaagttaagccatcttctcctctggcccttacttctggaatcttcagatgccagttaggccttcttattgtcctcctcctcctgggctcccacagtgtcctggact

SEQ ID NO: 705606 - DNA, 1096 bp, Homo sapiens
  misc_feature (759)..(759): n is a, c, g, or t
cagtgagccgagatcgcaccattgcactccagtctgggcaacagagtgagattccgtctcaaaaaaaaaaaaacagaaaagggaaaaaaaaatagcatttatacctccttcctggttcctcacaccggccattgaaacatttctgaacactccaaattctcaggtggaattaattccaaaacaaaattttatacaggtattaacacctaatttttacctctcttatagctaatagctatactttaaaaagccctcagggctatactatatcgtctctaaacagcctacaactctcagctgccaggctacatttaacccaacttattgttctctctagcttgagaaacaacttaggcccatatttcacttgctggtgttagccctcaggtgccttaacatggggttgccaaattaaaatattccgctagaaatttacccgtgacattggctaaaacccattgcgtttctggtttacaattggccaaaacttctcaaagggcccgtgttacttcactgtacatccttgtgacaactctactcactctcgactctggaattcctcacgttactcggactgggctggggtggtgacttacgtaccataaggtacctcaatatttataaaaccctcaaactactttggcactcgacttttacagcaaaattccttccccttttctaccaagttaatttcttcttaccaaatcatgcgggtaatctcgctaaatggacttactcattccatggggtctcttaganaccccactgttttcaacctatcttgcgccttcatccagtcatcacctgcgctctacctattcccacaacaattctccacactttccccacgacctcattccttgacctgcagaaatcggctaggcgaaaagtgaaccctttcacaactttgggctgacttctcccacacccttggttcacacagggcggtccctccacagggactacacatgcgggcctcccccaacggggtgtccgctccggacccatactttgaccttccacgctctacctcacagggcgcgcgaccctcctcccctaacctctcctcacacacacggcgccccaaatcatacaa

SEQ ID NO: 705607 - DNA, 131 bp, Homo sapiens
cctcccgggttatttttttccgactgagtaccaggccgcccgagccacctgctcagagcgttccaggcgaagtagacacattgtgtagtgccccgtgttgtatgccagtggcgacatcaaagacaggaagg

SEQ ID NO: 705608 - DNA, 95 bp, Homo sapiens
ggccccttaagggcaggaaaaggacccttttttttttttgctttcccaaagcaaagtttttggcaaatgaatgtttaaaaaatgtttgttgaata

SEQ ID NO: 705609 - DNA, 501 bp, Homo sapiens
  misc_feature (302)..(302): n is a, c, g, or t
ggctcggacccgcagtttacaaagctccagttacaacactttctcatttttacagctaagacatgttaaattcgttaaatgccataattttgtgttcaagctgctttgtctgttcaatctcacaagtctagaatgtgattaagctactaatctaagtattcacagatgtgtcttaggcttggtttgtaacaatctagaagcaatctgtttactaaagtgccacctaagcattttatagaaagcaatttaatgccaccaaacatgatgcctgctataccttggaaacaaaaatatctcacacnctaaattctagcagagtacactattcctcctcgaatgtactgtatatccatatggcacatttatgactttgttctatgtcattcatattacaggtttaggtgtgtggtatgtagctaggattcccatggtcgtcagcttttctagagctgttgtcattggccttttcaacatctgaaggctatggtgtctggggtacca

SEQ ID NO: 705610 - DNA, 419 bp, Homo sapiens
tccactaagaagctcaacatccagtgaggcgcccgccgccgccccctttcccggggctaaaaataaacgtttccaaagtggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattggggccccttttgccaaaataatttttaaaactggcaaattttatatagggggcccaaatttgggccaattgggcaaaacccccctaaagggggggttaaaaaaaaaaacggggcgctgtttaaaaaacggttaatgggaaaaaccctgggttacccaaaaaaaaacccttgaaaaa

SEQ ID NO: 705611 - DNA, 329 bp, Homo sapiens
gtggtcccccgctcccgggaagtcaccattttgatgccgaacttagttgcggacacccgatcggcatagcgcactacagcccagaactcctgggctcaagcgatcctcccacctcagcctcccgagtagctgggattacaggcatgagccactacgcccggcagtaagattaattttaatttctcaaacatactgaagaggaggtatgaacacaaaatgctgagcatggctgctgtgaggagtcaggtgtgtaattccagcagtgattgtgtcaggctttacacgtgcactgcaacctggcaaaaattcctgtttgtggaggtagcact

SEQ ID NO: 705612 - DNA, 690 bp, Homo sapiens
gcaggctatgctcgccggtttcctggcgttccgctccggccagccagagtctctgtctcaacctgtgtcctgtgctccagcatgtctcctcagccctggccccgctggcgcggttggctgtgcctggctgccccatggcgcgccccctcctcctgatgtgctggctggagatccatgcccaatgcctctgaccctgcaagcctgatcctgctgcatgcgtgatggatgtggtgtcccagtgatggtggtgaatatggcctgtgatctgtgcccaaatgatggatgggctgtcatcatggctgtctcctgaggacatggacagttcgtgttttggttaaagagagacatgtggacagtatttggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtccttggagctggatgtgggtgctgagcactggacaggacaagcaatttgcctggcactgtctgagagtggggcagcgccttgggagtgttatcggaccagtgctgtggcctcaggcctgcatttgatgttgaaacccgg

SEQ ID NO: 705613 - DNA, 1121 bp, Homo sapiens
  misc_feature (281)..(281): n is a, c, g, or t
  misc_feature (316)..(316): n is a, c, g, or t
  misc_feature (616)..(616): n is a, c, g, or t
ggcagtcgccacaccttagaccctgctgcgatagaccctgtccgccacttctagtcggtatcctgcccaccgctgcttgctagctggctggacagttccccacggcgggcggtgcagggcgttcccctctgcgagcgttacgacggtctttgaggaatgggccagtcagttaacctacaagacaggcaatctatacctgcgggggccccctgagagaagtcccaatagtcactcgacttggtcaagtcgtgacccttctactagtagaagagcaactggtngcaggttggctagcctgaactgccttacctggatnctctgagtgatgcttctgttccccaacaatggctggttaggtcagttgcgacgtatgcttcatactgtccagcgccctggttgtccccttaccggaatagatggtccaccatgggaaatctatatacatttgttcaacgttgaggcagggatcgtgggcatgctaccaatatgtcgccatgcgattcggttaggtaaacgcaggagaacgtgggcatagatttatccaattcaaaagggtggggcatggccttgccggtggtttgcggaactgacaacctttgacacacttggcagcgtnaggccccttttccctgtgtatcccagtttggtcctggccagtggcgaacacacaaggtatcggacgggcaccactgggaacgcaaagaaaaaggtttcctgtggcgcaacgttaatgggcccctgggcaaggccttcattaaccggccgccaccaaagggccttgggttcggcccagggaaccacacttaatttcgattggggcaccggtttggtgtggccacactatgcggcggaggaaccccggggcgggggcaaatttgctctcaggcttcccaattggggcaaaacagaccgcaacaaagccggccgccaaggcgggggaaccacggaattgggctttccttgcccaacaagaaccaaacgaccagaccacacaggaagtggtatttggtttggccccccgttggggggtcccaccccgggtcgagcaattggggggaaaaaccgccttgtgggggacaacggatttcaagggaaccccaaggatttcccttttaaaccta

SEQ ID NO: 705614 - DNA, 339 bp, Homo sapiens
  misc_feature (5)..(5): n is a, c, g, or t
accgntaatatgtaacctttctcccttcctttcctttttcctttttctttgttgagacaggtctcgctctgtcgcccaggctggagtgcagtggccccgtcttggctcactgcaacctctaattgatcctcccacctcagcctcctgagtggctgggactgcatgcgtgtgctgacacgcccggctaatttttgtttatttttttttttgggagaggaggtctcactatgttgccgagtctagtctcaaactcctgggctcaagcgcttctccggccttgtgctcccaagtgctggtgagctctcacaccggtgcattgttttcgtgtttcatgttttc

SEQ ID NO: 705615 - DNA, 785 bp, Homo sapiens
caagttcccagtaggaccgccgggtaatattcacggatagaatcttgttttgattcggacaaaaaaatggggtaggtaccaataacactaaaggggtgctcttataggcggcccgaagtgtgcccctccacaagagttgcaacatttgttgggccaaggaacaattgtgcgaccgttttgtgggaagaacagtccggacaaggggtctctccgctgtcgtgatatgtacccctcgtcattagttaccgttggccatccccaccggttttcgccgcccatgggatcacgtcagcggcctcaacacctggtacggcactgcaggcgggaacatcacacgcgcgggttactccggcaaaaaatataccccctgccaacacgtagcaaacacacgggatgcgccccaaagggcggacacactcggtcgagaaccccttcataaaatgagtggccatcaagggcagactaccccagagcaagtgcgataaagccgggaccatcaacatccgagcgtggcaataaggtcacgtcctccaaatggtgcttctaagggcccctgtcccagagagggcggtttcactcccggattccttccctagtttatagttcatcacgatccggtgtccgagtagaagaattttgcttcatttgaactcggctatctggacatcttcagttcacgccggcttcaaaacatgcttgcaaaggcgccaactggtctcccgaagacccggaccacactgcaaatcatgctctcccaaacaaaaaagaacccactgcccccatga

SEQ ID NO: 705616 - DNA, 146 bp, Homo sapiens
tggtagcgccaggagcctgggctggacatcctacagggaggcagaacgaaaagatgtgtatgggcgcatcatctgtatggacttgtatgtattcttgttctgggcgaaaatttttcctcttgtagttatcttctattcattgaaat

SEQ ID NO: 705617 - DNA, 161 bp, Homo sapiens
cctcaccaagccacttcataataatggtcctccacgggaggatcctgcccttggtggcacgagcgctgtcgagaatgagtatactagtccaggagcttgatggtgaaggggtccagcacgcggtatgttgatctatttctattcttcagcgtccgtagcgg

SEQ ID NO: 705618 - DNA, 133 bp, Homo sapiens
ctttcgtctcggccgctaaacctgagatgacgaagggcacgtcatcgtttggaaacgcgtcgcaataagacgcacactgttgtgccgccctctgtggctctaaggcctaccaccttcagaagtcgacctgtgg

SEQ ID NO: 705619 - DNA, 189 bp, Homo sapiens
gagcacaatgtgttcagcttggcgaatcgaagaatgatacagatcagtgccctacccgcctttaccgacaactacatctggttgttacaagaccctacgacccagcgctgcgccgtggtcgaccccgcgcgatgccacgccaagtgctggccctggctcagagcagaatgccgatgtgggcgcctcagc

SEQ ID NO: 705620 - DNA, 916 bp, Homo sapiens
ttgtcggtagcagtccgctcgggcccgttcgcgcccgtgctgtcggccacgtccgcggggtggagggcgagacagtgtgacctttgatgaatgacacggtgcttgggctacctctggaagatgtctgtgtggaagcatgaagcggcacttcttcaactgtgaataatgatcatcaatgacgtgcgattggactatgatgatcgtccgttgggatcggctaatggatcctctgctatgctgattagtatatatcctcacagctaagaaccattctagatggttgacgtggcaccctatcattatgaactaatccgagcgtgcaatgtgagagatggttaaacataagatagcataaagatcctgcagatgataaatgcgacgtgagcgcatgagaaatcgtgactcctagtccttggatacacgtgagacgattacttttaatcgatgaggtagttgatgtaggcatgccatagattgtcgatggcccaaggttcgatgaccaagcttagagtgcatatatagctagaatgcttgataagagcccatgagtaaacatcgaaatagtctcaggagatccgcatattccaggaagcgactacaagcgatgttgcagcagaatgtgcgattgtcacaccccatgtcaagagggtatatagagtctacaatagtccatttgagcaagggatgtggtgagattgagttataactcagtgagggaaccgtcagcatggatcctgagataagtgtagtccaaagcatgatagggttgtcatgataagagtgttttccaataattcttggttgaggacggggagtaagatgcagggagattttgggggggtttacagccttgcatgggtctagtggatgattgactatggtcaagaccggatggggccgggttctataaacatga

SEQ ID NO: 705621 - DNA, 434 bp, Homo sapiens
acaagttggggtctatgtactaaaattcttagaactctatttctttacatgccatgtctctaaacactctctctcggataacgagaacattgtcctgtgcctattaacaaacacctacctgaggtcaggcacagtggctcacgcctgtaatcccagcacttcgggaggccatggcagatggattgcctagaggtcaggggttcgagagcagcctgaccaacgtggtgaaacctcgtcactactaaaaatacagaaattagccgggtgcgacgacacgccccttgttagtcccagttacttgggaaggctgaatgcgtgaggatcctaggtgcctggggaggatgaggttgcagtgagccgagattgtgccactgaggtccagccggggcgtcaaaggcgagagtgtctcaacaaagcaaatcaatggtggtggc

SEQ ID NO: 705622 - DNA, 534 bp, Homo sapiens
ccctgggccttatcttatgggaaacctacccttgtaggacaaactcaagtggcctttgttgggggaggggacagacagcccggagttgggcaggaacgcttctctacacagtaaatggagaggacgagctcttcattcctggggaggctccattaaatacccattctctggagccagttcggcgtagacgccctcagacttcatgtacatgtctcgggtgtcgttggccagaccatgcagcccgttgtgctggacagcgcccccacgtcaggtttaatggctgccccgctgactgcttcgataggcccggtagcgctccagacatggtcacagtgatgatccccggccggagcccttcgagctcggtccgttggatatggcggggtcccgagcacgaggccagtgcgtttcctctgtaccatatgggctgtcaaggcctatttacgttggccccattccaaatcaggcctatgagcaccgaaagcctcgaggaaaaaagtttgaccaattttgttttttgggtgtggtaggggg

SEQ ID NO: 705623 - DNA, 395 bp, Homo sapiens
accaaccaggggaagccccctaatcccgaaagttcctgggtgtatccccggaaaaaccaaacccccggacccccgagggagggccctttcctcccatttttccccccccaaaaccaaaggccttggttcctgttccccccggaatgttttttttgttgtgggagccggaacccctcctctttgggcaaaaaggggcccccttccctcccccctgggccccaagaaaaggggtttttggcccaagcccccctcttccaaaaaagaaccagggatttgggttccctttttttttttttttttgggggaccccaagggccccggttgggaggggaaaggtaagggcttcggggggggcaaaaatgggcccccggtttttaaaaaaaaaatttcctggg

SEQ ID NO: 705624 - DNA, 633 bp, Homo sapiens
tacagaacacaaatcatgtcccgaggacttccaaagcagaaaccgatcgaaggtgttaaacaagttatagttgtggcttctggacaagggtggagtcggaaaacatctactagcagcagtgaatcttgcacttgcactagcagcgaaccgattcgtccaaggccatggattggctagactgtggactgtgtatggaccttcagattccaagagatgactgacactctgacaaggacaatccggacacttatcacagagacaacgctaatgaggcctctcttctgaacttatgcgtacttggcgttgctctggtctactggggctcttctggctctgaccgacacgatgaacccacggctcggatccggaccgacgcgccctacctggtacactgagctgcgagcccgtgaggacaaacagacgcggaggacaaagcgaagtgctcagtacggatggggagggcacgacacggcgcgcgagcaacgcaggaagacacgacaagcacgacgtgccggcagtgcaagggaacaccgtggcagcaagtgatatgcaagcgagaaaaccagacacaggcacagacaggacagaacccacccacaacaacacagggaaaggactcgacgcacacaaggc

SEQ ID NO: 705625 - DNA, 1130 bp, Homo sapiens
agatcgtccgcatgtcgctgccctatggtataactcgtccggactgagaatctgctgtcttgagtacctctctgatgccagcgcagatggtatcaacactatctccgtaagacctcgctgccgcactcaccttcgcatcgtcacttaagtaagcctatccttcgaaactattcagtctcatgactacacgtggcaaggagatcccagtgccctgccaagtgggtgatggcatcagaaagaaatctctcgcttcggcgttgctgtcttggtgcactagtgccccggggtacacagttcagatttcgtgtattccccttagctcttgcgaagagaactcagcatccctataacttaattcgacaccccacgatggtctaagtcctcggtgtcggattggaaatgttcgtaggccacgtactcttacttatgcattttggacttcgatttgtttgatccaccaagaacacggaggtacggtggtcggtaatgagtataaggaggatacctcctcttcttcccgtgacacggactatactcgcgtacatcagatggagttgactactctgcatccgaataaacaaggtcgtggtccatggcggtggaggatgggacttttctacctattcctggccctgaatattgttaatccatctaattaatttgccacgtaaacttggaccaacaagaatacagaaaaataagaataaagcttcttgccaaggaaaaggtatactttactgaaaccgtagctatgagcgtgttttttaggcctaagaccccttgctcaataaataatgttcataatacatgacggtggaaacgggtcgtcagcaagtgcgtcgtttacctgcacctatcattgccctggctgcctcgagggttgctctaaacaccaaaggtgcttctaaccaaagaggaatttccctgggcccattgcaggtcaatagcccattgtgagagaaaaataaaaccacttaatggggtcaaccacgaacattgtggcagcactctatgatatcaaaatcaaaaggaaaaccgtagttagcagggatacagtagagccacatataccaaaaaacgggtgacacaaacaaaagattttttgttttctattacctccacaaccaata

SEQ ID NO: 705626 - DNA, 281 bp, Homo sapiens
ttctatagaaatagtaaaaaattagcgggtgtggtgggggcgctgtagtcccagctactcgggaggctgaggcaggagaatggcgtgaacccgggaggcggagcttgtagtgagccgagatcgcgccaggcgacggagcgagactatgtctccaaaaaaaaaaaaaaaaaaaaaaaaaaaagtttttttttttaaaaattttaaaaattttttactcgagggagacccgcgccccctctcccagcgccatccgggggaaatacggggtaaggagaacacat

SEQ ID NO: 705627 - DNA, 221 bp, Homo sapiens
  misc_feature (26)..(26): n is a, c, g, or t
  misc_feature (130)..(130): n is a, c, g, or t
  misc_feature (152)..(152): n is a, c, g, or t
  misc_feature (155)..(155): n is a, c, g, or t
tcgttttctttttttttttgttgggnttgttcatgaaaatttcataagacattaaacaaagctagccatcatctcaagtgtatttccctgttaactattgttgtgacagcacatgcatgttaggcaagtntcaaaaaaaaaaaaaaaaaatnttnaaagcaaaaatcctaaaaaaaagttaaatacatgggtttttgttttactgctgtgcttgatataca

SEQ ID NO: 705628 - DNA, 756 bp, Homo sapiens
  misc_feature (463)..(463): n is a, c, g, or t
  misc_feature (501)..(501): n is a, c, g, or t
gagagtgagagagatacgagacaaattagacaaccatttacccagatagagagtgagcgatagatatagagacactagcgcagagatatagtaccgcaagggatagatgactatgttacccaagcattctttaggagagactaacacccatacgctctgcataatgatgtaactccatattactctctgtggagagccaaagctgacaccccggtaaccagacgagcatcctaagaacacgtttctgagcacacccgtctatatatctaaatagtgcgaagagttataggtagaggctacacacctatcctgcctggtgatatctgcctgtccaagatagaatactagttcaactttaaatctgcgcacaaaacactctaaatgcgcttgtagatttatctgctagtccacagaggaacagctctttgagcactacgacaaaaccttgtgtagagagagatanattgatcacccatagagagcctatatgcagacaccatntaagaaagcgctctagctcatcacccactacctaaaagaatccgaaacatatatactgactcctaacacccaattggaccaatctctcaccctatagaggaactaatgtgtgcataagacacatgataacatctttctacgcataagcctgcgtcagatgcactgaactgactatttacagcccatatctacatgatccaacacgtcttattacactgactgtgtaccacacatgtctgctctatggagggtgtt

SEQ ID NO: 705629 - DNA, 172 bp, Homo sapiens
cgggacgaggctagtatcctgtatggaggaaatgtacttgttcgtgctctgtgttgagtaatgcagagccagcacttgctgaggggatgagaacatgggtaagtggtaaattcattcctcatcagttttccacagagaattccacatgtctccactccccgggcagtgttgg

SEQ ID NO: 705630 - DNA, 234 bp, Homo sapiens
tgattgcctgtgtcgaaggcttgacgcacggactttccccgctggccgtgagcgacgcatgcatgtcatgccggatgacgacgtgtattacatcactgatgtgaaaatagatgacgcaggggtttacaactgtactgctcagaactcagccggttctatttcagctactgccaccctgactgtcctaggtttgccaattggtctcctgtgtgtgtgtgtgtgtgtgtgtgtgtg

SEQ ID NO: 705631 - DNA, 658 bp, Homo sapiens
  misc_feature (466)..(466): n is a, c, g, or t
ggtcactaacatggctgatgggtcgaccacttcctgagcagtaagaaagagatgtggagtggagctggtacgctccgtggccctaacactcgaagacgctggacgctcgcagtttcaacaactccgcgtacacgatctcgacacgctatcgtttcggagaaacctcctggagcatgtctcacacacttgacacgcgacagactacacaggatgcgaatgaggcacgcagtccaggacacaacagcacgacacagtccagtaccggactctttccttcaaacaaggtactgaaagccaaatagaaacgtggacagagcgatgcagatcccaacagtgcatgagaaagtcggcccccttaagttggaaacacgggaaaggctgggttcccgttgtccttgggcggagcaaaatttgcccccgatcaaggaacttaatgctgggcaaagttaatacatttctctagagnagacttccgctcaattaacacaatacacaaccaatgttgcttgggaacaaccctaggtagcaccaaaagtgcttacttaaataacccttttcccactagggaaagttttacccaggggaaagggggagggtcaaaaaccaaatcaaagggtcaaaaaagggcaaaaaataaaaaagcccgggccctttccgc

SEQ ID NO: 705632 - DNA, 155 bp, Homo sapiens
  misc_feature (23)..(23): n is a, c, g, or t
  misc_feature (69)..(69): n is a, c, g, or t
  misc_feature (87)..(87): n is a, c, g, or t
  misc_feature (138)..(138): n is a, c, g, or t
gcaagggctcatgacgacccctnctgagcactgttcaaggacggcggctagcattcctcgctgtgagtnctgaacagcagcttctcnaatatgaccgacgtcatgtctggcacccctacgcaccgacgatcggggcanacccaatgcttgcagtg

SEQ ID NO: 705633 - DNA, 450 bp, Homo sapiens
agtaagatcgcatgaacggcaggttatgaatgatgtctgaaatactggccacattacacttgtaagacctccttcataatgtattctccaaggtttggcaagggctgtaatattactgaagacttggtgacaatcattacattagtcaagtttccctataccacggatggctggatggtgagtaagtgtggactgaccaccaaaggctctgccacactcattacactggtacaattcctttccagtgtgaattccagtatgtggggccaagtgtgaatcacacccgaaatccttgtcacaaaccttacattggtatggtttctctccagtatgaatcctgcgatgctgtgcagggtgtgacatattatggaagaccttgccacattcattacattggaaatgtttctctccagggtggatcgcatgatgattagtgaggcttgaacgcat

SEQ ID NO: 705634 - DNA, 404 bp, Homo sapiens
gaccggttacagcttctactaattttaaatatttgttaatgatttctttacttatattctattacaaatatgcaatctattttttaatctaggctacctatattgaagcaaaattctattaggtcattttcagtacaggtttgaggagaacaagaagagaatcaatgttatataattaatgcctactaagcaatagtcatctgacatagataatttcactgaaattcaaaataccttgaagtcaatatcatcttcactgaacgttagtgtcacaagccacatcataagtacgtattggaactatacatcaaattgacatttttcaggacaaaggactaccttacataccttgatttgcattattcaaagatgacagctaaagttgcaaagtcattaaatcctcc

SEQ ID NO: 705635 - DNA, 345 bp, Homo sapiens
  misc_feature (1)..(1): n is a, c, g, or t
  misc_feature (12)..(12): n is a, c, g, or t
natatggagganaagttatgagataaaaagaataaaaacagagactattcaaaggctatgcatgggactgggcactgtggctcatgcctgtaataccagcactttgggaggccaaggtgggtggatcagcaggtcaagagatcaagaccatcctggccaacatggtgaaaccccatctctactaaaaatacaaaaattagctgggcgtggtggtgcacatctgtagtcccagctactcgggaggctgaagcaggagaatcgcttgaacctgggaggcagaggttgcagtgagccaagattgcaccactgcactccagcatgggcgacggagtgagactccatctc

SEQ ID NO: 705636 - DNA, 379 bp, Homo sapiens
cccttttttttttttgggggcccgggggtttttccccccgggagggggccttttttccccccaaaagatttcccccggggcctttttccccaaaagggggtcttttttggtttttttaaaacccccccccccgggccttttggctttccaaaaacacctttaaaaatttttttaattgggggggccggggaattgggggggtttttttccccaaaaattttgaaaaaaacttggggggtgaaccctttttttttttggcggggggttgaaggtttttggggggggttttttttggagggggtttttttaatggggccccctctttttaaaattaaggggtttttcccttaaaaaaaaaaaatttttgggccacccccca

SEQ ID NO: 705637 - DNA, 90 bp, Homo sapiens
cctgctcctagtgacacaggagatagaagttatttaggcagatagtgagggtacgagttcttggcaaggcttcccttctgtcgtcttctc

SEQ ID NO: 705638 - DNA, 170 bp, Homo sapiens
tgtgctaagtacaactgagaggccaggaaagcggggagggtcctagatcagggtcaggaggccacctacagaagcccaggcccaccagtgcccaagcacatagtcagggctcagaacaaggcctacaaccaacgagggttgataggcctaccagttacaagaaactagta

SEQ ID NO: 705639 - DNA, 129 bp, Homo sapiens
tacgtcttcatcatacctacccaccctatgtgtaagtgactgttttcctcttaatttcaaataaggaaaacagtcacttacacatagggttggtaggtatgatgaaggaggtaggtatgatgaaggacg

SEQ ID NO: 705640 - DNA, 471 bp, Homo sapiens
  misc_feature (7)..(7): n is a, c, g, or t
  misc_feature (299)..(299): n is a, c, g, or t
  misc_feature (342)..(342): n is a, c, g, or t
  misc_feature (464)..(464): n is a, c, g, or t
ggcagancaaaaacttttcaataaacataaaagtagagacaccagtttaatgagctatcatatacccatcacatagatttaaaaactattaacatttgcaatatttacttcatttgtttttctgaagtatttacaaaatagttgacagtagttatgtaattgcatcctgatattcatccctacgtaatttactttccctctaaaaacatgagggcactttttatatgatcattgtcatacctaatcaaattaccagtaattccttaatatcctctaagatcaagtttacattcagatgncttgtcctcaaaatgtcatttgtgattatttttttctttgacnaaagatagtaagatctcaagatttaatgacagagattccatgttagccctgatgtctaagctctgtggtccattgtggctttacttgaagtctgaggctaggcgtggtggctcacatctgtnaaattct

SEQ ID NO: 705641 - DNA, 209 bp, Homo sapiens
ggctgtcagtgagttcacctctaatcacacgatcaaaagggacaagcattaagcacgcagcaatgcagctcaaaacgcttaggctagccacaaccccacgggaaacagcagtgattaacctttaacaattaaagaaagtttaaattaagctatactaaccccaggttgggtcaattttcgtgccaggcaccgcggtcacacgattaacc

SEQ ID NO: 705642 - DNA, 1302 bp, Homo sapiens
  misc_feature (378)..(378): n is a, c, g, or t
  misc_feature (402)..(402): n is a, c, g, or t
  misc_feature (447)..(447): n is a, c, g, or t
  misc_feature (455)..(455): n is a, c, g, or t
  misc_feature (463)..(463): n is a, c, g, or t
  misc_feature (472)..(472): n is a, c, g, or t
  misc_feature (475)..(475): n is a, c, g, or t
  misc_feature (507)..(507): n is a, c, g, or t
  misc_feature (519)..(519): n is a, c, g, or t
  misc_feature (543)..(543): n is a, c, g, or t
  misc_feature (555)..(555): n is a, c, g, or t
  misc_feature (586)..(586): n is a, c, g, or t
  misc_feature (628)..(628): n is a, c, g, or t
  misc_feature (682)..(682): n is a, c, g, or t
  misc_feature (686)..(687): n is a, c, g, or t
  misc_feature (722)..(723): n is a, c, g, or t
  misc_feature (727)..(728): n is a, c, g, or t
  misc_feature (730)..(730): n is a, c, g, or t
  misc_feature (751)..(751): n is a, c, g, or t
  misc_feature (762)..(762): n is a, c, g, or t
  misc_feature (773)..(773): n is a, c, g, or t
  misc_feature (823)..(823): n is a, c, g, or t
  misc_feature (849)..(850): n is a, c, g, or t
  misc_feature (858)..(858): n is a, c, g, or t
  misc_feature (860)..(861): n is a, c, g, or t
  misc_feature (882)..(882): n is a, c, g, or t
  misc_feature (943)..(943): n is a, c, g, or t
  misc_feature (977)..(977): n is a, c, g, or t
  misc_feature (981)..(981): n is a, c, g, or t
  misc_feature (1088)..(1088): n is a, c, g, or t
  misc_feature (1239)..(1239): n is a, c, g, or t
agaccggactccagaaacctgatatgaaggaagaggagactctgcgcagagcactatgagtccggagggcgagactacggcggaagcattcccgggcgggtgacccagcatgggtgcctctcgtgattaggattcgccattatatctttctcgctgctaaatcaccgagcccggaagattatagagacctatatctgggattcctgtagacacactcacgcacatacatacatttatatatatatatattatatatatatagaaatacatatctctatattatatatatagaatatatatatgctctctttaaatcaacagagctaatgttataggtgtcttcactggatgtatctgactgctgtggactcgagttgngaggggaatgttcccactcagatnctgacagggaagaggaggagatgagagactctggcatgatctttnttttgtcncacttggnggggccagngtnctctcccctgcccaggaatgtgcaaggccagngcatgggggcanatatgacccagttttgggaacacngacaaacccagncctggcgctgagcctctctaccccaggtcanacggacagaaagacagatcacaggtacagggatgaggacacnggctctgaccaggagtttggggagcttcaggacattgctgtgctttggggattncctnnacatgctgacgcgcatctcgcccccaggggcactnnctgnnantcaggagcctgggcggcctcncttactctacntgctctgagtngcccagaggccactggcagatgtccggcgaagagagagacacattgtggnagaaagcagccatgacagctcccttnnctggactngnnctcatctctcctggtcccttnctgggtgcagctaaaggactatgtctacacattgaaccctagtctgtccccaggagactgntggtgtgggagtgtgactttctcatcctggcttncttncttcgagccagaagcaggcaggatcactccatgtggggcggaaagaaatgttttatcgactattaaatccttttatagaataacagtattataagatagttctttanattctgtaaataatcacttttaaaggacttgctcttgcccttatttcccggttggttaaacagtccaactttttcttacggagacatcttctatacatataattttaacaaattctctccccccgtgtcgacacctttataaagtgatacncactctattttctgccggcgggtgtatatatatatctatattgtataaaaacctcttcttatt

SEQ ID NO: 705643 - DNA, 170 bp, Homo sapiens
ggccggttcctgccttaactgatgacattccaccattgtgatttgttcctgccccaccttaaccgagcgattaacctgtgaacttccttctcctggctcagaagcttccccaccgagcaccttgtgacccccgcccctgcctgccatagcacaaccccctttgattgtaa

SEQ ID NO: 705644 - DNA, 791 bp, Homo sapiens
  misc_feature (2)..(2): n is a, c, g, or t
  misc_feature (21)..(21): n is a, c, g, or t
  misc_feature (791)..(791): n is a, c, g, or t
gnggggctccccaggtttccntctttacggccgggggacagactgttacttgctgttacaggcacaggtgattaatatgctaaatattgtatatttaagctttgttagtatatggaaaagttgaagggaaaatattggaatgcttcttcaaaggttaaaaaataaccgtgtcttttgggattttgatccaacgtgtttctgtgaccatcatgcatgagaccttagagtatagaggaccaaaaccaacctaattgtcaactctccacacgttgttgaggctgtaatatccgcgctctcgctctccccggttgctccccctcgaaattgggtagtcttgtgttgtggttttgttttgcactcttcataactttgtacgcgaatctcaatcccaccctcctctcggtttcgctatcgctctctgggtgttgtcgatatcgcattcttgtcctcccttgtatgcatccctcaccttcggatttctcttgacttttccgtccaatctgttcagtccccgtctataaccaaatttatcgttcttccttctccggcgatgcgcacggcggcgtcggagtgaagtgaacgaatgtgtactgctcattctcttacagcaccatctcgacgtagcgatcttcatataggtgagaactcgtcgatttttaatatcgttgggtattcgcttcgctgttcgtgttgcgtgtttgtgttcgtttgatgtcacggtgtctttatgtgggagaccgcgtatcctcgcccggacgcgccgccttgagctaacctgtcccgatgtgacn

SEQ ID NO: 705645 - DNA, 283 bp, Homo sapiens
gcagatcgacgagccgtggatcaaggcaacgatctacacccccgacgaatacctcggatcgatcctgaagctgtgccaggaccggcgcggcatccagacgggcctcacctacgtcggtgggcgcgcgcaagtgaattacgagctgccgctgaacgaggtggtgttcgatttctacgaccggctgaagtcgatcagccgcggctatgccagcttcgactacgaacagatcggactgcgcgagggcgatctcgtcaagatgagcatcctcgtcaacaacgagccg

SEQ ID NO: 705646 - DNA, 629 bp, Homo sapiens
cgggagctggagtcagcgcagagattgtgagggagcggtgagatacgggacggggaaggctaggtaggtgtaggaggaaaggagggaggagaggacagaagcggagggaggagaggtagggaaagaagccccgggggtgaaagtaaaccggaagttaggggggaaagaaaaggaaggggaaagggaggagaagacgggcgcggaaataaagggagagcagacgtgaagagggggaggaggaaaggttgtggaaagaggaacggcacgtagaggagatgaatggcgcagggaggaaggattgggaagagtattgtttttgttttcggagagaagaagcggagtatttgtagagggaagagaaagaaccatatataggaggagggttgtatttaggaggagaaaaaaagagtatgggagcgcggagaaacagagttaagataagagggagggagattggggggaggaggatgtgtattgtaaggagggggacgagaagaaatttatttgccgacgacagcgttgtgtgagaaggattggggggcgggagtttatgagaggaagagaagatctcacaaaagaagagaggggagggatgagagtaaagggggagtaagaaaagagtataaaga

SEQ ID NO: 705647 - DNA, 189 bp, Homo sapiens; identical to SEQ ID NO: 545746

SEQ ID NO: 705648 - DNA, 634 bp, Homo sapiens
ttatgtcgtctgatagtctgatcttccccgtcaaagcccacccaggagtccaggccatagggaatttacactcataccaaaatttcagtatgatcttcccggaaaatgtctgggaaaaacatctaccactccatagcaaaagatgagcatcgccaagcgtggtggctcatgcctgtaatcccagcacttggggaggccgaggtgggtgtatcacaaggtcaagagatcgagaccatcctggccaacacggcgaaaccctgtctctactaaaaatacaaaaaaattagccgagtgtggtggcgggtgcctgtagtcccagctacttgggaggccgaggcaggagaatgtcgtgaacccaggaggtgaagcctgtagtgagctgtgatcacgccagtgcactccagcctgggcgacagagcgagactccatctgaaagaaacgatagatgagaggtgggtggaggggtgtgagtgaacggccgtcctgatgagatggctccttgcagaggcctcgacggtgatagaaaaccgggccatgaaggatgaggacaagatggagatccaggagatgcagctcaaagaggccacgcacttcgcgggaaaggctgaccgcaaatacgaggaggtgactgggg

SEQ ID NO: 705649 - DNA, 797 bp, Homo sapiens
gcccaggcccgcacttttctgagcagacgtccagaggcagagtcagccagcagtgaccgagcgccgcgtccccttctcgctcctgggggcccccagctgggcacccgcttcggcgactcggtacccagcatagccggcctcttcgtaccgaggccttcggggctggcccccggctggccgggaggagtgtggtcgcagggggttaaggcaggcagcagctgggccaagggcttacgtgcggcccccctgtgccccccggcccgcccatcgacagaagcccccggcacgggggcgcgggctcgccaccggctattaacgaggccccggcggcaggcttcacaagggccgggggaaaatctacaaggacagagccgggggcgggatccctccgggaaccgaacttccgcggcgccaccacaccagtgggcgggaggaaccccgggatcatgggaccagagccttgtttagttccccccggtgggggaattcaggtcccagagccacccaattgttgtggtcccgggccacccccccgggtggcgaaccgacaggaaagcgcacgtgagaacgccgcgcggctccgaacgaggtaaacccccacaaacggacggatatctagtccggcgctggttttgctccaccctgggcgaagggatattccaaacgtccggggggaccacaaaacagaccaaacagcgaaagacgagacacgcccggcgaggcctgagagcaacgacaagaacgccacgagtgggcggctgatacgcacattcacttgcaccgagcggggagtgcca

SEQ ID NO: 705650 - DNA, 156 bp, Homo sapiens
tttttggggccaaaaaaaaaagttttttttttttaattccggggggttttgggtttttttattttttactttgccaaaaaattttttttgggcctggttccgggttggttggggggaattttttttttaaaacctaaataaaaaaaaaatttgcca

SEQ ID NO: 705651 - DNA, 700 bp, Homo sapiens
tatgcgggtccgaggcagtgggaagagatagcgggccctggacatcgtcgagctggcgagaaccgggaggaagtggagtgtgctggagcccgaggaggatttcgagcagtttctgcatcccggtcatcaacgagatgcgcgaggacatcgcgttcgtgtgacgcgctgagcacgggcgggctgtacctgcggaaccggagcaagctgtgggagatggacaatatgctcattccagattcaaagaacgcaggtggaggcctcggaggagagcgccctcaaccatcatccagacccccgggcctgacgcggacgaggggcacggcgcggtccaagaggtgcgagacggggcgaggagaaggccaaggaggattgcgaagatggcagaggatgctggtggagcgtaggtccggcggatagagaagagcgagtcgtcgtgagcgcggtcggcgggaaccagccaatggattctggtcaactggtggagattgggctgacaccctggagaagccgaaaccagagagcctttggttttctctttgggcctgtctatgcgtctgtctcacttaacactacgttttgtgctatggtctgtggttgatgacctccatatgagtctcgactgtaacgtgttttgtgggacgtgctttggttggcaggtgctctccctaccggacttggggctgaatgtaaggctgccgcg

SEQ ID NO: 705652 - DNA, 91 bp, Homo sapiens
tcaagcttctaacgatgtacggggacatgagtttcatcatataagaatgtcattccagcctgggtgacagagtgagagactgtcccaaaaa

SEQ ID NO: 705653 - DNA, 437 bp, Homo sapiens
  misc_feature (396)..(396): n is a, c, g, or t
atttcggcacagctccatttcaaaaaaaaaaaaaaaagggtacaggtatctgcctaagttctaatgcataaggcagtttcttcaatatttcttcaaaggcattattagccactgtatctgacagtcactgtggtgacttccttgaattaatttgaagaatgccaacgtctaatgggaagtgtcgtcttacggtctagcagtcctgttgttcctgggggttttgttctgtgtgccagttgcttctgatttccacagtagacattacatttatttgtgtgtctagtgaatgctcttctcaactaccatcatcaattaggaatttattttttaattttttaaggccgtaggtattcttcatgtggcttgagggcacatgtgggtttcatttttaaaccntacaatttactgggctgggatttgtcttcttttctaggtat

SEQ ID NO: 705654 - DNA, 349 bp, Homo sapiens
taggaatgtctctatttcgtctaagttatctaatttgtcactgtaggccgggtgtggtggctcacccctgtaatcccaacactttgggaggccaaggcaggtggatcacttgaggccaggagttcgagatcagcctggtcaacatggcaaaacctcatctctacaaaaaaaaaaaaaaaaaatagccaggcatggtggtgcactcctatagtcccagctacatcagaggctgaggcagagaatcacttgaacccgggaggcacaggttatagtgagctgagattgcaccactacactggagtgtagtgcaatgcctcctgggtgtttttgagactctgtctcaaaaaaa

SEQ ID NO: 705655 - DNA, 1068 bp, Homo sapiens
ggagagaactagtctcgagtttttgattttttttttagatgtcatttggtgtaagggcgcaaattgctggaacagattgttgatagcgcctaaccatagtgtagatttgggattagggggctatttcggctagggggtggaaccggatgattaaaaaaattcctgtacaatatagggtgcttgagtggagcagtaagggctgagactgggtggtggggccttctaagggctgaggggatgtcacgggtgttgagagacctaatggggctagattgcgcctagctgcttgctaagagagagaggcctagtagtgggggtagaggcttgacataagcgttcagacgggctattgagtcgggggctctcatgacgttcggagttgtacgcgataaatcatgctaaggcgaggatgaaaccagatatccgccaaaaaacggggtgggcatacgagatcggcttgaagggcctaccggcacgtggcgcactccggccccggcgcagacatccaccacaccgctgcgaccaaacgaaggggactataatcccattacgccccctcctccagccagaatgaaccacgctccggcacatcacggcccgcacacgcggcgacacacctaaacagactaacccacggcgcaactcacccgaaaccgcaggagcccgcctctccgggccgacaccccaccacacgcacgcgccactccgccactcaacctcacacccaagcccgagaaacctccaactgtaatgccccccaacgctacgcgcccccacaggcctacccggcatacacccctacacgggacaccgcacacgcaactattgaccgcccccgcacacaccgcgctgtcagaccttcagccccccccgcacccccagacaaccacacccccgacaacagccacctacaatcccgtgcggcacagagcaccgaacacccacgtgctccacaacaccacaacacaggcgcctcacaccgaaccccgtcaacaagcgaaccaccaccacaacacagaccccaaaccacgctgcagcgacgaacacgcgacaccgctacacgacata

SEQ ID NO: 705656 - DNA, 267 bp, Homo sapiens
cccggctcattcgttctcatctcccacatccagtctgcaaatacacacaaaaaacatttttatttcatatattttattttaacagacagggtcttgctctgtcaccaaggctggggtgcagtggtccaatcatagctaactacagcctcaaactcctgagctcaggcaaactctccagcctcagccccctgagtagctggtattcatggctgttcaacaccaagcctggttaattttctttcatttttggccaacactgaacatgag

SEQ ID NO: 705657 - DNA, 120 bp, Homo sapiens
cgtcctgggaaaagattatggcttttacgtaatggattctctatgctaatgctctctcgtctgtctagtctgtctgcccactcccccacccaccacggtgcgtagctgatgggtaccgag

SEQ ID NO: 705658 - DNA, 352 bp, Homo sapiens
gaggatccccgtacaatgataagaggttatgagaagaatattacaatgaaatatccggacatttaagtctggatgtcccacattcgatagctctgtgactggatcggttagtagaagaatagtatacatgcatggaactatctacaaaccaactcagataatcggagtccttcgaggggactagaaagcgtgatgtaagcgaaggagatggatagccgtcttaaactcagagagctactgtcatatcagaacccttgcagtcttagatgttataccaaatatatatctgaattgtaagagttgttagcacaagttttttttttttttttttaagcccttgtttggggtccaa

SEQ ID NO: 705659 - DNA, 363 bp, Homo sapiens
aacttaaatgaaacggaacaatgccttgaaatacacaaactatggccgggtgcggtggctcacgcctgtaatcccagcgctttgggaggccgaggcgggtggatcacttgaggtcaggagttcgagagcagcctgtccaacatggtgaaatcccgtccccaccaaaaatacaaaaatgagccaggcgcgatgcctgtaatcccagctactcgggaggctgaggcaggagaattgtttgaaccagggaggcggaggttgcagtgagctgattgcaacactgccctccagtctgggcaacagagcgagagtctgtctcaaaaataaataaattttttaaaaaagtatatgggaggatgtgtgtag

SEQ ID NO: 705660 - DNA, 651 bp, Homo sapiens
  misc_feature (65)..(65): n is a, c, g, or t
  misc_feature (484)..(484): n is a, c, g, or t
ccctcgtgtacaatgtcttacacgtccacaggggaagcgtttcgtttacttgcaacatctatcancaggcgttcttctatagtgtgatggagtggtacagttagtgtgcacagctcatctacctctttggaagagcctgatcattgtagactgtcaggcacgctatctctatgtgtgccgctgttaggccaatgatgcatcatgagtgcctttccccaaggaaatggcattcaccaagtgcgcgtagaaccgccccactatgttctggcagttatatgttcgccctctggtaacctggatggttgctaagctcccagggataatgggtctgttcgctggatcagaagctatcagcaggcacggtaatcatgtgcctgtattcaataagtcctccggttctttggatccatagctgtggcgagcgtcatgagagcatgatactgtagtgtaggcattgttctggctattcgtgcgggctactcangctgtctgacagcgtcctagcgctatagtcaatgtgctacgtctcatgcattcatagggtgcacaccggcagtttcctcatctgcaggcagtctgtctccatagctctcagtcgtccagccgtgggcattacccaaggctgtgtgatactcaatagcatcaggtcag

SEQ ID NO: 705661 - DNA, 204 bp, Homo sapiens
aggatcttgggagtaagtcaaatggcagcagataaaagtgacgagtggtttgccaacacaataaaccccaagcttcagtgttaacgtgaatgacattatgcatgagcaatgcctctgtgattccttgtccagacactgttagggctgacggtgtcagttcccaataaatgctcttctgatatggtttccgtacaggccaggagg

SEQ ID NO: 705662 - DNA, 426 bp, Homo sapiens
  misc_feature (15)..(15): n is a, c, g, or t
ttgctaaaagagtanattttaaatattttcactacaaaaatgctaagcatgtgatgttactgacatgccaagtagcttgatttaattattccacaatgcaaacatgtattgaaacataacattgtacattaattatatatgattattatttgtcaatttttagaaaggacccagaaggtagtggttatagattgaggtcctatacttggacaaggacagagtcagaggggacacccacaggatgctggcttccaacctcttcatcctatttatgtttccattatatgatatctaaaggttcctcctgggctacagcttacagcttttgttttaagattctcctgtttgatttagaattgactttctcttattccttaccctccttagactgaggagccctcaggagaagatacacaggaattttgc

SEQ ID NO: 705663 - DNA, 1077 bp, Homo sapiens
  misc_feature (325)..(325): n is a, c, g, or t
agcgggttcggtgccggatgcctagaccgcggtcggcatgatcgtctactggaatcgtggtgctgatcctgagcttcgcgtcgtacagcgtcatggcagacgcttagggatgtaagcccgccattactagtcgagcttgtgtttatcccaccgccagagctctgaagtccgcaggcaggagccaactggagtggagtggcgaaaacgcgtgacgtggccactgcgtcgtatcaggatgctggttatggaatatcgactatttgacttctgctcgaatgccagaagcagaacgatgcctggatcctactggatgggtgcatagaantcctctattgatgctacatgtggcgtagccgagatgtgtgagtgacattggcgacctcgaattcagctgttaccgtatgaggaggtcataatccgagtctcaaatagagtggtcgacaaatgctgcaacagcattggcttgaagccccaaagctgaacgatgttggaatggtcttcatgcctatggacttgatacatgaactcgagctcggtgcgaaatggtcagacgccggaaatcaaggcgccttttctatccagtaaacacatcaagccaagggcatcgacagaggtacttccaagaacccatacagctgaagagcattcagcttacctgcaatcggtgttgcagatggtccttgacttggactaacttaatgtggtcccacaaagcgactagtccttctactagtaaccttgaaaagaagaagtgatctttcccggagggtgctacgggtcagcggtggaaacccgtctgtgccttggatttgctggcgcaaatggagataagagggacatccgtggggcaatttgtccaggcattcttggcatgggtcgcgtcctcgtgagaagagttctgagtggcgtgctgtatgatgcccggactggggattcgccattggtcttttgaagtagggcaagacagattgacggtcgattaaggcccatgctgatttcttgggccaataaagaaaacgggggagacatggactctgaaagctgagaaggaacaagggggaagggcgaagtagatga

SEQ ID NO: 705664 - DNA, 585 bp, Homo sapiens
ggcggctgttcacaggattggactatgtaaataaccctttgtaccccacagcaaagatattagggaccgctcaaatgcaagaacgacagcagagctccaacctgagaggaattacttatgactcctgtgagctccatgagaaagacagaggaatccactcacccccgcccctccaaaaggaagtacagcatttttcctatgtatctcagaaggtctcagggttttcagcagtctccttcaatttcctttgtggtcaccaggattggccaaaggacaaacttacacgtttagatttgaagatctcgactagctttatagcgacttctaggattgggcaatgtctcattccataaaatagaataagtgtcccacagagttgagcagaggggattcattttatagacagagggggttgaagaaaccagagagcataagaaaaaatggtgggcttcgtcttttggaagttagctcccgttagaaggtgagaaaaggaaataggaaatagagaaaatgcagatgggttagctcaggttacgtggggtcatttggttgtcaggattaaatagagggaatttgttatccatg

SEQ ID NO: 705665 - DNA, 458 bp, Homo sapiens
  misc_feature (52)..(52): n is a, c, g, or t
  misc_feature (64)..(64): n is a, c, g, or t
  misc_feature (68)..(69): n is a, c, g, or t
  misc_feature (71)..(71): n is a, c, g, or t
  misc_feature (75)..(75): n is a, c, g, or t
  misc_feature (89)..(89): n is a, c, g, or t
  misc_feature (95)..(95): n is a, c, g, or t
  misc_feature (131)..(132): n is a, c, g, or t
gacgcaggagcgcggccactgccgcggtgcgcaggacggtgaggccttcgangccataaaggcnggcnngncacnttccaagttccccnccgcanagattcattgcggaccagctcgaccatctcaatgtnnaccaagaaatggtcctaatcctgagtcgtcacccttggattttatggatcacggagcttgaccatctttacctggtcctggaactgaaagactgtagcttgtgtgaaaatgagcctttggaccagtctttattatgactaaacaaacatgtagtagctcttgcatatctgagatatctagagctcatagaacccccacaatacgttaatagtctaatagctgtcctgtggtttcattagtctgataggaagatagggatttccgtcagtcacagcatgatgttcgaggtgaagctgcaaaaagcccattgcattggaggctttggt

SEQ ID NO: 705666 - DNA, 341 bp, Homo sapiens
  misc_feature (130)..(130): n is a, c, g, or t
  misc_feature (188)..(188): n is a, c, g, or t
  misc_feature (237)..(237): n is a, c, g, or t
  misc_feature (249)..(249): n is a, c, g, or t
  misc_feature (251)..(251): n is a, c, g, or t
  misc_feature (288)..(288): n is a, c, g, or t
  misc_feature (331)..(331): n is a, c, g, or t
  misc_feature (335)..(335): n is a, c, g, or t
agagggctccccaagtcctcatccctgaaaagggactcccagggtcacccccctgaaaagggctcctcaaaaggccccccgaacggggtccccctaagactgccctctgaaggaggcccccgaagacttnccccgtgaaggtgccccccaagacctgccccctggaagagggctccccaagacctctncccctagaagagccccctaagacttttaccctggaaaagggctctctgnaaagctttcctngncgtgcgcctttgagctttggcagatagggaggagctntgtactcgacataatacttaggatctgttgtcctcccgttttncctntcccgg

SEQ ID NO: 705667 - DNA, 911 bp, Homo sapiens
  misc_feature (910)..(910): n is a, c, g, or t
gtggcaagctggttgaacccgctgcggcgccatttatccgcgtctagccatgagtgggctcacctgacaaaagttaagatagagactgatctgcattggcaggccaagatgtctggttcttctgctccgttctactgatcgcaagtatcgaaagcagaacaggtcctgaaaaaggtgaggaacccagggtattctttgtcgggtactatgtcaacacgtcttggtccgttcgccttgtgtagcctggagcaagatcacagcgatgctcgcgtttactcgctgtagtgctcacaggtcccaggcacctgatggcattccctttgccctgagtctgcagcgggtttccttttatgtgcttattcttctcctcaggtaagcctctcttcgccctgtgcactccccggggggtgaaagagtggtttccccgcttttcccaagtggttactcattagttccttgtaagtggcttcacccccattcagtatttagaactgtagctttcgttacactgaaacttgaagatgaatcaaaagaatataccggtcgttttggcatgacacctcgagaatggatgccggcgacaggggacaaggttggattctgtcaccaatatttttcaccaagggtttaacacacgagttcctaaaaaaaagcgtaatcaaattcaaaaagccgggtaaccacgataagaacctaagaaaacagaacaaaaacactgccgcgagcatagcacaagaacagcacacaaaactcttgatacacggagaagcgaacaacacctacaaagagaaatctacgcacaacagagcaagcatcgaaccacaaccacgaccactaaccacgaagacacagcagcacaacacgcaaacgcagaaaaagcagagcaacaagaccaaacccaataccccgna

SEQ ID NO: 705668 - DNA, 325 bp, Homo sapiens
gtcttgttaccaatcagctccacattatattattatatatagagaggaaaggaaatactctcattaacttttagtcatatttccctgatgggacgaagatggccatctgctcccatcagcgccaagctgtttgcaatgggacttagccatcgttggctgaagcatttgagcatgacgactcggaaaaaagaccgtagcttcttttccttgatgtatttgcaagtcttgtattaattgatcgagacttgcagccggcaaccagttttctccgttagaccaatgccaaactccattggtttcaggcatccctgatgggagaagactg

SEQ ID NO: 705669 - DNA, 775 bp, Homo sapiens
  misc_feature (194)..(194): n is a, c, g, or t
  misc_feature (215)..(215): n is a, c, g, or t
  misc_feature (257)..(257): n is a, c, g, or t
  misc_feature (266)..(266): n is a, c, g, or t
  misc_feature (287)..(287): n is a, c, g, or t
  misc_feature (289)..(289): n is a, c, g, or t
  misc_feature (322)..(322): n is a, c, g, or t
  misc_feature (372)..(372): n is a, c, g, or t
  misc_feature (389)..(389): n is a, c, g, or t
  misc_feature (392)..(392): n is a, c, g, or t
  misc_feature (419)..(419): n is a, c, g, or t
  misc_feature (458)..(458): n is a, c, g, or t
  misc_feature (471)..(471): n is a, c, g, or t
  misc_feature (474)..(474): n is a, c, g, or t
  misc_feature (576)..(576): n is a, c, g, or t
  misc_feature (597)..(597): n is a, c, g, or t
  misc_feature (623)..(623): n is a, c, g, or t
  misc_feature (635)..(635): n is a, c, g, or t
  misc_feature (701)..(701): n is a, c, g, or t
  misc_feature (710)..(710): n is a, c, g, or t
  misc_feature (742)..(742): n is a, c, g, or t
gcgttgctgcattgcgccccaccgactccactatgttgaagaaattcgacaagaaggatgaggagtcaggcccgtgtatttaatgaaactcccaacaaccctcggaaatgtgcccacatcctcaccaagattctttatctcataaaccagggggagcacctgggtgaccacggaagcgaccgaggccttctttnccatgaccaagctctttcagnccaatgatctcttacttttcttttgtttttttacttgaccancaaggagangtcttgcattgcagaggatgncntcattgtcaccagcagcccaacaaaagacatgnctgggaaaaaaaacaacaaccggggcccggccgtgcgaaccccccgccanatcactgaaagcaccangcngcaggctattgagacgctacaagaaanaaaccaatgtagacaaaggagcccagtgtctccagctcngcccccgtgtctnccntgcacctgctgaagtgcagctttgacgtggtcaagcgctgggtgaatgaggctcaggaggcagcatccagtgataacatcatggtccagtaccacgcactanggctcctgtaccatgtgcgtnagaatgaccgcctagccgtcaataanatgatcagcaangtcacacggcatggccttaagtctccctttgcctactgcatgatgatccgggtggccagcaaacanctggaagangaggatggcagccgtgacagcccactgtttgncttcatcgagagctgcttgcgcaacaagcacga

SEQ ID NO: 705670 - DNA, 310 bp, Homo sapiens
  misc_feature (39)..(39): n is a, c, g, or t
  misc_feature (75)..(75): n is a, c, g, or t
  misc_feature (243)..(243): n is a, c, g, or t
taattattgtatttatgtagagatgggattttgatgaanttgcccaggctggacttgaactactgggctcaagcnatcctcctgctttgccctcccaaagtgctgggattacaggcgtggcccgcgcccggcccccccaattactcttaaaggtaacatcactattgtgaacctaagatcagctttttgagatgccttttcaggtgtaatggttaatactgagtgtcagcttgattggattgnaggctacagagtattgatcctgggtgtgtctgtgagggtgttgcacaagagattaccttggggaggc

SEQ ID NO: 705671 - DNA, 340 bp, Homo sapiens
  misc_feature (171)..(171): n is a, c, g, or t
  misc_feature (304)..(304): n is a, c, g, or t
  misc_feature (330)..(330): n is a, c, g, or t
atcccactagttacttccccaaagtcttaactcattccagcattaacccaaaagtcaaagtctgagtctcatctgaaaaaaggaaaatcccttctcccatgagcctgtagaatcaaaaacaagttagttatttccaagatagaatgggtgtacaggcattgggtaaatgtncccattccaaatgggagaaattggccaaaacaaaggggccacaagccctatgccaagtccaaaacccgggtaggcagtcattagatcttaaagctccaaaatctcctttggactccatgtttcacatccaggncacgtttgttgcaaagggatgggctnccacagcact

SEQ ID NO: 705672 - DNA, 832 bp, Homo sapiens
  misc_feature (757)..(757): n is a, c, g, or t
  misc_feature (766)..(766): n is a, c, g, or t
  misc_feature (829)..(829): n is a, c, g, or t
ctcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactcccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagttctcataatcaacaagatctcctctcctcccaagcagtaagctcccttctccttccaggattcaattactccatgccctctttataaaaaatcccaaattcagtcttaccagaagtgcttcctcaacccagcatccttacttcccgnatcctcttncctttctactcattctttcactggaatcctgggacacgtcaggcaccactttcccaaaatttnctt

SEQ ID NO: 705673 - DNA, 215 bp, Homo sapiens
  misc_feature (154)..(154): n is a, c, g, or t
  misc_feature (178)..(178): n is a, c, g, or t
acctggctaggctcacacctgtaatctaacactttcagaagtcacgtcagggtattacttgagctcaggagttcaagaccagcctgggcaacatggcaaaaccacatactctacagaaaaattagctagggcgtggtaggtgtgtgtctgtagntcccaactattcagtgattcaganagatagagacggacgtaccgagcttcgaactatcgta

SEQ ID NO: 705674 - DNA, 161 bp, Homo sapiens
taattattttctagaccgcaaatagatgtgatggccccttcagttctaatggtactagtgtaagtaaccgtgatcgcctcttgaatctcctgattgatgtattctacccctacaggctaaaaaagacggtttgccagctgtccatcaggtaacacgacatg

SEQ ID NO: 705675 - DNA, 173 bp, Homo sapiens
tccccccttaatatccctcttttttttttttgttataaaacccctttttggtccccccgggggggcccggagagcccggggcggggaaactcgggcgtggggtctctggacgaagggtggctcggggcaccctccttgtatggggagcatgtgggtgactatacgttctcctt

SEQ ID NO: 705676 - DNA, 1247 bp, Homo sapiens
tgtgtaggtgtgtggtccacgagtctctgtggctgttgggtgggcgcgcccgtggtgtcgggttgctgccggccgccgtggggatgttccgagtggtggtgcctgacctcgggtgccagagtgggtgcgccgtgtgctagagaggggggtggtgacggccgctcgtgggtaggaggggtgatccttgctggggggccagacgcttttgtgtgcggcggattgtgtgtccggccggggcagatccggcggttgtatttttaggggggggccgtttcattacggggggagattgcatgacggcgtcgttcggtctgtagtgtgtgaacgtcgttgctcggttggaggaagacggtgtcccaaaacatgggtgtcgctgataatccacgtgtttgctctcgtctgtgggggcacaacatatgttgggggttccagcccccgtgctggtgtgttttgtaaatccggagggtttagcttccaacatgatggcttcgggttctaaacatatggtgtcgaatttaaggatgtgctctgtgttgtggatggtaaatgcagcgcgtggagtggcgggcttttgaaacctttgggggacaccccgttgtagagtcacatgtgagaatatgtcgcgcgtgggcacacagaacgcacggacagctgcgtcttgtgctctcttcgaggtcggcatagtgttctcacaaagtggcacttgtgagattccagcgcgcctctcacatgccgtctgtcctaagtatatgctcggagtttcttgttgccaccgcatggaaaacagttcttggtgtggcacaccacgtgtttaaggaggcgtccacagggggaacacagtgccagtgcctgcgtgcattccagggctctccacggcgaggtgtcatccgagaggagccgccgagctttgcagaacttccgagaagtcataggtcccgcacacttctgattatcctttgtctgtgaactgaataccacttcccgcaccgcttctggggacacccacaatggcgacggctggtggcacgcactggagggtcactcattgaacttaacgtgccactgctcttgtgggacgtctctcgggtccggcaccacctgtcacgtaccactcatggcatcactgggcccacaataaggctaggggtcttcctggagtatagattctgattgtagttatatgttttggtattctgtacaataaagtatttattgtcaacagcaccaataaatttttttgatttgta

SEQ ID NO: 705677 - DNA, 906 bp, Homo sapiens
tctgtttgtgggtatgtcacctgttgtttttttgcgtcgcgggtgtgttggtgttgcgtgtctgtctacgtgtgtgtggtcccgtctgcgtaccactgggctgggggtggtgccggtgtgctcatgtcgacgtggccaatgtccctcgctccccttccgagcctgtgcagtctcgcgcgcacgccatcctgggactccccagtccctggcctgatatactttaggaatatggattcttagacttctgtccccccccgtattaaacgccagcatccttccccccagtccttggatacctcttatcagggaaagtcttttcctatgaagccatccatgatttgaaagaagagacagtacaccagatgcacaaatatgagtgtaaggatataagaacatgtaaaagccaggaaacaggatgcctctgaaggaacaccgtaattctctaggaacaggtttgaatgaaaagccatacctgaaaatgccccaaaaagagattttaaataatgttattagaccagttccgtgcgatacaagagacatagaccaactgcagaatacattttcttgtcagcacatgaacattctccaggataggccatatgtttggccaccaaatatatctccaccaattttaaaattaagataatatcacagtaccttttcagactaccatggaataaaactagaaataaataataataccgagaaatcagaaaaaccacttatgatctgagtaagaaattcacacagagatagatatcataaagaaagaacccaacagaaatactgggactgaagggttccatgaatgaagttaaaaatatattgggaggccgaggcgggcggatcgcgaggtcaggagatcgagaccatcccggctaaaacggtgaagccctgtctctacta

SEQ ID NO: 705678 - DNA, 453 bp, Homo sapiens
  misc_feature (1)..(1): n is a, c, g, or t
  misc_feature (11)..(11): n is a, c, g, or t
  misc_feature (37)..(37): n is a, c, g, or t
  misc_feature (39)..(39): n is a, c, g, or t
  misc_feature (41)..(41): n is a, c, g, or t
  misc_feature (72)..(72): n is a, c, g, or t
  misc_feature (88)..(88): n is a, c, g, or t
  misc_feature (98)..(98): n is a, c, g, or t
  misc_feature (101)..(101): n is a, c, g, or t
  misc_feature (112)..(112): n is a, c, g, or t
  misc_feature (123)..(123): n is a, c, g, or t
  misc_feature (126)..(126): n is a, c, g, or t
  misc_feature (128)..(128): n is a, c, g, or t
  misc_feature (148)..(148): n is a, c, g, or t
  misc_feature (151)..(151): n is a, c, g, or t
  misc_feature (153)..(154): n is a, c, g, or t
  misc_feature (162)..(162): n is a, c, g, or t
  misc_feature (184)..(184): n is a, c, g, or t
  misc_feature (193)..(193): n is a, c, g, or t
  misc_feature (198)..(198): n is a, c, g, or t
  misc_feature (287)..(287): n is a, c, g, or t
  misc_feature (298)..(298): n is a, c, g, or t
  misc_feature (300)..(300): n is a, c, g, or t
  misc_feature (307)..(307): n is a, c, g, or t
  misc_feature (312)..(312): n is a, c, g, or t
  misc_feature (328)..(328): n is a, c, g, or t
  misc_feature (330)..(330): n is a, c, g, or t
  misc_feature (333)..(333): n is a, c, g, or t
  misc_feature (344)..(345): n is a, c, g, or t
  misc_feature (368)..(368): n is a, c, g, or t
  misc_feature (371)..(371): n is a, c, g, or t
  misc_feature (373)..(373): n is a, c, g, or t
  misc_feature (376)..(376): n is a, c, g, or t
  misc_feature (396)..(396): n is a, c, g, or t
  misc_feature (398)..(398): n is a, c, g, or t
  misc_feature (412)..(412): n is a, c, g, or t
  misc_feature (415)..(415): n is a, c, g, or t
  misc_feature (417)..(417): n is a, c, g, or t
  misc_feature (425)..(425): n is a, c, g, or t
  misc_feature (437)..(437): n is a, c, g, or t
  misc_feature (439)..(439): n is a, c, g, or t
  misc_feature (441)..(441): n is a, c, g, or t
  misc_feature (446)..(446): n is a, c, g, or t
nctgatatttnagaaacgcgatgtctctgtagctccncntncactgcccgggtattgctctgtatttatcancgatgccccgctgtcnccatgccttnccnaattgtccacnatggtggaaancgncntgtaatatgatcaggacccnccncnngttcgtcngaaagtgtgacagtgtccagcnggttctgcngcacnaggggagggggcagatggtggttgcatggccttcctgggtctccactctccgtctggccgaaaggtgatgtatttggtgtttggccctncagtccccgcncntgagccntaagncgcatgtggcacaccncnccntccagcagtanncgctttactgttacctgtttagnccnanaanttttcccgcatctgtaaatntnatttaaaatctaanccntnaatatgcnttatttattaanananttatncggattt

SEQ ID NO: 705679 - DNA, 502 bp, Homo sapiens
tatcatgattatatgtgtagatcgcagaccattatgaacagagcaataatatatgaacagcaaaataccgtctcgtccttacctcataggcacatttaaattattctagcactatacgagaacttttcactctcagaaggggtaactactggagttcagaaagcatttaatggcctgcctcctgcactgaaagctgctctgtgcagcacagaactgtactcaacctgattgaactcccacggaggggtaggcttccaaacgcaactgaatttcattttggtgcagcacctttctgcctcaaggccttagctttgatagctttagaaaataatggatatggtaacactatgcaggtaagacatggtttaaccagtggctcagagatttaagcccaattggcagtgtttggtgttagaagtaatctttatttcttgtaagcttcatactaagtacccattcaccaaatcagagggcactgaactctttacccctcagttatgga

SEQ ID NO: 705680 - DNA, 149 bp, Homo sapiens
tttttttcccaaaaaatttttggggggggggggggggcccccccttttcccccctttttccccttttttttgggggggggggtccccccccgatgggggggggggccccccccggggtttttttcccaaatacccgtttttttttttta

SEQ ID NO: 705681 - DNA, 529 bp, Homo sapiens
  misc_feature (78)..(78): n is a, c, g, or t
  misc_feature (97)..(97): n is a, c, g, or t
  misc_feature (123)..(123): n is a, c, g, or t
  misc_feature (128)..(128): n is a, c, g, or t
  misc_feature (164)..(165): n is a, c, g, or t
  misc_feature (179)..(179): n is a, c, g, or t
  misc_feature (186)..(186): n is a, c, g, or t
  misc_feature (206)..(207): n is a, c, g, or t
  misc_feature (224)..(225): n is a, c, g, or t
  misc_feature (228)..(228): n is a, c, g, or t
  misc_feature (272)..(272): n is a, c, g, or t
  misc_feature (351)..(351): n is a, c, g, or t
  misc_feature (353)..(353): n is a, c, g, or t
  misc_feature (429)..(429): n is a, c, g, or t
caaaatgttcaggctacaatagagtattaagcgtaatgttcattttatgatttgtggtacaaatggataatctttctnaaatgtcgctttgatttcngggataatttatttaggcagtaagtngaatnaatttctggcaccccttgagtccctcacaagtttcnnctcttaggaaaaanaagccgnttttcttttggatgaaaaanncaaaaaagaaaaaaatnngcnaacaggaaagaaaaagaagaaaatgccaagacggcagccgttcntgaaggatgtaatgggccaaacaacatccagaaatggttaagtagtacggaaattatcaaatggccaaaacaaaatttntnaaaaacggagggggaggtaaaaggaaaaacaagaatggaagtattgcattacaattttggaaacagaggcctggcnggccgggggaccaaccacaggagagccttgcctttggaacaaagaccaagaaggtcggaaaaccataccaataactgaaaagccgaaggaaatgatcaaa

SEQ ID NO: 705682 - DNA, 481 bp, Homo sapiens
accagcatggggtttcgggggccggtttgcgtttgcagagtttgcaagtctctttctgttttttcccaaacacagcaggttaatggcgcccgggactcccaagatttggttgcaaaattaagagcttttcttaatggggcccgggttacccccgaacgtaaaaatttaaaatggattggttttgatttgagcaatggtaaccctcgagcccccaaccaagcgggggggtttgacccccccatagttaaagttaagggtttgaaatttgcaccagaagctgcaatcccccttttttgaattgatgttttttttaaattcccccccgaaagtaaagatgataaacatgggagttatgaaaatgctgttccttttggggcccttaatgtttgttttgatgttccttttttttttaccaattttaaatgcaatttttttgtcccgtgagttgggttttacccattaaagtaaagtccaaccggta

SEQ ID NO: 705683 - DNA, 149 bp, Homo sapiens
cagggctcatcactctgcactctgacataactgtacaaccataaaactcagacctacagggggatcacgagcatgtagatgatcggagcctggaaaatgcagctgtatatgtatcttcacgacttctccctgcttatgtgtgtgacttc

SEQ ID NO: 705684 - DNA, 463 bp, Homo sapiens
tgctgtagaccggtcacaccatgtggtccaggctggtctcaaactcctgagctccagcgatcctcccagcttggtgtcccagagtgtggggtcttaggtgtgagccatcgtgcctgtcctgtttttcattttaatggtgtgacatgtaatgtataatgtaccctctaaagcatttgttagtgtccagtttggtggtatcaagtacattcacatgatggtgcaatcgtccccaccatccattcacagaagtctttcaacttgcaaaagggaaacggtctgcatgaagcaatcactatcccttccttcttgcctctgccccagctcttggtaaccaccattctactgtctgtctctatgcagtggtctactctagtaacctcatataagtgaaatcacgtatgagtctgtctgtgactggcttataacagttagcataatgtcctcaggtgttatccgtgttata

SEQ ID NO: 705685 - DNA, 495 bp, Homo sapiens
  misc_feature (146)..(146): n is a, c, g, or t
ctgaagtgtgagccatctcgcccagccctgttttggttttagaagttgacttctcgccgggcacagtggctcgcgcctgtaatcccagctttttgggagttgaaacaggcggatcacctgaggtcgggagttcgagaccagcctgnccaacatggcgaaaccccttctctactaaaaattaaaaacttagccaggactggcggcaggggcgctttataatcccagctataagggaggctgaggcattagaatcacttgggctcgggaggcagaggttgcagtgagccaagattatgccactgcacctttaagcctgggagacagagtagacactgtctggggaaaaaaaaaaaatatctggtcatgggttgcatgtgcctgtaagtccccaggtacttgggaaggctgaaggtgggaaggatcacatgagccagggaagtcgaggctgcagtgaagctatgattgtgccactgcactccagccttgggcaacagt

SEQ ID NO: 705686 - DNA, 318 bp, Homo sapiens
aatccgggccctttttttcccgggcggggggtttgggttaaagcccaaaaaaggaagaaaatttaccttcctttttttccccaccccccccaatttccggggtttaaggccccaaattttttcccatttttttgccgggttttttgcaggaaccggggttttccccttaggcccggggggggttttttttaaaaaaaaaatcctttttttagggcgtttttttcccccgggtttttaagggggtggttacccaaattatccctccgccaggactttgggggggccaaaagggaaaaaatttacccccccccttttgcg

SEQ ID NO: 705687 - DNA, 100 bp, Homo sapiens
  misc_feature (39)..(39): n is a, c, g, or t
  misc_feature (56)..(56): n is a, c, g, or t
tggaaatgctttccactcttgtggcccaggctgaagtgnaagggggtaatcttaancccccaaaacctctgtctctcggttccaagcaattctcctgcct

SEQ ID NO: 705688 - DNA, 457 bp, Homo sapiens
acgtgagacgaccttgcagcctgcattctgggctgctgtattctcccttgttgctatctgacgagcacagcatgggctcagagtacagacaggaggaaccagctaataaggagaggtctagggtgaaggctgttgccttgtggaagaagagagaggtctcattctaaagggatggcattggaagttcatagtgataaagcaaagccaacaggttttggggctgagagttaaacacacagctctggtttctgccttttcacagtggtgatgaaagagcactgagagcctctcgagctaaagttgtcatcattgctcttcatagtctgaaggtgcatgaaatggtcaactttcttccaaagtgcttttatgcctaagcctgtggttagtgtataaacagatatttactgaagtcctgctgggtgcagacactgtggccagccctgaggctacagtcaag

SEQ ID NO: 705689 - DNA, 124 bp, Homo sapiens
cggcacttatcgtgtagcacacccttctgacaaaccgaactgcgcagaacacaagatgagactggcatggctttatttgttttttattgttttgttttggtttttatttttatttaattatggg

SEQ ID NO: 705690 - DNA, 107 bp, Homo sapiens
ccttatggcgctgacaggctccaaacaggcatgcagtgcttggaaagccccaggtactgtggccaggttcacatttggccaagttatcatgtccatccgcaccaagc

SEQ ID NO: 705691 - DNA, 830 bp, Homo sapiens
  misc_feature (684)..(684): n is a, c, g, or t
ggtcttcttgtggacagcgtctctcctcctcctccccccgcgtgcgttgggctatgacaagtatgtatacctttctcctgcgcgacggttcttcctctgcccgcgtgatcttgcacgttccatttgtttgttcctctccgcggcggaagagttgtgcggctgcggtgcgtcgactccacctctaccaccactgctgttgtgcgtcctcctgctgccgtggatgatttccttcttctgctggtggatgatctcccactgttgctgcctcctccttcgttcgtcccccaccagcggatgtgtgttcgtcgctcttgttctactagcccgccgcggcttggtcgctcatcccgccgcagtaggataccatcgtcgtcggggtttttccttcccatcgggtccctctcccgtcgagctgctccctgcgcagggctcagcacaccttctcttctttctcacccgtctggtctctcgataatgtgcttttgcgcgtgcagagtattttcttgcgccgcctgcacgcaatcatatgcgtttcgcgtccccccgcgccggcgtgcctgtgggaaaactacgcgccgtttttccacccgctgtttcctaagggtaggctcatatgttcttcccattgccacgccaccacggggtgttctagccgctcctggctattctctcgactagagcgcncgcgggcatgttcacgccacccacgtggttgcgccccccaaccgttgttgttatgcaggtgccacggaggcccttgcactccgcggtgcgtccgcccgcgattgaatcttctctccgggcgcccccgaaaacaacaaacatgacaa

SEQ ID NO: 705692 - DNA, 259 bp, Homo sapiens
  misc_feature (19)..(19): n is a, c, g, or t
  misc_feature (62)..(62): n is a, c, g, or t
  misc_feature (124)..(124): n is a, c, g, or t
  misc_feature (143)..(143): n is a, c, g, or t
  misc_feature (212)..(212): n is a, c, g, or t
cccaagttaagctgctcgnagctggaagtgagaggcaggtggcggccggggccgaagccagnagtgtctaaacccccggagccatcttgctgccgacaacctgctttcccctcgccctagggtncccttgccgccctccctgncagtatttatggcctcgtcctccccaacctaggacacgtgtgagctgctcctgtctctgctcttattgnagctccaggcctgacgtttaacggttttgtttttactggtttgtgtt

SEQ ID NO: 705693 - DNA, 135 bp, Homo sapiens
ggtagagggctccagctcctcaatggtgttcagggctggtgcgcactggaggcacctgtgcactcagccgtcgatacactggtcgattgggacagtgaagacgatgtggttttcagggaggcccagagatttgga

SEQ ID NO: 705694 - DNA, 350 bp, Homo sapiens
  misc_feature (12)..(12): n is a, c, g, or t
  misc_feature (50)..(50): n is a, c, g, or t
  misc_feature (205)..(205): n is a, c, g, or t
  misc_feature (208)..(208): n is a, c, g, or t
  misc_feature (234)..(234): n is a, c, g, or t
  misc_feature (240)..(240): n is a, c, g, or t
  misc_feature (272)..(272): n is a, c, g, or t
  misc_feature (304)..(304): n is a, c, g, or t
  misc_feature (316)..(316): n is a, c, g, or t
cacattcatttnttaaaatgatgtaacatagagataataattttctacanaaattagccaggcatggtagcgcatctgatagtctcagctactcaggaggctgaggcaggagaatcaattgaaccgagcagacggaggtgagctgagagctgagattgcaccactgcactccagcctgggtgacagagcaagaaaataataatantantaattttcaaaatgttaggcttgggngccatngcaagccactttgggaagccaaggcaggtagnatttgtagcccaggggtttttagagcagcctngggcaaaccatnggcaaaaccctggttttctaccacaaaagtttaa

SEQ ID NO: 705695 - DNA, 183 bp, Homo sapiens
catggatttgctggtgcagtacaactaggcttaatagggacatggtggtgcatgcctctaatcccagctactcaggaggctgaggcacaagaatctcttgaacccagacgtggaggttgcagtgaaccaagatcacgccgctgcactccagcctgagtgacggagcgagaccctgtcccaaaa

SEQ ID NO: 705696 - DNA, 1416 bp, Homo sapiens
  misc_feature (208)..(208): n is a, c, g, or t
  misc_feature (1161)..(1161): n is a, c, g, or t
agcgtgtcgcggcacccatgatgcaaggcctggacgacggcccggacttcctctcagaagaggacctgcgcgaacgggactctatgctctgtcgctagcgctggaggtgcatgtaggtgcgtaccattgcactctacgtagcaaactctctggcttccacaagtttacgaatgcatagtcgtctctgcctcatgactcgtcctccagntagctagggacttacagggtgcacggcctaccactgccccagttaatttttagtctttagaggctagacggacgaagttgtcagcccagtgtgtgggcacaaggatgggtccttgaatctcctgtgacgtatacagtgaatcgcacctcgtctcgtcagcgcgtcccgcatcacggtgcctggggagttgaccaggggttggtgaggcccaacaaattcgatcgcatggcgtatcaaacctttacataggcaactaaaatgataaggaatgcgtatcaacagcttgaattgacctgcctcccttgccaggattgcgcacaggttctcctgagactgccctgcgttatgtgtgaacgccggggtacttaattacgcttacacaaagtctcaccttgctttcattcaactaacaaggaacggtttccactttgtccccacaaagttgttttcccagaccagagaacaagcggagggtttgttaccacgaattttgcttgttctggggcctaataacccatttgggaatgcgcggaaactttttggattcttttgcgcccctgttccacattggcaatttctccgttttatgctcttccgtcacatccttgttgcgaccgtaacacctttcctggtcccccggggtttgaacgttaggttccacttttccccgaggcccaaggcgcgaaccctagatcacaagaagcgaccccctggaaatttggccctggaattagcctttcccaccggggcggacatagggaaaccgctcatcgagcggaacacgtgcgcttttgccgatgttggaccccgccgacacgcaacagcggggcgggtcccaatattggaactcgcaaaacgcggatagcggaacacttttccacctaggaagaggcgaatgtgacaggaggcccattgcggagagaccctttggggagaaaaagccccggcagggnctccgggaacatataaaccaaccgacggagaacaatctcttgtgggggcggttttataacttctcgtttaacactactggctttaaaaccatttcccaatttcccttctcattggcccatttcccgtattcccttgtgctgcgcaactatgagttactgttctcacacctcttggacgattttgcatacttaaaccgccttgtcaatgcacgtgacacggacatttctccaacaacccttttcttttcccaccaa

SEQ ID NO: 705697 - DNA, 122 bp, Homo sapiens
gtgagccactgaggccagcccagatcatttcgaataataacagttgtacttacttacttcttaattgtaataatttaacccccctttttctcgcttcattgtattgactaggtttacacgcg

SEQ ID NO: 705698 - DNA, 114 bp, Homo sapiens
tcccgctctccagtcgcaacgtgttgctcccccgttccgggcaggtcaccatattgatgccgtaacttagatgcggacatccgatcggcatagcgcactacagcccagaactcc

SEQ ID NO: 705699 - DNA, 923 bp, Homo sapiens
  misc_feature (652)..(652): n is a, c, g, or t
  misc_feature (752)..(752): n is a, c, g, or t
tccaaggttcagttccctttaatgacccccatctccctgaaagggcaggtgcaggcagctaggtaatggcaaaaaatgttcatttgaaaatcttgccctgattgaaggcttggcccacttgctggaaggccccctcccaggaaaagtatctctcaaaccaggcgttcctggggttccttccctcgcgtgccaggactccagtttcccgccaggtgtgttttgactcgttagtctccacctgttgccaatctcgtggacctcagcggaaaggcaagcctccctgtggccctcggaagacccagacctccaaaaagtggagcgtgcttattgtggtgggtctccaaaaaaggagtgacacgtggcggagagagcttttctctcctccgagctgtgtgtctccccaggctcgactgtggaacacctatctcccgagggtgaaagtgaagatatgtgccaggctctcaaagtgaagagggctcctgaaaggtgaagtttcctctcgaggggacaagccgaaatcacttctgtgaagttcaccccacgagcggcaccaagccggctcccctttattcacagagtgtgctctccccaggaaaaatttttggggcagggtgcccacgagcaggaggtgtgttgctcccctcgtatgggnggcagctaaccgtggcgcccttaatattcactcccaaacaacaaagggtccctctggcggcgcacgtgttgacgcagacatgggggccccccttgtggcnctgtgggggcctcaaagacagccacaaggcgcctggttctccaaactttcaatcgcaatcgtccatcactcaaggaagccgggggggcagcccggccttttttatctccatccctttccggatccagcccgtggggggcctcctgcctccttcttcccggggaaccccttg

SEQ ID NO: 705700 - DNA, 327 bp, Homo sapiens
cccaagtagcaggactacaggtgcacaccaccagaacctgctaatttttaaattttttgtagagacagggttttgctatgttgcctagtctggtcttgaactcttggcctcaagctatcctacctcagccacccaaagtgctgggattataggtgtgagccattgtacctggcccccgcactagcccctttttttttttcagtccttaaaaggttggtatagatcaaagattatctgtgtctttgtaggtttgatactacttgcctgagaaaacatcttgggtgttagaatctttaaaggtgtgtggggggggcagaataagcaatt

SEQ ID NO: 705701 - DNA, 230 bp, Homo sapiens
gcaaggaaccaaagatcgtggcgcgctatacgaaaaagccaaacttcccttcatctcatacgccatagtcgacggcaacctcgtcgccggacagaatccaacatcgaccaaggagacagccaaaaagctcgcgtcgcttctccggtagatcagcggctaccccaaacagccgcaaccggccgagcggatgaccgaagccgtgcggcgggcgttaacgccgtctgcggccg

SEQ ID NO: 705702 - DNA, 851 bp, Homo sapiens
gtagtcctttgaacctaggacatgtttatccatctattacaaagaatgttggctgagcatggtgtgcatgtgcctttagtcgcaggtcctcgaggggctaaagtgggaggatcgcttgagcctggaagttgaaggttgcacggatctatgatcaaaccactgcactccagcctgggcgacagagcaggacatctggctcaaaaaaacaaacaagggctttatcagggggttgcgtggggaccataggctccgcttccgagaatgagaggtgtcacaagggtgtctcgtctgaaaaccattctttgtcggaaagtggtttgggcccaatggcgttgttaggatattggtcccgggaagaaatcctctttaagaaatgcgaggcggtgtccatctactctgagagcaggaattgagggccctttttggataaggcacaagaaggctgggcagaatcacgaggttcaggggcatgatcgaggagccagtcggggtgttgaactacggggtgtaagcgctgggttgctgttgtaaagtatttgcaggcctgatagagtggcccaaaagactaaggaacaaatgtgggacggcggcggcacaagtcgaagaagaaaagtcttctccatgaagcaaaagatgtgagtggtgcagccccacatagggagttgaagcacgggccggacaagagggacgcctcgacgaaaggcctgggcacagacaacaggtcgggggatacccgccaaaaaaaaagccgccggtgaaacacggtgcgggtaaacacacccacggaggctgggacgcacggtgttccaacgacggaccggcagtgaataatatacgcagtggggggagag

SEQ ID NO: 705703 - DNA, 634 bp, Homo sapiens
  misc_feature (521)..(521): n is a, c, g, or t
cccagatggcacgaggaattcgtcataatcaaggaaaccttatccgggtggatatctgtgagattactgagtgtgcatccatcattaacctgatccctggctgataaacactctcaacggaaacgaatgacatatccccagatctattgagcagcactgactagggagcagtgctacccgcactggtgcatcgcacacgatatagcttggtgcaggataatggacattgataatatggtgggcctgcacctggccgtaatgctgaacccgctgaatggctctgtgaactttgtattgcctttatgctgacctatgtgaggatgagcttataccatcatgtgaataatatgcttaaatctatgtattgagaacgatgatggattcgaatggcaacagtccatgatatgcaatggctacattgtcatacaaagtgggaagccaagaatgcgatcaagcaagcttatcatggtcgtaagtagaatagccgcctttttagggtttgtgccaatgtggacatctgncgaatgtctgctggagcattccagagaccagaatgagtgtaagaatcatatcctcgatcagagtgctgacggagctggagatgtcatcggctacccgcgctggctatcagagc

SEQ ID NO: 705704 - DNA, 269 bp, Homo sapiens
  misc_feature (157)..(157): n is a, c, g, or t
  misc_feature (190)..(190): n is a, c, g, or t
  misc_feature (210)..(210): n is a, c, g, or t
aacacagagctgacagaagattgtgagatcaagcaccttggacaaagtctcgactgcaatgctaacgtgtacatgagaccttgggagaacaaagtcatcccgactgtgaaatgccaagcattagataagactattcctatccgaagaggcctccagnttttctcctttccggtcagccaaagtacaaganacaaaagcaggaacaactangctcctacgcgcgtgcacgtacaagggcagactctcaaaggcaggggcacagcacgcgc

SEQ ID NO: 705705 - DNA, 291 bp, Homo sapiens
agctcccaactgctttgggaggccaggcgggaggatcgcttgaggccaggagttccagaccagcccaggcaacaacaagataccacatctctacaagaaataaattagccgggccctgcacgcgtgtagtcccagctactggggaggccgaggccggaggatcgcttgaacccaggagttccaggctgcagtgagctataattgtgccactgcactagagtctgggtgacagagacactgtctgaaaaaaaaaccaacaaagcccttagctcttattgcccaggctggagt

SEQ ID NO: 705706 - DNA, 214 bp, Homo sapiens
aacacggacacacacattattgttaactatagttatttaaaaatacaagggatttggactgaaagccagtagaactaataagatgattcagttaactgcctctttactgaataaaatattaaaatcccttactcttttaaatatgagtaataatgatttcgactatgtaatagaaaatagagttaggcaacataaggtattgggcgtacgagga

SEQ ID NO: 705707 - DNA, 732 bp, Homo sapiens
  misc_feature (131)..(131): n is a, c, g, or t
tttagagaaactgcaactggcatgtgattgagtgcttctgtggattctcacttctgtcatctagcatgggtcaattacacgctaataaacaaggtaggactgggtacctcgatgtagcattcactttgtgnttatacaaatctcgcggagacgtcggtctaccgatctggcatcaggacttactagcgtggtcattaaaagggctgatgaaggcatctcgtgtacagggtgccatttctatcactatgagtggataacgtgtgatattcttcgtgtcagatcacatgtaaatgacctccctgttggacgctctgtggatgagactttgatgactagttcaggccttccaggttcgacttgacacaatctatggaggatatgtgttgccctagctgtgctaggaaatcgcgtggcgagatgataccatcaagccgtgatgtccaatatagagcgaacacgaatagtttctccaacgcagaagtgacgcgcgcgctgtttagtgccaggctgcggtgggcagccatgagaacaaaagctcttctgtattgggggggccattagtacaacaccagacttcagattcagccgaatggtggtgtcttacaaggcaggcctttcctacagggggtggagagaccagcctttcttccttgggtaggaatggcctgagttgccgttgtgggcagtgctactggttcgtatgatgtattaagtagagcacccattaaatct

SEQ ID NO: 705708 - DNA, 506 bp, Homo sapiens
ccgcgggcggggacatgcagaaagaaaccaggtgatgcagaaaaatgggagcaatttggcagtctccagaaaaccagagcacatggtcccaataactacagctaaaaggtaaatgtcagtatttggaagtttccttatagcagtaaactctgaacacttcacatataaactatgccttgctttagtttagtggcagtgagtaaaaaaaatctgtaccgcagtggcaaggaaaaagaaaatcaaaaacagaccaagaaaatagtttaagctgggcgctgtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgaa

SEQ ID NO: 705709 - DNA, 389 bp, Homo sapiens
  misc_feature (17)..(17): n is a, c, g, or t
  misc_feature (19)..(19): n is a, c, g, or t
tttttttttgagacggntntggctctgttgcccaggatggagtacaatggcacaatctcggttcactgcaacctccggctcccaggttcaagtgattctcctacctcagcctcccgagtagctgggattacaggtgcccaccaccatgcccagctgatttttgtatttttagtagagacagggtttcaccgttctagccgggatggtctcgatctcccgacctcgtgatccgcccgcctcggcctcccaaagtgctgggattacaggccattttctttattaatatattgtagtcctctttccatatcagcacatgtagatgtagttagttattgatttgaacagtaatcctctgtctgtatatagattcattttaaagtcgacgcggc

SEQ ID NO: 705710 - DNA, 451 bp, Homo sapiens
gagagggggaggcagtaggatgggctggcatggggatcattgggaggggggatggggaagagagagagccatgacactgatttctggccagtgggcaaggctgagtcatgtctatgtctcaaaacatggtcacctcctcagcctcctgattcttctagtgtgtgcgtcccttagagtggtcagttcctggcttcagtgggaacctatctgagggaggcgcaagtctatgtcctcccttctctcgggtcttctcctcccacagctgcagcactttggctgctccttaagtggaacaggacgtggagctgtgacatgtttttcccgaagtccttgctttctaggtctgagcttgagaagagagaagatcccttcaggcttgtcactcatggtcttacttgctgtgtcttctaccaaacccaaagcaattctgaatacaccttcccagggtctg

SEQ ID NO: 705711 - DNA, 113 bp, Homo sapiens
acccgactgatatgcagggaagcatatgaaatgatctgcggcagtgctcgtgagccctaggatcatctttcttttcaccgtaggtggccgtgacggcatggtattagcaaact

SEQ ID NO: 705712 - DNA, 261 bp, Homo sapiens
agagtgtataggtgtgaagacatcctgcatctcagtcccacacaggcagctgtctcaggctttacaagcgatgagagactcatcagagccctgggcactgttgctggacgcagcctagagagcagctccctggctatattcctattatacatctcctatgggccatactacctaccgtctagtaggtacatagattacacctccttgtattcctcctgtagctagagccctttccttagtagtaccatactgacccatctt

SEQ ID NO: 705713 - DNA, 316 bp, Homo sapiens
  misc_feature (124)..(124): n is a, c, g, or t
  misc_feature (299)..(301): n is a, c, g, or t
ttaaaaatgggcaaaggacctgagcagacatttctccaaagaagacataagaaatggccagtaggtatagatatgaaaaggtgttcagcatcattaatcataagaataatgtaaattaaaaccnctgtgagctatcacctcacatctataagaatggctattaacaagacatgagataaatgttgatgagattgtgaagaaaagagaccctaagtacactttttggtgggcgtgtagactggggcaacccgttatggaaaaagggtatggagggctcctaaaggaaattaaaaaatagnnnctggtttaaaaaaaa

SEQ ID NO: 705714 - DNA, 285 bp, Homo sapiens
attaattaaattccaatgtttattgacctaggaggacagctgagactatgacagcttatatgtctcatgttcggacatgagtacaggaaatgtcactgtcttatcctcttggtaggagttattatttggtttaatctttccacagagcaacatttatttgataagtttactatttacactaatttgataatgccaattctacagctatattcactcagatatttgtcctatgtgtatattgtaacattgtttgttcctgcatacgttggaaataatctctatgtc

SEQ ID NO: 705715 - DNA, 800 bp, Homo sapiens
gcggaaaccgaatgtgaggaccttaagggatccacatgctgccgccccccgcagccatccagagcgcggtcacatgtcctgactggctggcacggaggcgtgctgggtgcggcgtgcgtgcggcagctgtgcggctggctagcgtgcgtgcgtgcacgctgtagctgcagcagcaggtaaacgacgatgcgttttcccaaagaaaataacatagcacagacaggacacaaactaaccacacgacattgctgcagattttactttatgtgagaaaatctacaatttcttcgacgacactcatactaacagatataggtgaatgaactttgctacgctatggacttcacggcggctgcgacaggtctcatggcattgccacacgtccagaactctacaatggaccataccatgcactatgcaacgactttagttggcctggacactggcctggtactgtcagcatacccgaactggcagcacccatacttgcttcgttttacacgcttcctgatccggctggtcactaggttcttcctgcatgttgcacaccacgatgactgcggcactaacctctttgcactcaatggccccctctgccgccatgcacaacatttgctcgctctgggtaccccttgactaattcaattccaacaacgaaggcaacacttgcacctgttcacgctctacccacgcacaagcgctacgtgactatagatccaccctgcaaacagcacggctacagttgcaacaccacgtgcatatgatctcgctccactattcaacagaacttatcatcacga

SEQ ID NO: 705716 - DNA, 88 bp, Homo sapiens
gtcaactgctacacatttttttgtttgtttgagatggattctccagcctgggcaacagaacgagactccgtctgagaacaacaacaac

SEQ ID NO: 705717 - DNA, 236 bp, Homo sapiens
cgttggttagagacgaagagggactcgctggcagcagcccagacctgtaccgctcggagtgtaactttcccttgaacaggccaaggcctgttggcccagtggcctcgcctttgtaccattacctcccctccctggcggcagcctttccaagggtttcttccctttcttttccccgccccccaaggcccttttcaggggcaaggagggccttgccaaggcttccgggccgctaagga

SEQ ID NO: 705718 - DNA, 917 bp, Homo sapiens
ggttactgcagaagtgaataatgataggtactatctcgtgtaaggcaaagtcctttgaaagggctcctgaaagcgtcaaggcctccgacctggatgaatagaatgagtcaggcacagcccagctccacttcacggatgggaaaactgaccgtactgattgcctcgctgcaaagatgcgagtgcagatgcggaggaaccagaaagcatcacgttcttctcgaggcgtgagtgctctaagtctcgggatccccccgaccctagtaagtggctgtagacggtctccgacgactcgagtccacagcagaccctccctccgggaaggggaagtctcctcggtggttccacaggacaggttcaaaatgacaatggtcaagaagacgaagaggccgagggctgctccaccgcgtgtactttggagccagataccgttgggatgcgcaggcagagagctgtggggagcgtgtggtatgccctcaggcgcgatgtgggcggtggggggcggtcgccccgcgaccccgggtcctccctcaggggcccgtgggcttctctctcaggggccgttcccggtgggcgggaacgagagcgcagaaccctgccaggtctttctcgatgactgggcctgctcgctgaaggagtcatctagccgacgagagtatcggtggtgcgtggaagccccgaaggccggcgagacccaggacatacgagagccaggggtgcggcggtgggtatctgtactgaagcagggaacacagtttcccagtgtttatggctatgagaaccggcgcatagcttgggtaaaatcccaaagtgtgggcgaactctctctgtgcatttatggaatctatatatttcgattaactttcccattgtgtggggtttcaccggcgctggaattcagagaaaggacacatgggggg

SEQ ID NO: 705719 - DNA, 182 bp, Homo sapiens
cttcgagtctctttgacattcatgccaatggtatactctatgtctctgctgtggaccagagtgcgggaaaagagaacaagattactatcactactgaccagggccgtttgagctaggaagactttgcatgtatggtccaggaagctgagaagtacatcgctgaagattacaagcatagggac

SEQ ID NO: 705720 - DNA, 283 bp, Homo sapiens
  misc_feature (103)..(103): n is a, c, g, or t
  misc_feature (236)..(236): n is a, c, g, or t
tactggaccagcttgtgtcgtgagttgagacagcctggcatcatggtgaaaccatctctactaaaaatacacaaaattagccaggcatggtggcaggcgcctngtatcccagtctactcaggaggctgatgcaggagaattgcttgaaccctggaggcggaagttgcagtgagctgagatcacgccactgcaccccagcctgggtgaaagagtgagactccatctcaaaatatatnaattatttaatattaaatgaactccaaagccccattggcgcactgac

SEQ ID NO: 705721 - DNA, 153 bp, Homo sapiens
acgggtaacgccggagttcctgtgtaacaggcagatttgctatttgggataatgaagaagatccgggagatggatagtggtgataggtttcacaacaattgtgaatttacttaattgccagtagaactgtacactgtaaaaatggtcgaattt

SEQ ID NO: 705722 - DNA, 1027 bp, Homo sapiens
agttgttgctgttgttttttgtgatatcagtatgagtagtcttgttagtaatagctacgatagagacgaaaatatagtaagataacaacacgtgcatggcagccgtgacgacggggtacccccctttacttcccgttcaagaacggcctggggccattcgccagggtacacacccaacggcgggcgcaaacaccgccccttcgataggcgcctaaaggggcccagaagaaaggggggaacacatttcagaaagagtgggtatgaaggaacccccggcgaaggtccaatatacgaatttgggaaaaacgctcgtcccccggacccagggaccccaatggcatctgaggtctccaaggtctgtgtttggcaaggagtcttctggatttgccgaatggatgaatgtgccatttagaaaattccagctgattactgaagatagttccgggtaaaaactgcctgactaacttccctggcatggatcttacccgggaccaaaagggttccctggtccaaaaaatggccagaccatgattgaagctcaccttgatgtccagactaccgatggttacttgcttcgtctgtttctgtgttggttttactaaaaaacgcccacccattcagattcggaagaccttcttatgctcagcaccccaacacggtccgccccaatccggaagaagatgatggaaatcatgaacccgcagaggtgcagaccaatgaacttgagaagaagtggtccataaattgattcccagaccagccattgggaaagacatagaaaaggcgttgcccatctatttatcctcgtcccatgaagtcttcgttagaaaagttaaaatgctgaagaagccccagtttgaattggggaagctcatggagcttcatggtgaaggccgtagttttgggaaagcccctggggacgagaccggtgctaaagttgaacgagctgatggatatgaaccccccggcccagaatctgtttaaagttcagacttccaaatagtggccaatataaaagtgctatttg

SEQ ID NO: 705723 - DNA, 844 bp, Homo sapiens
gggtgaaatcgtaggacagtgaagatgctgctggaattgtccgaggagcataaggaaccctggcttctgctcaagtggacagcgcggtggtcgcgagttgggcggattgctgtggcattcctgagacgcgggcaaccaacaaatctacgaaggcgcccgcagaaaatcaattgtgagtagtgacacttgtccagcatggtgtggacggattacccgtatctcctcatctggagagctcaacagtccatgatttctgaactgcacttcccaggactctcgtctggtactgggattctctgaaagacattaacacaacttctgtgtcgctcacacggcttcatcctggaccacaaccgacacacgagacgatcccgacaccgatctagcggtgcctcggcacccaaacgcattccccagttatcattcaccctccgacctggcggacctccgactgtcccggctcggcaccgttccgacacgtctccaggcccacccgcactaccacccaacgcacgtgactatcacacgcttcccccttctcacacatggccgactcacccacaccaacagttctggccgaagagcaccccagaccaccctgtcccatatgcttcaccaatggacccagcctctggcagcccatgcagacacatcactgtacggcaagctgtcccgcacccctccacgtcctcacaccctcccgtctcacatcctccgcctccctctgccatcgtgcctatcccacatccctttccacatacttctcctccacctcaccgcgcccaccactcctctctccgtatatcccacctccgcgccacccgacgcacctggtcgcctgcaa

SEQ ID NO: 705724 - DNA, 968 bp, Homo sapiens
ttctgtttctttcctcgttcaatcttggcggttatgtttttccaggaatttatccatttcctctagattttctagttggtgagtgtgcagctacccataatagtctctaatgagctttgtatttctgtggtttcagttgtaatgtctcctttttcatttctgattgtgtttatttggatcttctctcttctttgttagtctagctagtggtttatcatttttgtttatcttttcaaagaaccacttttcatttcaataatcctttgtatttttaaatctctatttcatttagttctgctctaatctttgctatttcttttctactactaactttggggttggtttgttctggtttttctagttccttgaggtgtaacattagatcattaatttgtgatcttctacttttttgatgtaacttctcacctggtgctgctttgctgtatctcacgtgttaggtatgatgtgttttcattttcattcttttcaaaaaaatttttaacttctgtcttcatttattcattgacccagcaattgttcaggtgcatgttgtttaatttgtatagattccaaagttctctggatattgatttctaggctttattccaatgtggtcttgagaaaatacttgatctaattctgatttcaaaatttgctaaaattgtttggtggcctacatggggtcacttgggaacatcccctgttctgggtaaagaatgccctgtagttgatgttggtctgggcccaacgtctggcacagttcgagcattatgcacaatccatacatcacagtctttgtaatgcgaccggaatccaaatcggtataggaaagaaacacaggaaagaatgaacccacgtcaaaagctagataggacaccaacgataacaagaacatacacctatataatcaaaatacttagacgtaaaacaagcagacacaaatcaaaataacaactaatctaggttat

SEQ ID NO: 705725 - DNA, 107 bp, Homo sapiens
aactgaaaatgatactgccaaaaagtaaggcattaagaaacgaactgcaggagtagaaactaaatagcagtaactcagcatcccctcatcgttggcccacagagaat

SEQ ID NO: 705726 - DNA, 190 bp, Homo sapiens
gcgggtggtcatgttataatctacactttggaggaggtgagaaggcggatcactgaagtcaggagtcagacagctgcgatgtgtgaaaccagtctctattaaaaatacaaaaattagcaggcatgtggcacatgcctataatccccagctaccgtggaggctgaggcaggagaattgcttgaactcagaa

SEQ ID NO: 705727 - DNA, 510 bp, Homo sapiens
attcacatttacaatatttttgtcactacctgcctgagaacgttcattatttcaaacaacaatgaagtggtttttggagatcatttatttttagtattgcagaactatattctttgggcatcaatgtatttttctatttacaagcctatgtaaaagctgtagtgtatcttcagtgaaccatgtgccaattaaactttaataaaaaagtggcctatgcctgcacaaccttactcatttcttacattaaaaccttgtcgcgcgcctggccttggcttttgttttaaaccctttaccttttcagtctgccaacttctacttgtgttttcctaagctactcaaagcactgctttttggtcccttgtttcttttgccttacaccatcttgcccaaacaccccctaccgtaccctcccccataaaccatcgaaggccatccggttttttacaaacacaacccttctcctctaacgccccccccttttcgcccctccaccacaacttccattttcga

SEQ ID NO: 705728 - DNA, 204 bp, Homo sapiens
ttccggtaatgacccatgtgcacgccatggtcctcatgacacctcatttcatagtggtccttgttggattctctctctagcagcacctcctgttccttgcaccattactcttgatatgttcttcacttctctggctatcaacctctaaccctagtgccttctagaggatacatatcaatggaactcagaggattaacatcttac

SEQ ID NO: 705729 - DNA, 1039 bp, Homo sapiens
  misc_feature (503)..(503): n is a, c, g, or t
ggtccgccgatacctcctccttggtcggcgtgtacttgtgtggcgtcagatagaatagggctagtaacttccgagcatatgagaaagatctggttcgactaggttcagaatatgacgacagcagaaataggagatatctgaggcatgcaagactgaagcgggccgtgtggagaggctgcctgccgtcctagggaggaatgggagctcagcgtctgtgatccatccgtgtgcaccatgtgctgcagagcctgagtagcacgaacgatcctgagaattcccatgtgcgtggaaagactcatggcctccaggggaccatcccagacgtgaaccaagacggagaagacacacggagatagaagctcggtacggtcgctgggatggcacaggatgctggaacagtgtgcatgagaccgagatggtctgcggtggcgtaggtcaccaggaggctgggaaagcgcagggccgatcttcgcaaggctgtgaggcccgtgtctcgaacagtnggctcggaggcagacgcagcgtcgtctcgtggcctcaacgcgggtccatccggtcctcctactagaatccctagactagcgatagtctaccgcagtgacgcgcatagtgggagtcgcccgcagccaagaagtcgcagatcatcatccagctagaaggatggacgagtgatgtactgacgggttgggaaccgctagtttgagggcaagttgaaccacactgaacgggacggatggggacggcctgcggaagggtcgtgccagccaagggttgggcgtggcatgcgtaagacgggcctcatcgggggaaaaccccatcgtcagggaacgcaccacgaagatgggtttccccccgaaaattgggctccgcaaaaacgtgtgtgtggccgcccaaaagtagggttcccccttcccatgagccatattgcgatgggttctactagccctttgagcgcgagttagggacatgagggaaaagcggatcatgggggcggcaagtacataagtgagcgccctcggtgggtagcggcttcttaccg

SEQ ID NO: 705730 - DNA, 517 bp, Homo sapiens
ggggcgttcaaaattggcccagtgccggggatttcttcgaagtggagtaggaccctggtggagatatgctaagttggagtctcctgcttgagttcttcagaagttttctaggcaacccccaatcaagggcttccgcagagtttgggaacaaacatgatgcggttctgggcccaacagatatcatggttcagtacatggaactcttccacaagatcccaaatcaacagcaggtggcggtggttgggatttgtatattattagcagctcccagctaggttttgtcaacaagggtattcccagagaggagcaggtggtgatttttaggtccttggaccccagaaacccagggtagacatggactttactttccttttttggttttcagctgtgggttttgttttgggggtgggtcccctccccaaccccctgattttcaaacatagccccccatcagctgttttactccgggccttaatggatttggcctgtcctcaagaatggtaattatgaagagtga

SEQ ID NO: 705731 - DNA, 268 bp, Homo sapiens
ctaaaaagtacaaaaactagctgggtgtggtggcgtgcgcctgcagtcccagccacaggaggctgagacgaggtggaggttgcagtgaatcaagatcacaccaccgcactccagcccggtgacagagcaagactccgtctccaaaaaaaaagaaaaacaaaaaacagaaggtaaaaatgacaatggtgactaaacaaagggaacaaacatgaattggtatgaggacgtcctaaaagcctagcttcagaaaaaccggtagtgacttcac

SEQ ID NO: 705732 - DNA, 236 bp, Homo sapiens
tatatgtctccatgtactgatcctcacaggtctccaccaaatacttcgtcatcatgttgtggaacatcatcatattatggaacatcatatgtactcgatttcatcatcttattgtggaacatcattgtcctcgaaattcattatcatcaatcagatgtcatcaccaacaaatatccataagtcataaccattcgacatcactatctaaagtctcttctaccaccatgcaaattacc

SEQ ID NO: 705733 - DNA, 757 bp, Homo sapiens
gaaagtaaatcatgagaaagggtttgactgaagtaatgggggctgcccctgaagccttgtggcagtacagcccagaaccaaacttcagtttcaaaattgtctttcctaatgcctggctttctggatggatcacagggcccatgaaaacatcgagaaaagaggtgaagaaagctttctatggtttgaatcttctggaaacatcagagaaagactgtccttgccatccatactataacaaaacttcaggacttgggcttcgggttcatggtttcacaactgagaagggttcatccaccgtttggaactgtgcacccattggaacccttgaggtaaagctaaccaggaaatttctcccaagaagaagatggcatccttgatgtgaacagcttttcccaagttcacagattaagacttctactgtcacaaaactctgatctttgaatgttttttcttgcttatgcctctatgaacaatagaagtggaaacggggtctgttatgtgcactaatggggtgtactttcgtgaaggagtttgccagccatcctttatacatggataaaccttaaacttgatagataaatgatgaagggcccatgtcaatacgcaccttttatgttgcctcattatgtcatatgttggctcctaatcagtcaaaaccacacttgattcctcctctaacaatcatggttaaaaacacttacagaggctcactctctaaaggcccctcaagccttccgggaacgcaacagttcacttc

SEQ ID NO: 705734 - DNA, 474 bp, Homo sapiens
  misc_feature (3)..(3): n is a, c, g, or t
  misc_feature (92)..(92): n is a, c, g, or t
  misc_feature (106)..(106): n is a, c, g, or t
  misc_feature (158)..(158): n is a, c, g, or t
  misc_feature (162)..(162): n is a, c, g, or t
  misc_feature (173)..(173): n is a, c, g, or t
  misc_feature (175)..(175): n is a, c, g, or t
  misc_feature (178)..(179): n is a, c, g, or t
  misc_feature (184)..(184): n is a, c, g, or t
  misc_feature (189)..(189): n is a, c, g, or t
  misc_feature (192)..(192): n is a, c, g, or t
  misc_feature (194)..(194): n is a, c, g, or t
  misc_feature (196)..(196): n is a, c, g, or t
  misc_feature (198)..(198): n is a, c, g, or t
  misc_feature (200)..(200): n is a, c, g, or t
  misc_feature (205)..(207): n is a, c, g, or t
  misc_feature (214)..(214): n is a, c, g, or t
  misc_feature (216)..(216): n is a, c, g, or t
  misc_feature (218)..(218): n is a, c, g, or t
  misc_feature (224)..(224): n is a, c, g, or t
  misc_feature (242)..(242): n is a, c, g, or t
  misc_feature (254)..(255): n is a, c, g, or t
  misc_feature (260)..(260): n is a, c, g, or t
  misc_feature (265)..(265): n is a, c, g, or t
  misc_feature (269)..(269): n is a, c, g, or t
  misc_feature (272)..(272): n is a, c, g, or t
  misc_feature (275)..(275): n is a, c, g, or t
  misc_feature (278)..(278): n is a, c, g, or t
  misc_feature (287)..(290): n is a, c, g, or t
  misc_feature (292)..(293): n is a, c, g, or t
  misc_feature (296)..(296): n is a, c, g, or t
  misc_feature (298)..(298): n is a, c, g, or t
  misc_feature (300)..(301): n is a, c, g, or t
  misc_feature (303)..(303): n is a, c, g, or t
  misc_feature (306)..(306): n is a, c, g, or t
  misc_feature (320)..(320): n is a, c, g, or t
  misc_feature (322)..(322): n is a, c, g, or t
  misc_feature (328)..(328): n is a, c, g, or t
  misc_feature (332)..(332): n is a, c, g, or t
  misc_feature (350)..(350): n is a, c, g, or t
  misc_feature (354)..(354): n is a, c, g, or t
  misc_feature (359)..(360): n is a, c, g, or t
  misc_feature (362)..(362): n is a, c, g, or t
  misc_feature (364)..(364): n is a, c, g, or t
  misc_feature (391)..(391): n is a, c, g, or t
  misc_feature (398)..(398): n is a, c, g, or t
  misc_feature (404)..(404): n is a, c, g, or t
  misc_feature (407)..(407): n is a, c, g, or t
  misc_feature (414)..(414): n is a, c, g, or t
  misc_feature (421)..(421): n is a, c, g, or t
  misc_feature (427)..(427): n is a, c, g, or t
  misc_feature (438)..(438): n is a, c, g, or t
  misc_feature (451)..(451): n is a, c, g, or t
  misc_feature (456)..(456): n is a, c, g, or t
  misc_feature (462)..(462): n is a, c, g, or t
  misc_feature (464)..(465): n is a, c, g, or t
ggnactttagtaaagacattcatctcagtcatttctctctcccagcttgaccttaggttaatatttcatttgggtcaagaaaataatacgtnggagaggtatgttnttttaacaaacaggaaaatggacaaaaaattgatagtttgcctacattaaantaanttaaattcatntntcnntatanttaantcntntnananctaannnttctatntncntttccnttgtcttacttgggcttnttctaaacttannttctntttancaanttnttnttnatatacacnnnntnnttntntnntnttntttccaactttttntnctcttntttnttcttcctccattaattntttnttttnntncntccaaatatattttttttttttttttnttttttntttttntanttttttnttttttntttttnttttctttttnttttttttttttnttttncttttntnnttttttctt

SEQ ID NO: 705735 - DNA, 143 bp, Homo sapiens
tagaggatcccttctgccgcaccactctgctgcctcccagcctcacaatggaaccactatccccactgccaggtcacccccacactcattaatgcaaagccaacccatgtctgccagtgagaagtcacagcgcagcaagaagg

SEQ ID NO: 705736 - DNA, 184 bp, Homo sapiens
ggtggtttctcccacccccccccccttggggaagaacggggttttttttatttcccccccccctttttcccctgcccccaggattgggccccttttggggggggcagggggtcccaaattggctccccctgaaaatgtaagaacccccaacaaaatttttattaaattaaattttgggttccca

SEQ ID NO: 705737 - DNA, 657 bp, Homo sapiens
tcccaggcaatgccctggagaggggctaccaagtgcacttataaccaggcacactgctgcaccattggatcgacttggaggacctatgtatgagacaggaactggctcaatgacacaggtgatgaacatgcatggaaacctggccatggacacagtccctgaaaaggtgcctttcttcaatagcaccttctatgataaactccgtaccaagggtcatgacggggtgaaaaggtcgaccagaaacggctacatactctgtaaggagctactgctaatacccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactccaaagtctcctctggaccctgactcgggcctcctatcatgtactctgcccaacggttttgggggacaatctgggcccagaaggggagcgcaacttggcaccccctgatgccagcatcctcatcagcaatgtgtgcagctttcgggaccatgtggcccaggaccttttaagggctcaaaattgggcatggcataagaagcaaaaagccctgggagaaagccggccccc

SEQ ID NO: 705738 - DNA, 649 bp, Homo sapiens
aagtggcatctgttgaggtaggcacactcagaactcgaaaccaagggcatccccctacctggacgtgcgctgcgatcagcatggtgcactgaaacggctccagccatccgacagctcctcccgtgcccttggcttctaccactgcctcacatcagggacacctctgtccctcacatgcacgagagagaggagggggtttacactttctgaagccctttgtgcaaagaaaaaatcctaaggagggtagagaggcagaactgacttctgtgctgggcctactatctgcctactaacagttacggttgacaagtatcaagtcttcctgtgccctgggaattgtgctaagggaattgcacgcctctttttaaccaaaggcttttaacaaaaggagctttaatctcaggtcattccccatttcacagactgagaaattcagatccaggcgaatgaagcaactgaaggagccatgtttccaatgagagaaaatgaggacaagagcccacatctggttgacccgtattccatttcctgattcaagccagacacaccgtgggtggaaggatcattcctttagcctcttagcttccaaatgcaaaaggggaggacaaaagccaggctcagtataagacgatgagggctgaaaccaccc

SEQ ID NO: 705739 - DNA, 124 bp, Homo sapiens
ctgtgagccggtttgtgggaagagcagtgatcattgtggccgccgatgagagcaccatcagctggggtccgtcaccgaacctttggggaactgggctacggggaccacaagcccaagtcttcca

SEQ ID NO: 705740 - DNA, 333 bp, Homo sapiens
atttacctaggaaagagaaacaaggtgtctagccgtcaatacatatcaagttttgatgattgcaaattcatattagcattacgaaggtggatttacagttcttgcttatatcttcttttacaaaaaataataatttaagaaaattttcaggacaggtctagtggctcacatctgtaatcccagcatttaggaaggctgaggcagttggattgcctgagcacaggagttcaagtccagcctgggaaacatgccaaaaccctgtctctaccagaaatagaaaaaattagcagggagcagtggctcacacctgtaatcctaacactctggaaagtg

SEQ ID NO: 705741 - DNA, 209 bp, Homo sapiens
gtgggaggcggctcagtcgcgggctactgcgactggcggatacgcgtcggatagaataagcgttcaggatgccaggacccgcactgctggagaagctcagggcattgctgcccatgttccccgaggtaagcccaatgccaccgccactgctactagcaccagtggaattcatcacagagatattcacggctcccactccccaagagcga

SEQ ID NO: 705742 - DNA, 564 bp, Homo sapiens
  misc_feature (19)..(19): n is a, c, g, or t
tcataggtcgcaggacaantggcacatgaaagggccacaactttggaatgtttcatgacgactattctgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaactctggtacttgtcctgatgatagattccaagtcaatggcttcccttgccatcacgggaagggccactgcttgatgggcacatgccccacactgcgaggacagtgcacagagctg

SEQ ID NO: 705743 - DNA, 110 bp, Homo sapiens
acacattttgaaggcaacattctgtatctatttactccaagctcccagtccctcccactctttccccttccctcttggaaaccacaagtcaattctccaagtccatagag

SEQ ID NO: 705744 - DNA, 186 bp, Homo sapiens
ccatcttctaggtcgtccagctagtttcagtagctcctccttcatcttcccgcagaagatccgagtacgatccggaagatccattgcccgtgttctcacagttcttaagcagactcagaacgaccccctcaggaaattctacaagggcaagaagtacaagcccctggacatatcgagcaggcgtaa

SEQ ID NO: 705745 - DNA, 1485 bp, Homo sapiens
caggtgtcgtgaaaactacccctaaccgccacactgggaaaggcacacgactcatatcaacattgtcgtcatttggacactgtacgattctggtgcaatctccaccactactggccatctgatctataaatgctgtgtggcactcgacaaacagaaccatcagcacaaaattcagcagcaagtgcagtgcttgcttgcagcattgggcacaagtggctcccttccaagtaattgccttgtggctcatctgtgcatccaacacttgcacacagacttgcagctgctgcaactgtatggatactcacccaatatgacatacttctccctatgctgcgacacacttattgatgacgccactgcacactgtaccatagatgctgacacatagtcaactcttgaccttgccacacacgtgcacaccatagatgaactttacaatacacctacaacacacgttgacctctaccacgtgtgatcactcatacactgtgccttgaactctgagtgactttgctcacctggacctatcgacttggcctcggccttgacgttgctctctgccgtctgacacctctgatggacactgccattgccgctaattactctgtacgacaatagcacgacttgagtgcgccatatcaacaccctgcatgaaaggccaacttggacatcacagttataccttgtgccatttacacaagcaacccattgacgcgcttcggactgcaacacaaagccgaacagcctcacaagctctcggatacacgtcgcttgggccttcctacgcgccacaacaacgcaaagtgggccccacatccacccaccaacccatagtgaacgccccgccaacaccaccaggtagaaccctacgacggcccaacggcacacgacggcaacggcgaacgtaacttgccacggcgtcaccgcacagctcctggcctcacaaccacgccaggaccaacacggcttccaaacagcaccacaccccgccacccacacgcacccactgccgcgccctggccaacagcaacacccaactcacggcgaccgctgtcaacaccgacaaaccaacgcccccccctccacggcgcatccacaccgccaaaagagcgacgacagaacaccaacaccactaccaccaggagcgaagcagcgccgaacacacaccatgcccaccccacagggcagccatccgcgccaggcacacaaacactaggcgtagtttgcacacccacaacacccacacactcgcgacaccacttggggcaacggtccacccacacctaggagccactgagccagcaacaccaacccaccaacaagtgggtcccaccgtatgtcgcaccgtataacccccaacacgagcggggcgcgaacacttgtcgcacaaagccacaccaggcgtacccaacccaacccacgccgcgcaaacacaccgtgcaaccagactgccgccagcaactactcggccgccacagcgcaccg

SEQ ID NO: 705746 - DNA, 184 bp, Homo sapiens
caggctccagccaccagagtccatctcatatgcaggaatgtgaatcttttcctctcttacatggttcaggtgccacggggtaaattagggcttttcaaaacccagaggcctttccttccagcccctttcccatgttccctgccatgtcaagttcccaccttagggaacctttcacgggggtggg

SEQ ID NO: 705747 - DNA, 400 bp, Homo sapiens
ctccctgacgtatgtcatcatcactcttctaatctcagctaggtcgtcctcttccacaactgaagcttgcatctctcactgaatttccatcatccactgacatttgaatgctacacataacacaaaacctaagatctttgctgtcatttacagcacaagaagagactatatctaagacatagttcaatctggacaattattctggcatgatcaaaataccagtaagatcttcagatgcctaaaagattccaagtatttaatacctttagactaacactttatgtattatatgaatgttttgctttggagccataggggcctgaccttgattcccaagtgtcccacttactcagtttactcatctgcagaataaagaaaaataatagtactgatcagtctg

SEQ ID NO: 705748 - DNA, 796 bp, Homo sapiens
tataatgctagcatataccatctcacttctaggaatactagtatgtcgctcacacctcatatcctccctactatgcctagaaggaataatactatcgctgttcattgatagctactctcataagcggcctcaacacgccactccctcttagcgcaatattgtgcctatgccatactagtctttgccgccttgcgaaggcagcggtgggcctagccctactagtctcaaatctccaagagatatggcccagactacgtacataactaaacctactccaatgctaaaactaatcgtcccaacaattatattactaccactgacatgactttccaaaaaacacataagttggaatcaacagcaacacccacagctaattataagcatcatccctctgctattttggaaccaaatcaacaacaagctatatagctgttccccaagcttttcctccgacccctaaaaaaggcccctcctaatactaactacctgagtcctacccctcacgaatcatggcaagacaagccaattaatcaggtgaaaccactatcaatgaagaaaaactcttagctctctaatactaagtctcccttaggaatctccttaattatacatccagaagccaccagaacttaatcataattgagatctgtcttgcgaaacaaaatttatcccgcaccttgggtattcatccacccgatgggggcaccaggcaagaaagggctgaagcggggcacataatcgctagttaaccttagttgggtccttcccctaattcataggcgaatttaagtcaagc

SEQ ID NO: 705749 - DNA, 164 bp, Homo sapiens
tctcttagagtgatcccgcacagtttgggggagggaggaataggctcactgggtaatctctgaacctgtaatcattaccagtccaatattagtgcgtttttgatgccgattagaaaaatcactccttctggggaaaggcaggttggccaactgagaagtccgga

SEQ ID NO: 705750 - DNA, 535 bp, Homo sapiens
aagagaggaaaaactgggcgtctgcttgggaatctattgtggaaacccaggctgtttcccgaccagtccctgggcgccaactagagtatggtctgaccaggtacctggatggagacctgagctggagaaggagatgcgcttgggaggaaattgcagaggccgtcaacatggaaaagcagccccagaacagcaggagaggcctcgccccccgagaggtgccgccagctgtagggctgctgctgatcatggccctgatgaatactctgctctacctctgcctcgaccacttcttcatcgctcctcgacaatccactgtggaccccacacactgtccctatggtcacttcaggataggacagatgaaaaactgctcaccttggctgtcctgcgaggagctgagaacagaagtgagacagctgaagcgtgttggggaaaggagctgtaaagagagtcttcctgtctgcagtgacacgagcacaaagtcgcactctcacagctcaccagcctggagatgacagatgatttcctccatgga

SEQ ID NO: 705751 - DNA, 248 bp, Homo sapiens
  misc_feature (10)..(10): n is a, c, g, or t
  misc_feature (30)..(30): n is a, c, g, or t
  misc_feature (37)..(37): n is a, c, g, or t
  misc_feature (76)..(76): n is a, c, g, or t
  misc_feature (90)..(90): n is a, c, g, or t
  misc_feature (123)..(123): n is a, c, g, or t
ttccattganaatgtcctgcaggacagcanccccgancactgtgccgaggcccacctgctgaaatctacctgccanccctggggcccgantcctgctctgttggtatagacgagtaagcgganggcccacctccatggaagtagcccacggcctcgccaccaccagccccacctggcctccacttggtgccccagccccgatcccagcctgggcgacagagcaagactccgactccaaaaaaaaaaaa

SEQ ID NO: 705752 - DNA, 428 bp, Homo sapiens
  misc_feature (390)..(390): n is a, c, g, or t
gtttgagacagagtctcactctgtcacccaggctggagtgcagtggtgtgatctcggctcactgcaacctctgcctccaggttcaagcgattctcatgcctcagcctctcaagtagctggggttataggtgtgcaccaccacacctggctaatttttgtattttttagtagagacagggtttcaccatgttggccaggctggccttgaactcccgacctcaggtgatctgcccaccttggcttctctcccaaagtgctgggattacaggcatgagccatcatgcccagccaaactcagttttaaatggggaaacaaaggcacaaaggttccacttgcttgagtttagggatctgaacctagcatatagattggttctggtgctgagcctncagatgtggcatgggctccttggtctgccatggtctgc

SEQ ID NO: 705753 - DNA, 960 bp, Homo sapiens
atcggttgcccttcgacaccggctgtactgtatggacaccgttacgatggcgggttatgctgggcgaaggaggatcgaatcatcgcgacggatggcaacaataatgcaggaggcgatttgcgggtagtaacgctcacggcaatggctgcacagcatcgcccattcggttttgctcggatacatttcatgcccgcagtaaccacagtatttatgcgatcggtaaaactccgccagttgtacgcctcgtccggccagttgaaacagcccaacatcgagatcaatgacctgacgtaccgaccccatatcgtgacgccgctgctgttgtactaaccaaacaggttccccctgccattcgccgatttgtagtgcgcgctgacccacaagatcgaaatttgccgcttcgccatatggcaattctcccttcggcaaccataatttttgttcatggctgacgacccaccagccgtgatctaatttttcaattatacgatccatagctcttgcactacctttgcatcactggcatgtttaacatggtttttacatttctcactgagcagtttttgaatacaaacttgcggagtcaatcatgcttaaccagctcgataacctgacggagcgcgtcagaggaagtacaaactggttgattcgctggctacatgtacgtaagcatcttgctcgtgggcttactacaatcttggttgtgccattaaagcctggccaaaggaattcgtacatgcagggctaaaacgaaaaaagcccttggagtgatttttgtcaggagcctggtccgattacttgtcttgcccggaccattgtccggtatttatgagcgcattcttccataagctgggaaaggcaacggggcaactcgcggcgccgccgggaaaatttggccgcaactcgaaggcgattctctcaccgattatggatttctcgcattcccgtctggaaacggcc

SEQ ID NO: 705754 - DNA, 485 bp, Homo sapiens
accagctggaggaccccagccttgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgatgtcgcgccccatcaagttcgcaagagcatgtggaaggaccggaatctggacatggtccgcaagaagcagaaggaaaagaagaagctgggcctgagatagggtctgtggcacagacaccagctcccaactggcagagcactagctcctcactcagaaatcattagaaaaccaccagaaaacacaaatcccctaccccaaaaccaaattcaataaatttaaaaacatataccaaaaaaaaa

SEQ ID NO: 705755 - DNA, 457 bp, Homo sapiens
acgacaaaattgccataggcttgtcagacaagtctaaaagaagctgttttttctttctcttccctatatttcctcttcctttgtttaaatatccctgagatggccgggcgcggtggctcacgcctgtaatcccagcactttgggaggccgaggcgggcggatcacgaggtcaggagatcgagaccatcccggccaaaacggtgaaaccccgtccctactaaaaatacaaaaaactagccaggcgtagtggcgggcgcctgtagtcccagctactcgggaggctgaggcagaagaattgtttgggcctgggaggtggaggttgcagtgagctgagatggtgccactgcactccagcctgggtgacagagtgagaccctgtctcaaaaaataaataaaaaataaaaattgatttggctttcatatcaattgtttcctttggctttcatatacattttat

SEQ ID NO: 705756 - DNA, 95 bp, Homo sapiens
agtcgcttgaacctgggaggtggatggtgcggtgaaccatgatcatgccactgcacttcagccaaggtgacagagttagattccatttgccacca

SEQ ID NO: 705757 - DNA, 139 bp, Homo sapiens
agtgcatggctgacctgatatagccaacaggaaagtctgaaatctatctagagacccaggaaagagggctccccaattccacaggactaaagactatttaggaggatggctacatagttgtctccagcatgatgcatcc

SEQ ID NO: 705758 - DNA, 465 bp, Homo sapiens
  misc_feature (18)..(18): n is a, c, g, or t
  misc_feature (29)..(29): n is a, c, g, or t
gctgccttcgttgctttncttttggctancccatttatagttagtagtggaagatgtagcccaccttttttgggaaaggctaaaagtgaacattttgaaagtttttttttttaattggtaaaaaaaaaatagtaagagaataatgccaccagagactttagtggacattgcccattttgaaggtgccattcttagaagccaagaatttggtatttaaagtttatcttgagagaataacctgtaatataatttgaaataaaggtatagtaaccttaagagcactgtagcaaaaacattggtgggtggggtgaatttgtaaaatgaatgactttgataaagttttatgcacaggcaaatgtattcattagattctgtgtagtgatctgctttccctttgtaatttgtagtcctaaaaagattttttttttttaaaataaagtccatccttgcatttaaaaaaaaaaa

SEQ ID NO: 705759 - DNA, 470 bp, Homo sapiens
tgttgatgatcatatgctgctggaaatataacgcgtgaatataaattacctgaaaaaggtgtgggtatattacccaaatattggtatcaaccatgtaattgcctataaaatgggctattattataacagacgggtagatgtgaaaagcacatactgccgtatagatgccttatacaaaatatgtatacgctaaatatttagtgactatgcgactgtattggagaacatggatgttgtttgagaatagggcgtaattgggaaacagaaaatgctttgcgatataagaaccggtgttgcgaaactgagaaaggtacgttatatgatgtactgacggaactatgtgggtattaagggaatggtgacaatgggggagggaaacaaaaaattttgtacggtaactattattaatgcccatattaggcttgcaagtacgacaacggggttacccggaacttctccccacctttggc

SEQ ID NO: 705760 - DNA, 1278 bp, Homo sapiens
ggacggcgtgggtctgacccacgcgtccgccggacaagatggcggtgcggaagaaggacgggggccccatacgtgaagttactacgatggtccgtcggacaccgtagacccacgttcgacaacgtgcggctgtggctcggctaagtaactacaagaagtatattgcaagctgaaccacaccaccaatcaagtccctgtctagcctgtgttgtacatgttgctacaactttcaggaagaagtttattggcaaacatgtcagcgaatgcagccgatcactaatactgccgattcaaactgtttcgcatagcatttcaaacgcgggagtgcatccttgatgcccacattctatgcagctgcctacgaaacttcaacgagtgaccagggcatggcgggcgtgtacgattctccagaatccatcacgcatggacccgcaatagtggcaaaatgtattatgaccattgaggacgtcctatgggtgcagaatacattgcctgatctcgatccgtaaccagtttgtgtctgtagcccggaagatctgaggcccgaaacgtacctagaggaacagttacaagtgacagttatcgacgagacaccagggaacagtcactgaggcataagaacactgcctcccatgtcgatagtatccttgtacccggggcaactctagacagcacagaggaaatgagcacgcagcaagtcagtgaactacgggacttgagccgcgtccctctgcaactggggacctacgaatcactgacagataacgaccacgctgtgatcccaacaagtgcatcttcgaggccacatctggtgtagaaccacgcctcccaaactccatgacgaccccgtcaagacacggggctccatgcccacgtgtgcgaccctgcgaccaccgaaccacttcactccgcaatgcgactcaactgtgaacagaaaaacgacagacacagtcacgaccacaaacaccgccctcccgcggaaaggaacatactaccacatctactgctctcacactttcgactacctaaccacaaactaacggacaacagcacacaactatctcaaattctaagacacgccccacacactaacacacaccaatacactaaaaagcgtatacgccacaacatacacctatccagctcctcaacaacccagactaaaaatcaacaagcaccacacacaagaccctcacactcacaccacacacccaacaccacaccacccaccagcacaaaaatcgacaactaagcctaccctataactcacatacattc

SEQ ID NO: 705761 - DNA, 652 bp, Homo sapiens
gttgtgctagaggagccagataatgccagtctcaacaagaggattattcaatagccattagatcatcccgctgccttcctgcttccgagtccattggactttgcccatggcctgtactcccctgagactgccatctggctagacctgatctatgactgggttccaaagttgaggcctaggttgtcgctgggatttagatcttttccggcaccattttgacagcattcaggaaaacggttattgaccccatagactagggtaagaataaaggcaagcaaatttgggctgactcagaatataggagatccatatatttccctggaaagcacagtatacactaaaatgtgaaactgaaggtttagttacacacaagagaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaagctgctgcctgctccaccttttggcagctctggacatctgaggacatcccggcagatctggaatggggcctcaaatgaaccattgttctcagaattcagttgaaa

SEQ ID NO: 705762 - DNA, 257 bp, Homo sapiens
tctggctttgtggtctcttcctgacctcacgattctcctgcctcagcctcccgagtagctgggattacaggtgtgtgccacacgcctgggtcatatttgtatttttagtagagacagtgtttcaccatttatggccaggactggtctatgaacccttgtaccttaagatgattttgcctgcctacagcctcacaacaagtagctgtggattacatggtgttgatgccacctgtgccatgtgccacccattttacttt

SEQ ID NO: 705763 - DNA, 648 bp, Homo sapiens
  misc_feature (594)..(594): n is a, c, g, or t
tgcatggtggctcacacctgtagtaatcccagcactttgggaggccgaggtgggcggatcacttgagaccaggagttggataccagcctggccaacatggtgaaacccggtctctaccaaaaaatacaaacatttgccgggagtggtgttgtgcatctgtagtcccagctacttgggaggctgaggcaggagaatcgcttgaacctgggaggcggaagttgcagtgagccgagattgcaccactgcactccagcctgagcgacagagcaagactccatctccaaaaaagaaaaaccaggcatggctgggcacagtagctaaggcctgtaatcccaacactttgggaggccgaggtgggcagatcacgaggtcaggagatcgagaccatcctggccaacatggtgaaaccccgtctctactaaaaatacaattagctgggtgtggtggcatgtgcctgtaatcccaggtactcaggagactgaggcaggagaatcgcttgaacccaggaggcggaggttgcagtgagccaagatcgcgccactgcactccaccctgggcgacagagcgagactctgtctctaggagacttaacanattaataccaataacaacattgtgccaggcacagtggcccacgcctattcttgg

SEQ ID NO: 705764 - DNA, 277 bp, Homo sapiens
  misc_feature (270)..(270): n is a, c, g, or t
gattacccacaatcaagctaattaacatatcctatgacacatagttaatatttttgtgtgtggtgagaatacttaagatctattctcttagtaaatttcaagtataccaatagttgccatcctgttgtaagcccaaatcactttggcttagtgattttggggacctgagattatttttcctttcacactgtacattaggtttccagaacttattcaccctataactgcaagttggtaaacttttaccaacatctccccatttcccctaanccatgac

SEQ ID NO: 705765 - DNA, 1228 bp, Homo sapiens
tacgcaaataggctagtagaggccgcgtgttcatcggccgaggctgggcggtgagtgccctgccgtggcactggctccagcgtcgtgctctcgaattcatttgctttccttaacgagagaaggttccagatgagggctgaaccctcttctgcctctgcccactggccccatgaactgctgtgtgtggagtgagtgcatggtgtgatgtggtgctgtgccactcaaactgtggtcatttgcccattaatagatgacctctaaacaacctgccttgctaaaaatacccgactggatgtgatgcataaaatgctgcatgcctgatgcccatgctgcccctgaactttttcatgagcagacgtccatgagcatgagtcatgccatgcattgacctgatgctgtctgctgtcccacttcttctgctcacttgctgtggtgccccctatgcttgtgtggacccactttcctgcctgacttgtgtaccctggcatatgcctggccttctttctgcaccagtgccattcagtgtgcttggcccctgtgctttgccctggatgtgcatgttgcgtcttgcaatgagtagcgatataatgtggctgtgcaaacgcctactgactttgtgacccacatgtgcttaactagtttggctggccacaccacttgtgcacacacccacctggcacatgacctaattccttgaagtgacatgccccatgacaatgattggagacatgctgaccacatgcacattaacagtgaagcctggacatggcggccttcacagagcactctggcagcaaactccatttcaaatggcactagccaggggtgggtgcattccgaggggacggcaactcccttgtgtcaacacatctttggctatgatgcaacacggggttgtggtgcagaccagatatgatccccacttatggagatttagttccaaaccacaacatttttccaggcccaccaggctaacactctagaatcgccttcagacacggtgctcccacacgaaaacccaagagtgtgactcttgtgggccggttaggcgattgagtcaatggcacttccacaccgcctggtcgcaacaacggaccatacctgtaacgaggatcgctaggggccaacgctaaacctagacgaccaagttgacgcatttacacattttctatcccacggggatatggcatttcccacgctcgcactgcaaaacagtttaccgagcgag

SEQ ID NO: 705766 - DNA, 1608 bp, Homo sapiens
  misc_feature (326)..(326): n is a, c, g, or t
  misc_feature (915)..(915): n is a, c, g, or t
agggaaaatgaaattacaagtcaatacctccacagaagaggataacctccttaattatttcctatgtgactcctctgtgaacccttattttaaacccctccttaaaattaaaaattattcatttgtgtggttttccttatttattttttacacctctataagaggcggggcctctgtgactataatttgcgccggtgggcgcttgtgagtggcatacaggatattatagcgcaccaagcgcatatataagcgcctccctatatccacccatatatatatagcgccttgtgcgctctttctcggggcgcttctcacatctcattatntagagacacccctataaacccctctatatacgaatttatagaacacggaaacacacactgtgtgtattatacaacacaacacacagagaatatacagagcggtgtatacaacaaaacaacacaaacaagagaggcgcgggcgcgcggcctctatagagagatattccctccctcgagagagggcgcccccacaagagcgctatcatagcgcgctgataatcatcccccgagatgtttctctctctgtgctgctacaccacaaggaggtgtgggtccccccctatatatgatgagatgagagcctgcgctatcatctatatatacgacgcgcatgatgagagcacacgcgtgtggcgcgcgcgcagaggtgttttttaaaaccacaaggcgtcggtgagagatctgtgcggcgaaacacaccagtgtgtcgcaaactcctctggtgcgcgcacctctcctgtgcggcgaaaaggcgcacaccctatataactatctctgagcgcgcgcgtgcgtcgcacacaatatatatgtggtgcggaccccaaacatcacaccctcatcacacgcgacacgatcatcttcttctaanacagggcgcctccctataaagggggggcatcaaccaatttctatcacaccaagcatcttcttttctaaaccagagcggtggataccactaccgcggctgcgtcgtgttccacacccaccttataactccgctgcgcccacaattattgctgcccccatgcgaccgtcggctcatttatgaaaaaaacacatctgaggcgccactcacacacggggggcggagcctaaatgttgcacaccttcctcctggctcgcgaccaccaccaacccttttttgttatatcacccccccgcagggcggagatcacctgacagttaacaagtcaacaaagaagaacaacacacgcagccagctcacacatacacacgcagaagtagacaacaagctagatgatggaagggagagtgacttaacgaggactgagaacgcggtggatccagcgcagtgcacgggcaaactcggagcccaacatatgtaaacaggagcgcactgtgcatgacagacgagtgacgagcataggaatacaatgtgactgtggttagaaccgagcccgacatacgcactcagccggcgacagcatcacgccgggtggtgcagtgaccgcgtagctaacggcgaactaggagcgatgcgtcggcacccagcagcacgggagataacggcaaaaagagcacacgcacaccacaaacaaca

SEQ ID NO: 705767 - DNA, 306 bp, Homo sapiens
ggggaatttgtggtgctgctcttttgaccccctatttagatgagaagaaaattaggggagacccagaagacgacagcttagctgacaaccaaagaagatgatatacgggcgcccatggaatcttatagcttgagcagcacttttggcaccaacctgcacccaaagagcatctttaaaagttgtcacatacttgctccgggcagctctttcacaccactaccatgctctgtgccagacatgactaattttttaaatctctgacactcttaattagacatgagctaattctgtaagaatgttagagta

SEQ ID NO: 705768 - DNA, 124 bp, Homo sapiens
gtgaagctcttaagacagggtgcttgcgccaggcgtgcttgactcatgcctgtaatccccagcactttgtggaggctgaaggtgggcgggatccacggaggtcacggagatctgagacccatcc

SEQ ID NO: 705769 - DNA, 151 bp, Homo sapiens
ttgaactatccaaatacctgctatctcctatgttctgtcctccagaagctgcacgcttgtacgtaggagttcggtaccttataacgatagtccaccaggccaaagggtaggcaatagaagaccttacccaccctttctccaaggacatgct

SEQ ID NO: 705770 - DNA, 364 bp, Homo sapiens
  misc_feature (292)..(292): n is a, c, g, or t
  misc_feature (335)..(335): n is a, c, g, or t
aactatgtagacttggagattgtgaaattgtggtcattattgcctagcataaattattttatcctagatctgtggggaggtggcactttgcaaagctatttgaaatgctaagtgttttatgttacccgctttaaggtaagtacacaagttctatgaggtacttgtttgttaaaacaaaatagagcctctacagcactgtaagtcagtaaaataagtttgatttatgagtggtcatttcacttaggtaggcactggtggcatctttgatattagatatgagttgagttatctntaaactgcataatacatccactgtttgcaaataagtatttttnggttatttcaaaaattttatcccaccagt

SEQ ID NO: 705771 - DNA, 400 bp, Homo sapiens
  misc_feature (58)..(58): n is a, c, g, or t
gttggttcccccccaaatgtcctgacaaatacccccgccgaacttcagttttccctgntacttaccacctgccgccggttgccggaggccatcgaggaagtgaaaaatggtggctggacctcgtggaagcccctctggctgtgtggctatggactcccgcagagccctgtcggcatcatcggggtggggggcataggtgaggctccccccggcccgcttgcccgccccggctttcacagggtggtttgcatccctggccccccgtgtttgaaggctgagaagacccccatgctgtcagggccctttgcttgcagtaaagatatttttaatgagggatacagctttgtaaaacccaggcaaatacataaataaaccaaagcaggattccttaagaactcca

SEQ ID NO: 705772 - DNA, 110 bp, Homo sapiens
gagaatttaatttttaaaagactttgatgtgtttgtgtatgaagtacttgtaacgtatgtatttcattcgctgtgtcacactctgtgtgttgtgaggttaatgtcttcct

SEQ ID NO: 705773 - DNA, 320 bp, Homo sapiens
ccaaaagggccctggggggtttttttttggggcccgttttttttttaaccccccaggggttttaatttaaaaaaaaaaaaaattccccccctccccttgggggttcccccccccgccccttaaaaaaagggggccggggtttctgcccccccacctgggggccggcctttctgggaggggccggttaaaaaaccaattgggggacccgccggggccccccccggttcccttggccccccaaaaaaacccctttttttctccgccccaatatttggccccgggggccacaatccctttggggggcgcgataaaatccccaa

SEQ ID NO: 705774 - DNA, 617 bp, Homo sapiens
gatatctttataaagaaatctttggaaattaggagaaggaatttcaggtgggtttaatcagagctagttcccccaccggaagatcatttggaacccggttgttatcccctctctttccgtcccgttccctagatccaatccatagtaagtgtggccctatttcacgtgacatagacttgaattatttttagggaagcccctataatggattccgaaatcactaccagcagcctttagactgaagttgggatattctgttgaccctcaaaccttgatatcacttctgtgtatatagaatgtaaaagggatattacacgtgttatactgccactatatgtatatacacccactccattagccttgtaatggcccaatgcacttcccccctgcttttctgttttccaaaaaattgtgaaaaccaatccactcttatcccccacccgctgcctaattttaggagtctgaccctccacatctcactggtgtgggtgcaactggggctttggagtgggtgtccgtatggatgtgtctgaatgtgtgaggccttggaagggactctttctgcagatactgtaaataccagtaccctttttataaagcatgtaccataaacccca

SEQ ID NO: 705775 - DNA, 948 bp, Homo sapiens
gacgagatggacctcactgccggtcgcttcctagtcaagtgctcagtgtggctacgtgctaaaagctgtcctgcctgcggcaggctgactcgacctttgaccccgagtacccaggacctcccagaaccactctcagcatccaggtgctgactgcacagcagctgcccaagctgaatgccgagaagccacactccattgtggagccccctggtggcggcattgagatccatgggcgtgcccgtgagactgtgtcccggcaggacgactgactacgtgctcaacaatcggcttcaacccccgctgggtggcacgaccctgaagttccagctgcgggctccggagctggcacgtggatccggtttgtggtggaagattatgacgccacatcccccaatgacttcgtgggccaggttacactgctcttagcatgctaaacgcaagggtaccgccacatacacctgctttccaaggacggggcctcactgtcaccaaccacgctcttcatccaaatccgatccagcgctcctgagggcccacgctcaatcgccttggggtctgagaagtgcagtccagatcccctgcagagcctctcctcctctggagtcaggtggtgggagtaacaggcccccaagaccaccacattgggccactcaaaccgatttcgaccaggcaggctggactcaacctgtggtgactgaagagactgccaggagccctcctggaggcacagaaggggtgggccaagtgactctccaggacgatcccaacccaggggcccgaaatgcgcgcagacccctggtctgagccaacccgcacattggactataggcagcaagcggtgcccgccggaaatagggagcaggaaccgggccgcaaaccactggcccgggcacacctccccaagagaaagacccggcgaccagaagcaaaaaacaaaatgacccgcag

SEQ ID NO: 705776 - DNA, 231 bp, Homo sapiens
tgactctacaggatccttactgaaactacaggtgccaccaccaaacaggctatttttttttggtattttccggtggagacaggtttggccatgttgcccaggctggtcttgaactccatctctactaaagatacaaaaattagctggatgcagtggcacatgcctataatcccagctactcaagtggctgaggcacaagagttgcttgaaccaaggaggcagaggttgcag

SEQ ID NO: 705777 - DNA, 107 bp, Homo sapiens
ttcgatgtgggactcagagggacacagacactgtccagagctgatcgcatatggtctttaacttgtatccataggtgacctttccatactgcaaaactatggggtag

SEQ ID NO: 705778 - DNA, 163 bp, Homo sapiens
acacaattagtagtgtgcatggttggcgtcacctgttgtccagtcatccttgggagtgctgaggtgaggcaggacccatccgttgagcctaggaggtcattggcttgcatgtgagctgtggtcttgctactgcgatctctggccaaggtacgagcgagacctc

SEQ ID NO: 705779 - DNA, 100 bp, Homo sapiens
ttttaggtcctatttgttttcaatacgattataatcgatcagagtaattcttttgtacattgagaatgaggggctggtttaaaaaaagacctttccctct

SEQ ID NO: 705780 - DNA, 378 bp, Homo sapiens
actgtgcatctcgtgcctgcgaggtaataatttccatatgggtcctagtcctccccggtggttttcccatctctgatggccgagtccttttacgaagtggtgttcggctacggctttagagatcctcctgtgccttcttcttcttcttgggtttttctcctgtgaattacaggggggtgggtagctatctctttgtagatagctaataaaatcacttaattcacggccaccttcatatttctttggatttagcttcttgtaggctggagagaagtatatggtaggaaaacctctgacttcatatggagaaggcacatcattggctgtggcatccatcttggctatgacgatatttgggtctttgctgagcttctcgcc

SEQ ID NO: 705781 - DNA, 125 bp, Homo sapiens
accgagcctggtgatagctggttgtccaggataggattttaggttaacttaactttgccacagaccttttaattccctgttaatttaactgttagtcaagaggacgctctttggactagggaaaa

SEQ ID NO: 705782 - DNA, 246 bp, Homo sapiens
aaattgatatatagtataaacatatataccacatatataacaggataagcaataatacatagctagctaaaaagtagggtctctgagatatcaactagtagataaaaaaacaagtgccgcacgtataagagaagagcagatcatagctatagtgacatattgcatgagatataacacacactattttgtacatgaagaggcttgtgctagtggtagggtacgatataataccctagcccatcccca

SEQ ID NO: 705783 - DNA, 282 bp, Homo sapiens
acaccacagctcgcggcaacgccggatcgttaaaccaagtgagcaagggcagggatcaaacccacaacctcaaggttcctagtcagattcgttaaccactgagccacgacaggaactcctgtctacttttctttatacttcatttatttttattagagtatagttgatttataatgttccttcaatttctgttgtacagcaaagtgacccaatcatacacagttccctgtgttgtacagtagggtcccattgctacactgtctacttttaactaaagatgtc

SEQ ID NO: 705784 - DNA, 145 bp, Homo sapiens
tagggaaacagaagaaaacacgttaagggcacactgaccaaagcttccatgtcacacatgcaaactgcggaggcttctgctcaccatgtgattgcagcctccattcttctcaatgcagatgttgcacttgggaccactgcaggag

SEQ ID NO: 705785 - DNA, 183 bp, Homo sapiens
ttgttaaaagttccaaccacctccaccataaatatacaaaaacctatttttagatatgtcaaattgcatgaatattttctaaagcttgaatttgctcttcactggatattatctatagctgtttctgtaacagactacataaacattgatatattattcatgcctttgaactgtgcaggactt

SEQ ID NO: 705786 - DNA, 475 bp, Homo sapiens
  misc_feature (1)..(1): n is a, c, g, or t
  misc_feature (100)..(100): n is a, c, g, or t
  misc_feature (108)..(108): n is a, c, g, or t
  misc_feature (130)..(130): n is a, c, g, or t
  misc_feature (143)..(143): n is a, c, g, or t
  misc_feature (167)..(170): n is a, c, g, or t
  misc_feature (173)..(173): n is a, c, g, or t
  misc_feature (212)..(212): n is a, c, g, or t
  misc_feature (214)..(214): n is a, c, g, or t
  misc_feature (248)..(248): n is a, c, g, or t
  misc_feature (250)..(250): n is a, c, g, or t
  misc_feature (262)..(262): n is a, c, g, or t
  misc_feature (281)..(281): n is a, c, g, or t
  misc_feature (285)..(285): n is a, c, g, or t
  misc_feature (291)..(292): n is a, c, g, or t
  misc_feature (294)..(294): n is a, c, g, or t
  misc_feature (308)..(308): n is a, c, g, or t
  misc_feature (313)..(313): n is a, c, g, or t
  misc_feature (326)..(327): n is a, c, g, or t
  misc_feature (329)..(330): n is a, c, g, or t
  misc_feature (343)..(343): n is a, c, g, or t
  misc_feature (345)..(346): n is a, c, g, or t
  misc_feature (360)..(360): n is a, c, g, or t
  misc_feature (365)..(365): n is a, c, g, or t
  misc_feature (368)..(368): n is a, c, g, or t
  misc_feature (373)..(373): n is a, c, g, or t
  misc_feature (376)..(376): n is a, c, g, or t
  misc_feature (405)..(405): n is a, c, g, or t
  misc_feature (413)..(413): n is a, c, g, or t
  misc_feature (425)..(425): n is a, c, g, or t
  misc_feature (432)..(432): n is a, c, g, or t
  misc_feature (437)..(438): n is a, c, g, or t
  misc_feature (443)..(443): n is a, c, g, or t
  misc_feature (468)..(468): n is a, c, g, or t
nccttttacacaaaacaaagtagaagaaataatacaggattaaaactgcaaaagtagttaatcagtagaatatgtatgcacacaaaaaatccagatgggnagacaggnttatttacaatgaaagtaaggnaaaattaacgtanttttcttatgaaataataaaaaannnnccnacatatggtacaatgggcaccactgttcacagcaatatncnagaggagaaaacaacacttatttaatagggaaananatacaaaaaggnacaaaaataagtgcaatanattnagaganntntattagagatagtnaatgngtttaggggtggnncnngtgagtgggattngnngggggtaagaggtnggttnttnaaganttnaactaatctaaatttgtaggtatcaagangttaagantgattattagangtttttnttggnnttttnttttttttgttgatcagaggtgaantattatt

SEQ ID NO: 705787 - DNA, 945 bp, Homo sapiens
  misc_feature (700)..(700): n is a, c, g, or t
ccggtgcttccctgaggctgaggcgcgcggcctcccggccggcgcgctcctagatgaatgtgtgagcagctgcagcgcgcaaggaagtgtagtaagaaaacaataaactgatgaccaagatgaatgtgtcagccgatgctaccgatgtccagccgcaggaaaatggagagaagggagaactaccacaagtctgggtgaatgccaagtactagtgttctatgacgcgaactgccgtggcagtgtgacaggctgctactgacgtgcagacggaagcgagtccatatcttctcccatgctgaacatgctcacaggacccttctttcgcgcgattctgaatcctataacaaggaaactggtgcatagccctctagatagacatcatagatgtgcctgagtcaggtggtctggtgatgtcctctagatctcttgtcacttcattcttagctagctaacattcagatcgctcaggagtaaacttgagtgctagtccaggaaggacgtctgttggtctgcctcagaagagtcttggggtgcacctatgtactttgagtacgacggataagctagcggaattttagtaatcctgggacgaagtcaaacagaggaattcggtgcgtcggcatatcagccagagcacacgggaagagagtgaacgcataccctgacccaatgctagacctctcgcacttgtccttgagcntagggtccgaatactggctcgatgcgggggtgctaggggttcagaccgcacgaattaaatgacccaagctgctgcagaacgtcgaagttgccccccaggcaggtcatggggactcttctggtgaagggatcatttcgccagacagcagaaccatggttccgagaagatttccacgtcattgtgggcccttgtatgacgagaagctgggagctctcaggaaagccttccccctgtttgctgctccg

SEQ ID NO: 705788 - DNA, 139 bp, Homo sapiens
gctgatgcagctggagaagaagttgcattccctgcagccgcattccttcatccgatctcttcctcaccactggagcatcaacctccaaggatgcctcgtcacatctgactcctgtgcgggcacgcatctctttgtgttc

SEQ ID NO: 705789 - DNA, 255 bp, Homo sapiens
  misc_feature (38)..(38): n is a, c, g, or t
  misc_feature (112)..(112): n is a, c, g, or t
  misc_feature (142)..(142): n is a, c, g, or t
  misc_feature (145)..(145): n is a, c, g, or t
  misc_feature (154)..(154): n is a, c, g, or t
tggcaaattcatctcttttatcctcgcttatgaataanatgtctcagggcaaccctggcctgggcagcctgctgaacatcaaggcggaacagaggggagccccgctgcggancctcgcccttcctaggcaaggcgtcgaagngcntggttcagnagaagttggcagagcctggaaggtgtacctgcgcaggtttggtacaaaggacttctgtgacggccagtgtgacttcctccacaaggcccacttccacttgc

SEQ ID NO: 705790 - DNA, 293 bp, Homo sapiens
ggataatccaagcaaggtctgtacctttcttgtttttatctcgaaatagttgattccatacatttccaggtcctgagcaaacttcaggtattccaacatagcattatcttgtgagcatcccatggatgtccgcaatgccacagctggatccggtcctcccaactggtccctggtcgattggtgctggtccctcactcttagcagggatcagccgctcagagctgagagtacccagcacttgtgcattacttggtagtagtccccaacacttggcctggccatcatgccaaggg

SEQ ID NO: 705791 - DNA, 486 bp, Homo sapiens
  misc_feature (125)..(125): n is a, c, g, or t
  misc_feature (137)..(137): n is a, c, g, or t
  misc_feature (169)..(169): n is a, c, g, or t
tatcatttacagagaagtccgtgtcccctaaacaacaggcttctttaaatttaaatgtttctcaaagtgcagaagcatttcgtggggaaatttcaaatattccagaaaaggggtaaggatggccnccataagcaaantctctgccatagacttcaattcctgaatgaanaactccaattccaatggatgaggtatattcgttcatccaatactgaaaagtggtcttcagagtgtaggaaaggagcacccccaggatctttaaataattcagctgggctattttcttgaaaaatgttagcctcattcatattttaacgaggttgcctttaacacacaaggaaagggtgtgttggctcctgttcacctttgaaaagattctagcacaggcacccgaaagctgtgaccttctggacttagaggggcttgggagtttctgaagacgtagccatggagagagtcggacagttcggcagaagcagaggagct

SEQ ID NO: 705792 - DNA, 1174 bp, Homo sapiens
agcggcgttgtaccgctgatgctatgatggtcgtccatggctgacggctcgaagtgcggatagggccgcggtgcgcctcagggcgctctggctgcatgccgctggcttcgtcggtgtttattgtcgagtctgcgctggcggctggcgtgcggcgggcagcgcgcgtgcagccgccgtgtcccgctggctgcttgtggtcgatgtgacgcgggacttgtggtgtctcctgcggccgactatgtcatgaaggccactagtcattcgagcagacgttgcaggcatcatctatccatacttccgatccgcggcgcgcttgtgagcttcggagtcccaaaggagattgttgcttcgcttgctattccgttgcaagtgacacagcgtgaacgcattgaacggatttacaccacgcactatgcgctgcgtgttgtctttgtgatagccaagcagagtgacagagcgagcctttttcatagagcctagagaggaattggcccttgagatcccttgggccccacctccgtctactttggttgcgtgtcccttgacggtcgagcgtcgtgtattgcaagctcgagtagctctggagcgcaacttacccttgcacgcgaggacacggcatccgagtggccaaggcgccccccttgcagttgtcggtagccgtgtgccaaccgcttgcgggcgagcctagacagcttcatagtgccatgtcgtccactgctcctgcctcgctccatctccgtcgtgtccttacacgcgcctgacattcctggtctgatgggcgccccgcaggggcaaaaggtctcgtcaccagtgccgaggtggaattgagtgttccctccggtgcgcagtgtccctgaaggctgcaacctcagagggtccagacccgagttggttccgatacaccaggttgtgtcccctctagcaggcgtgtcgcgccctttccgcggggcttttgtgccccgttgaattggtttgccccgttggttcgggccctcgccacgggggcttattgggtcgagagcaggcctgggttccaaggaatatcattccgccaggccacttctcaccctggctgaatccccgttcctcccctgttaaagttaccacttgaaagctccgattccgccggattcctgttcctgggggccggaaacttcactggggggcgtccatg

SEQ ID NO: 705793 - DNA, 295 bp, Homo sapiens
ggaaccttaaacttggctttcccagccttcagcctgagtctagcatgtttctagctccccagtcccttgtgaagccttgaggctggcagaagggttaggaggttgacctctagataccctctgtctttgccttcttttaccctttcctcaacctcctcgacttggcctaattgtggtcctagttctctgtctgacctattaaggcaaaggactagctatttgctagatcattgctggaaatgactagagagcagagagaggttccagagtgctaggtttggagtgaggcagaagt

SEQ ID NO: 705794 - DNA, 90 bp, Homo sapiens
gctgagccccactgtttacaggaatccagagagtttcaaggaacagttcgttcgcaagacccgcgagaaaacggtggaacccataggttg

SEQ ID NO: 705795 - DNA, 135 bp, Homo sapiens
ctgagatgacagtcggctacatcggcgtcatctgcggggaaacgccatatcgggggcaccgattattagggtgaactagtcagttgccaatagcctccgacttgtgatgggtattactagtgaagaagattatta

SEQ ID NO: 705796 - DNA, 552 bp, Homo sapiens
ccagtgcagctgatctttgacaagcaaacaaaacataaagtggggaaaggacacccttttcaaaaaatggtgctgggataattggctagccacatgtaggagaatgaaactggatccttatctctcatcttatacaaaaatcaactcaagatggattaagggcttaaacctaaaacctgaaactataaaaattctaaaagaaacattggaaaaacccttctagacaatggcttaggcaaggatttcatgaccaagaacccgaaagcaaatgtaataaaaacaaaggtaaatagctgggacctaattaaactaaagagcttttgcatggcaaaaggaacagtcagcagagtaaacagacaacccacagaatgggagaaaatcttcacaatctatacatctgacaaaggactaatatccagaatctacaacaaactcaaacaaatcagtaagaaaaaaacaaataatctaatcaaaaagtgagctaaggacatgaatagacaattctcaaaagaagacatacaaatagcccacaaacttatgaaaaaatgttca

SEQ ID NO: 705797 - DNA, 741 bp, Homo sapiens
  misc_feature (33)..(33): n is a, c, g, or t
gggtttgcttaggtcgcagaacggggaaccggnagccaacatgccagctcggcctcggagtctgggttatgtcgcatagaacattagtgtgacgcctcgcggagacccattgcgagaaatagtcgtcctcgagcagagacgctagaagctagagtcggcgacgtatgcggactccgcgaacaaactgtgaggtcctgcgagggctcaaaatttaacccgtggcacaagactaccgcaaaggaccgccacgggaacggactcgacgcatctgaatgaagaaggacccacaggcgtctgttcgaaggcaacgccctgctcgcggcttggctggtccgcattgggatgctggatgagggcaagatgaagctggaatacatcctgggcctgaagataagaggatcttcttagagagacgcctgcagacccacggtcgttcaagctgaggcattgggccatagtccatccaccacgctacgcgtgctgatccgccagcgccatatcagggtccgcaagacaggatggttgaacatcccgtccttcattgtccgcctgttgattcccagaagcacatcgacttctctctgcgctctcccatacgggggtggccgcccgggccgcgtgaagaggaagaatgaccaagaagggcccagggtaggggctaggggctggagacgacgaggaggaggattaagtccacctgtccctcctggctgctgactgttatcgttttcctgccaataa

SEQ ID NO: 705798 - DNA, 760 bp, Homo sapiens
cgagagattagctgaaacacagaatatagcgccatcattcgtgaaggggtttcttttgcgggacagaggatcagatgttgagagtttggacaaactcatgaaaaccaaaaatatacctgaagctcaccaagatgctatttaaaactggttttgcggaaggttttctgaaagctcaagtcagctcacacgaaaaaatccaatggatttcccttaagggcggaaacccggtctggattctctctcgcgtctcgtgtcgtgtcatattcgcggatagtatatgagtagcttctaagaagacacccatttatcatgctgtccgtcttccggaacaacaagcgaggggcttgcatgtctgcagtagatcctgtccagcatgaaaagatgtcacctttgaacatgttaaaggggtggaggaagctaaagaagaattacaggaagtcgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgttgtgggtgtgggagccagccgtatcagaaatctttttagggaagcaaaggcgaatgtccttgtgttatatttattgatgaattagattctgtggtgggaagagaattgaatctccaatgcatcaatattcaggcagacataatcaatc

SEQ ID NO: 705799 - DNA, 482 bp, Homo sapiens
  misc_feature (318)..(319): n is a, c, g, or t
accctacgccagaagcctcttaccctgttatccatccctgctgtgcacctaaggtgcaccccatgccctatcagctgtggccacatataggaaccctgcaccggagctatgcatgcctactgtgaggacttgaaagaccttggctttgcgcacgccaacaggctcttccaaccagtgcctttcctccaaatgatatggcgatgttttgctttcccaggtcgatcttaagccattcccaacaaggagtggacatccttgtgtgaaaaacactgtttttcttgctccagtcacgtctccttgcctttcttgtcttttggnnggagtgtgcagaagcagaggtgcaggaaatgttgaaagggatcacattctaagaatgtagttataatggcctgaagaattcaagagaatacatggttggaagatgtgtcactttatggttacactataaaactccaaatgaaaaataaaatatcattcatact

SEQ ID NO: 705800 - DNA, 667 bp, Homo sapiens
  misc_feature (387)..(387): n is a, c, g, or t
  misc_feature (446)..(446): n is a, c, g, or t
  misc_feature (492)..(492): n is a, c, g, or t
  misc_feature (532)..(532): n is a, c, g, or t
  misc_feature (553)..(553): n is a, c, g, or t
  misc_feature (589)..(589): n is a, c, g, or t
  misc_feature (635)..(635): n is a, c, g, or t
agtttgaccatgaggtgaggttcctataaaccttttataaccctttacaaatttttgttaaagagcagatcaatacattaagaaaaccctgttatgctttaattccaatgcttgatttacggaaaaaccaaatcatacccttttgaatttagttgatctcaaatgaagtttcttttacaagattaatttttaccaacctttcacaacttctttaaacctttagctttatcttatctgatttaaaacaattctttaaccctctaaactaggcaaaaatttatattcccaagccttcttataatattttaccaaaaatatattttactttctttacacaccttgcatgtaaatctatttttagtagtcccaattatgtgttataatggnaactcttagcaatttttaattttagtggaaaacccgggaagctgttttaattatgtacnaggtgcagctaagatctggacactttccagtataagtaagaggggntagttaactccacaagtcccaagggcttaccaaactggtnaagcagacaagccgaacaggntttcaaaaatccaaagaaagcagtttatgaccttanagcatttagcaaacctaatatccgaacataatttagaccacaaggntttacattttgaagacatttgtattttaccaa

SEQ ID NO: 705801 - DNA, 167 bp, Homo sapiens
aaagttttattttacattgggattttacatttaaatataactttttttaatgctattttatgaaagatattggtaataaacttgatggggttgtattttggttaatcttccatgaattgaaataatggttttttttaaagcaaaataaagttttttaaataaatgtt

SEQ ID NO: 705802 - DNA, 277 bp, Homo sapiens
aaagttaaattttggctggcatggaggtacatgcctgtagtcccagctgctcgggaggctgaggtgagaggattgcttgagcgcaggagttcaaggctgcagtgagccatgattattgccactgcactctagcctgggtgacagagagagaatctgtctcaaaaaaaaaaaaaaaaagggaaaaggggtatgggtttggaaactagataaatctatgtaaaaattcgggaataaacggggatggttaaattatttcttcattaataaaaggaggata

SEQ ID NO: 705803 - DNA, 142 bp, Homo sapiens
tcgcaggacccgaacacgatacggacacacacagaggagccaaaccaaaccccgaacaacgggaggcaactccgacggcaaccgagtggttagggctccccagacaccatgacggtcagggcctcctaaaacgcctactgca

SEQ ID NO: 705804 - DNA, 901 bp, Homo sapiens
gaaatagtcttaaaatagggaaaagagtgaaagttactcttatgcatgggagtgggcttaaagggttgacttccaccagctgagtacaaacaaggtgtaaagaaaaactatggataaagtatggagtgtcattgagcaatatgttccataatgcaaatctttaatctgggttcatcagcagtcaatgcaacatccacccaataagacaacgattcccatttcatcttggatcttctgtggttcagcagcaggagtcatggtctagctcatgtacagccagccttgcacaggcaaccaacgtcataaaggaatgacccttacaacaaggtagcttacgtataacctgggtagtattgggcacacaggtactctgaacgagtgacactgcagaacctcagcttggctgtgtttgtacaatcttgtcccacatggaccctacacctttaggtacgaactatgcagatcataatataagtccacgtaagaaaagcacaaatgtgcctctgcacatactgttgcatactctctggattatactgcatgcgcacacgtctacccctgccagagctgcgactgcgggtgtggaaaaatacgaggttaaactgcaactacacttgggtccggtatacacggatgtcaatttatggacatggaacgcgatgtgttatcgaatgtacctctcagacttcacagatgattaacgttatggtaatgatttacacttgggcacttggggaataccacagttacgaaagttacgagcgaatcgcattacgttaacagaccaacaccacgatgggattgctcattaaaagccccctcatgttcactggtaatggaacagctaactagcccagtaacattgtgaagcgaatattattgacgatagagcagatatagg

SEQ ID NO: 705805 - DNA, 440 bp, Homo sapiens
  misc_feature (176)..(176): n is a, c, g, or t
  misc_feature (317)..(317): n is a, c, g, or t
  misc_feature (324)..(324): n is a, c, g, or t
  misc_feature (330)..(330): n is a, c, g, or t
  misc_feature (343)..(343): n is a, c, g, or t
  misc_feature (345)..(346): n is a, c, g, or t
  misc_feature (379)..(379): n is a, c, g, or t
  misc_feature (388)..(388): n is a, c, g, or t
  misc_feature (420)..(420): n is a, c, g, or t
  misc_feature (423)..(423): n is a, c, g, or t
  misc_feature (426)..(426): n is a, c, g, or t
cctggagctaccaggctcctcagtcatcagggtccctcccaacactaaggctttcctaggcaggagctgggctgagccacccggggggcagagcctgaagagaaactgactgggctttcggggtcggggcagagggaaccccacggacatggatcccacactggaggaccccaccncgcccaaatgcaagatgagaagatgctccagctgcagtccaaagcccaacacccccaagtgtgccatgtgtgatggggacagcttcccctttgcctgtacaggtggagaagccgaggacaggctcagggaaccggagaccnagaaggngctgtnctcttcactgcangnnccctggaccagtgccggccctgatcatgcagcncttccaggnccactgcttcttcctgtccactaggccacagncgnccnccaggcccactatg

SEQ ID NO: 705806 - DNA, 242 bp, Homo sapiens
ctcccctgacgtctggtgtactcctccagccggaagcagcagaatgtggaccaggcggtggccactgctgcaagggggaggggctgatgcgtgacgggcaccgtgtgctatgtgagggaacggcggaggacccgggagcggctaggtggccatggcatgtgaagcttcagtggcggtatcgatatcctagtctccaatgctgctgtcaaccctttcttgggaagcctattggatgtcaccga

SEQ ID NO: 705807 - DNA, 555 bp, Homo sapiens
  misc_feature (9)..(9): n is a, c, g, or t
  misc_feature (25)..(26): n is a, c, g, or t
  misc_feature (34)..(34): n is a, c, g, or t
  misc_feature (38)..(38): n is a, c, g, or t
  misc_feature (43)..(43): n is a, c, g, or t
  misc_feature (49)..(49): n is a, c, g, or t
  misc_feature (55)..(56): n is a, c, g, or t
  misc_feature (65)..(65): n is a, c, g, or t
  misc_feature (68)..(68): n is a, c, g, or t
  misc_feature (73)..(73): n is a, c, g, or t
  misc_feature (92)..(92): n is a, c, g, or t
  misc_feature (127)..(127): n is a, c, g, or t
  misc_feature (132)..(132): n is a, c, g, or t
  misc_feature (140)..(140): n is a, c, g, or t
  misc_feature (145)..(145): n is a, c, g, or t
  misc_feature (147)..(147): n is a, c, g, or t
  misc_feature (152)..(152): n is a, c, g, or t
  misc_feature (155)..(155): n is a, c, g, or t
  misc_feature (162)..(162): n is a, c, g, or t
  misc_feature (174)..(174): n is a, c, g, or t
  misc_feature (194)..(194): n is a, c, g, or t
  misc_feature (212)..(212): n is a, c, g, or t
  misc_feature (221)..(221): n is a, c, g, or t
  misc_feature (230)..(230): n is a, c, g, or t
  misc_feature (242)..(242): n is a, c, g, or t
  misc_feature (273)..(273): n is a, c, g, or t
  misc_feature (279)..(279): n is a, c, g, or t
  misc_feature (284)..(284): n is a, c, g, or t
  misc_feature (286)..(286): n is a, c, g, or t
  misc_feature (293)..(293): n is a, c, g, or t
  misc_feature (296)..(296): n is a, c, g, or t
  misc_feature (309)..(309): n is a, c, g, or t
  misc_feature (318)..(318): n is a, c, g, or t
  misc_feature (329)..(329): n is a, c, g, or t
  misc_feature (333)..(333): n is a, c, g, or t
  misc_feature (346)..(346): n is a, c, g, or t
  misc_feature (369)..(369): n is a, c, g, or t
  misc_feature (390)..(390): n is a, c, g, or t
  misc_feature (417)..(418): n is a, c, g, or t
  misc_feature (421)..(421): n is a, c, g, or t
  misc_feature (435)..(435): n is a, c, g, or t
  misc_feature (437)..(437): n is a, c, g, or t
  misc_feature (441)..(441): n is a, c, g, or t
  misc_feature (470)..(470): n is a, c, g, or t
  misc_feature (472)..(472): n is a, c, g, or t
  misc_feature (486)..(486): n is a, c, g, or t
  misc_feature (524)..(524): n is a, c, g, or t
tggaaaaanaagtttatttgtaaanntagtcaanaaanaaaantgaccnaaaaanntcagtaaanttnaaaancactgggaaggccaacccnaaaaaaaagaattccccaggacagtaaccagaagnaaccnaacccaanaccancnaaatnggnagagggncagggggcgggngttttgggccccccccccanaccaagtttttaaaaaanaaaagccanaagaaaaanaaccccgggacngtttccccagcagaggagaaaaacccaaccnagtaangagancnaccacanaanaaaaagaaaagcngccccaacnagtcagaatgnaagnaaaagaagaggcnggggggaaaaacccgttttttcnagagccccaataaaataaaancccccagtaagtgtttgcattatcagnnagngggtaaaatgtggnanaatnagggcttatgcaagggataaatgcgcctngnattttactactatnagaacaagttcagttagaagaaaaccaactgggctttnaattacacaaaccttaatgacaagactcccc

SEQ ID NO: 705808 - DNA, 291 bp, Homo sapiens
tttttcctgggaaaaagcccggggggccccccccacttgtggggagaaaggtgtccttctttttttttcggcagaggaggggaaattagcccttccccccgggtttaaagggggggcccaaattcccgggggaaaaagggggcggggggtttttccccccaaacaaccccggttcggccccgggtttggtaaaaaaaaagggggtttttaggggttgtttttttttgtccccctttgggaaaaaaaggggtcctgtggggtgggggttttttttaaagggcccttttttta

SEQ ID NO: 705809 - DNA, 541 bp, Homo sapiens
atagagaatttgagcgtgagattacttaagaggctatgagatatatatgtcctgaaggactagggctcacttagttctgaagccccaggaggtagccaggttacaatgggagagtcatgagcgtgaagagtcagagtctgctgcctgtgtgttcagtgcagcctgatctccaagcaagcttctgcttccctcatttcctccatgggaacctgcactacctaacatctccttgtttggggcaagaggtgtgtttccttggtttccgtgttcttagaggacctctgttcttatatctaaaagagactaattcaactgtccttcttggtgtcgaatttagagtgccacatgtttggctctattcttggaaaaaatcatctaacattagaacataattttataatttacagagtgctttaatgtatattatgccatttgcttctcacagcaacctcgctctgtgaagtttctttatttcctctacgtgggaaatttctctcttacacacttcttgatcattttcatctctcctttcacaggcaaa

SEQ ID NO: 705810 - DNA, 333 bp, Homo sapiens
ggggggggggggccgaagggaaattttccccttgggcccaaatttaccgttgaaaaatttaaaaaacccaatcggcccgggtttccgggggttaaatttcccggaaagggtttccccctttgaattgggcctttagggttaaaaaccaaaatttccccccccccccttttacccggggggggaaaaaattttttccaagggcccaaaggtttttgggcccaagggaaagttttttttgtaaaaaattttggccccccttttggccaaaatttttcccccccgggccatttttaacccgggttagggcccaaaaaattttttatttttttccca

SEQ ID NO: 705811 - DNA, 137 bp, Homo sapiens
tctagcaggatctgatctggacacgtcagaacatcaacaagatcttggtctccaagcggtcaatccagttcctggcactcctcctctctctagctggataagtagccagctacttgctttggaaaaagggggaaaaa

SEQ ID NO: 705812 - DNA, 279 bp, Homo sapiens
gcactgtcatccaacactttgagcaggcccgaggctgtgcaatctacttgaggccaggagttcgagaccagcctgacaagatggtgaacccctgttactacaagaaatataaaaattagccgggcatggtgacacatgcctgtagtcccagctacttgggaggccgaggcaggagaatcacttgatccctggacggcggagggatttgcgggtgaagccggagaatctcggccaattgcattcccaggccgtgggttgacagacggggaggacctcttg

SEQ ID NO: 705813 - DNA, 536 bp, Homo sapiens
gtcgacaagatttcgaaagtcaaggaagactgagcaactagttaaaatgaagagcccagagcagccatgacagacagcatgggatagcacagcacagacagcacagaacagcacagacagcacagcacagcacatcacagacagcacagcacagcacagacagcacagcaaagacagcacagcacagcacagcacagcacagacagcacagcacagcacacacagcacagacagcacagcacagcacagcacagacagcacagcacagacagtacagcacagcacaacacagcacagacagcacagaaagcagaggacagcacagcacagcacagacaacacagacagcacagcacagacagcacagcacagacatcacatacagcacagcacagcacagcacagcacagacagcacagcacagcacagacagcacagcacagcacaggcagcacagcaaagacagcacagcaaagcacagcacagaccgcacagcacagcacagcgcagcacagcacagcacagacagcacagaa

SEQ ID NO: 705814 - DNA, 227 bp, Homo sapiens
tcgctattcatcggcaccagggatgataaacaactcagaattgtttgggtggggcacggtatggggctcatgcctataatcccaacattttgggaggtcaaggcaggagaatcgcttgagagcagagagttgaagaccagcctgggcaacattgtgagatccccatctctacgaaaataacattaccacaatagttagacatggtagcaggtgccgatcaatagcga

SEQ ID NO: 705815 - DNA, 116 bp, Homo sapiens
gccctgatgttccactgcagtgtctgtgacaactgtgtggaggaatttgatcatcactgcccctgggtgaataactgtattggtcgccggaactaccgttatattttccgttttcc

SEQ ID NO: 705816 - DNA, 783 bp, Homo sapiens
cgcggtggctcacgcctgtaatcccagcactttgggaggccgaggcgggcggatcacaaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactggactccagcctgggcgacagagcgagactccgtctcaaaaaaaacaataataataaagactttaaattataaaaaaaccagacgggttggaagtttggaggcttcaaagtgggggtggagtaagattactggtaaaaggattctaagacgccttacacagggttctccaaggggacagattattcggaatatcagattaagaagacaatatttctatgaaacggcgggggcactaacagtgactgtttggccaagcaactcaggggcaatgcaagggcccaaaaatgccctgcaggctcttgggaacttcttgcccgaaggtgtgcccatctaattcctaatctctccaaggaaggtcacagatggactctccaacgacacgtcgcgggcgcaatcgggtcctggccaatgtgtacattcgccgggtcaaaatgggccaaaacgcctccgggtccaccttggtggcctaagggggaccaggatctttgcctcggtgaacaggataataacacccaggcattggtaaggtaacccttggaaccgtg

SEQ ID NO: 705817 - DNA, 465 bp, Homo sapiens
gcatcccccaccccgtaattagcatcgtttagttcacaaaacctttcctgggagaaatctgttctctcgttccggggctcggttcagcacctgattccgccgggtgaagcgaataaatcactgcggcggcgggggagccggacccaagcccgccagacggtggccgccgggagaacgaaaaagtgagaaagaggcagcggagccaggaaaaatgatgcagggagacggcgcaatcctagcccaggaagagtgaggggcccgggaagggaaacccagaggcagagaaggggccaaaatggaagagggagatacagaaagagacagaagagaacaagaaggagagtgccaaggaaaagcgaacgaaaagaaagggaaaatgaggaagggaaataagttaaagaaacaagagcgaagagggagattaagaaggaagggacaggcgaataaagaaaataaaaaaaaaaa

SEQ ID NO: 705818 - DNA, 364 bp, Homo sapiens
gaccaccactgcactccagcctgggagtcagagcgagactccgtctcaaaaaaaaaaaaaaataaaaaaaatcagacactggtgcaaagtgctatattaacatttgtgcttgccgcatgcagtggctcacgcctgtaatcccagcacttggagaggatgaggagggtggatcacttgaacccaggacttatagactagcctaggcaacatggaggaaccccatctctacaaaacatacaaaaattagccaggcacagtgatgtgtacctgtagtcctagctacttggtaggctgaagtgggaggatcgcttgagcctgggaagttgaggctatagtgagccaagatcatacaactgcactgcag

SEQ ID NO: 705819 - DNA, 117 bp, Homo sapiens
  misc_feature (85)..(85): n is a, c, g, or t
atttaattgcattgaaaatgtcatcctttctgttgttagataattggggtcttcccctgatatccaaccgagaaattgcctccantgggagagtgtgtcatccagcttttcatgttt

SEQ ID NO: 705820 - DNA, 225 bp, Homo sapiens
tttgccggtcgcatctcgcggctaccccccggtcagctaggccactctgctattcctgcctgtttttcctcccacaatttgtgtcccccccactgtgctcaggccagtttccactggggtggggttcacagttccaggtccagtccagttcagcagcagcacaacattgtcatgctccagctccgggtcccgcagctcgcacattcagtactccatggtcctcag

SEQ ID NO: 705821 - DNA, 2399 bp, Homo sapiens
gtcaaggactcattgtgggtgcccaacatgatgtcctacagcgagagattggggggaccggctgtctccccacttccagtccgtgggagacacatggtgcatggggcaacctttgcttatgtgcccagcccacaagtcctgcacaggattcctggaacatccacctatgccatctccagtctgagcccggtcaccctcacagagcacagctgtccctgtggggaagtcctggaatgtcatgacccactacctaccaagctggctcaggaagaggagcaaaagccagagcccaggctgtcccagaagcttgcccaggttggcacgaagctcctgaaggtgcctctgatgctggctttcctttacctctttgtctgctccctggatgtgctcagctccgccttccagttggctggagggaaggtggctggggacatcttcaaggacaatgccatcctatccaacccagtggcagggctggtggtggggatcctggtgacagttctggtgcagagttccagtacctctacatccatcattgtcagcatggtctcctccggcttgttggaggtgagctccgccattccgatcatcatgggctccaacatcggaacctctgtcaccaacaccattgtggccctgatgcaggcaggggacaggactgacttcaggcgggcttttgcaggggcgaccgtgcatgactgttttaactggctgtctgttctggtcctactgcccctggaggctgccacgggctacctacaccatgtcaccgggcttgtggttgcttccttcaacatccgaggtggccgtgatgcccccgaccttctcaaagtcatcacagagcccttcacaagactcatcatccagctggacaagtctgtgatcaccagcattgccgtgggggatgagtccctgaggaatcacagtctcattcggatttggtgtcacccagacacaacagaggcttccacttctatgtccagggtagaggccatcggcagccttgcaaacaccaccatggagaaatgcaaccatatcttcgtggatacggggctgcccgacctggccgtggggctcattctgctggcgggctccctggtggttctctgcacttgtcttatcctccttgtgaagatgctcaactccctgctcaagggccaagtggccaatgtcatccagaaggtcatcaacacagactttcctgcccccttcacctgggtcacgggctactttgccatggtggtgggtgccagcatgacctttgttgtccagagcagctccgtgttcacctcagccatcaccccactcattggcctgggtgtgatcagcattgagcgggcctaccctctcaccctgggctccaacattggcactaccactacagccatcctggcagcgcttgccagccccagggagaagctatccagctcatttcagattgccctctgccacttcttcttcaacatctcgggcatcctactgtggtacccgctgccctgcacacgcctgcccatacgcatggccaaggccctgggcaaacgcaccgccaagtaccgctggtttgctgtcctctacctgctcgtgtgcttcctgctcttgccctcgctggtgtttggcatttccatggcaggctggcaggctatggtcggagtgggcacgccctttggggctctactggcctttgtggtgcttgttaatgtcctgcagagccgaagtcccgggcacctccccaagtggctgcagacatgggacttcctacctcgctggatgcactctttgcagcccctggatggccttatcacaagagccaccttgtgttatgccaggcccgagccccgttcaccccaacttccccctagagtcttcctggaggagcttcccccagccacgccctccccccgcctggcactgcctgctcaccacaatgccacccgtctctaggctacaggccccgactactgcctggaacgaggagtggtatttttacaatgcccacagtagaaagacagagcatgtgtgtgtgtgtgcacacatgtgtagatgcgtgtcacttgaggtacatgcttttgtgccacccttgggtacctgtgcatattaagggccacagtggcatgggcttttgtaattaagaggtagtgtgcacaaatacatgctaggtactgagcctgtgtgaccattagtgcgggtgtaatgtgagtacactgtgtgggtacaggggggtgcagatgcctagggagtctccaaacttttctggaaagagtcagctataccctctcatcttctcacaactcttgtaccaacaggagggacagaagaacagctggccttctgtatacatgggccttacttctgccaattctgctaactgtgcatagaaaaaaaaagttgaaagttgcatc

SEQ ID NO: 705822 - DNA, 189 bp, Homo sapiens
ggatcccctccccccgttttggccgggaaaacccccccggtcccgaaggttttgggggttcccgcctccctcaggtccccgggggttcccgggggcaacccccgaatttttccggaggcccggtcccccccccccaggcggtttcccccccgtccttcaaatcaattttttccccccccgcgccggcca

SEQ ID NO: 705823 - DNA, 315 bp, Homo sapiens
gccccccccccccccgggttttgggttttgggggggggaatttgcccccccgcaaatttttgagccccccctgcccgggggcccccccaaggggggcccccgaaaggttttttggttccttgggcccgaggggggccccccccccaaggcccggggcctagggctggctccggcccggggggggcaaaaaagggccaagggggggggtggggcagggccctgcccccctcctgccctttccccccccccccgtttttccccccttggttttgaatttttgttttttggccataaaccaaaaatccccccttggga

SEQ ID NO: 705824 - DNA, 2162 bp, Homo sapiens
gtcaaggactcattgtgggtgcccaacatgatgtcctacagcgagagattggggggaccggctgtctccccacttccagtccgtgggagacacatggtgcatggggcaacctttgcttatgtgcccagcccacaagtcctgcacaggattcctggaacatccacctatgccatctccagtctgagcccggtcaccctcacagagcacagctgtccctgtggggaagtcctggaatgtcatgacccactacctaccaagctggctcaggaagaggagcaaaagccagagcccaggctgtcccagaagcttgcccaggttggcacgaagctcctgaaggtgcctctgatgctggctttcctttacctctttgtctgctccctggatgtgctcagctccgccttccagttggctggagggaaggtggctggggacatcttcaaggacaatgccatcctatccaacccagtggcagggctggtggtggggatcctggtgacagttctggtgcagagttccagtacctctacatccatcattgtcagcatggtctcctccggcttgttggaggtgagctccgccattccgatcatcatgggctccaacatcggaacctctgtcaccaacaccattgtggccctgatgcaggcaggggacaggactgacttcaggcgggcttttgcaggggcgaccgtgcatgactgttttaactggctgtctgttctggtcctactgcccctggaggctgccacgggctacctacaccatgtcaccgggcttgtggttgcttccttcaacatccgaggtggccgtgatgcccccgaccttctcaaagtcatcacagagcccttcacaagactcatcatccagctggacaagtctgtgatcaccagcattgccgtgggggatgagtccctgaggaatcacagtctcattcggatttggtgtcacccagacacaacagaggcttccacttctatgtccagggtagaggccatcggcagccttgcaaacaccaccatggagaaatgcaaccatatcttcgtggatacggggctgcccgacctggccgtggggctcattctgctggcgggctccctggtggttctctgcacttgtcttatcctccttgtgaagatgctcaactccctgctcaagggccaagtggccaatgtcatccagaaggtcatcaacacagactttcctgcccccttcacctgggtcacgggctactttgccatggtggtgggtgccagcatgacctttgttgtccagagcagctccgtgttcacctcagccatcaccccactcattggcctgggtgtgatcagcattgagcgggcctaccctctcaccctgggctccaacattggcactaccactacagccatcctggcagcgcttgccagccccagggagaagctatccagctcatttcagattgccctctgccacttcttcttcaacatctcgggcatcctactgtggtacccgctgccctgcacacgcctgcccatacgcatggccaaggccctgggcaaacgcaccgccaagtaccgctggtttgctgtcctctacctgctcgtgtgcttcctgctcttgccctcgctggtgtttggcatttccatggcaggctggcaggctatggtcggagtgggcacgccctttggggctctactggcctttgtggtgcttgttaatgtcctgcagagccgaagtcccgggcacctccccaagtggctgcagacatgggacttcctacctcgctggatgcactctttgcagcccctggatggccttatcacaagagccaccttgtgttatgccaggcccgagccccgttcaccccaacttccccctagagtcttcctggaggagcttcccccagccacgccctccccccgcctggcactgcctgctcaccacaatgccacccgtctctaggctacaggccccgactactgcctggaacgaggagtggtatttttacaatgcccacagtagaaagacagagcatgtgtgtgtgtgtgcacacatgtgtagatgcgtgtcacttgaggtacatgcttttgtgccacccttgggtacctgtgcatattaagggccacagtggcatgggcttttgtaattaagaggtagtgtgcacaaatacatgctaggtactg

SEQ ID NO: 705825 - DNA, 351 bp, Homo sapiens
  misc_feature (79)..(79): n is a, c, g, or t
aaaacaattagtaagtatttatacatcttaaacattaggaaaggggacagtaaaaacacagcattatggccaaggtgcnggttgtcacgcccgcaatcccagcaccctgggaggccaaggagggcggatcacccgaggtcaggagttcaagaccagcccgaccaacatggaaaaaccccgtctctaccaaagacacaaaaccagccggttgcggtggcgcaagcctgcaatcccagccaccagggaggccgaggcagaagaatcgcccgaaccagggagcggtggccgcggcgagccaagaccgcaccactgcaatgcagcctgggcaacaagagcaaaaccccgtcccaa

SEQ ID NO: 705826 - DNA, 112 bp, Homo sapiens
ctcgtctagaggatccagcactgtgacgctccttggtagcataaacacagtgcagatctaatggttgaattttttttgttgttatttaaagtcaaggtctcgctcctgtcgc

SEQ ID NO: 705827 - DNA, 581 bp, Homo sapiens
taatggagagagaccactgagggaagggtcttttttggaatagggagaacataattatgtttataaacaggtgggaaagcaaccaggaaagaaagcagcaagggagaaggaaacataaaaacaaaaagaagaaacaaaaaagggcagaagcaaacttttttttttttccccaattggaaatagtttggctgaaagcacttttttgggtagggtgtataaatttcctagggctggctgctgctggctgtaacaaatgtaccatcaactgggtaggcgtttcaaacagacaatggtattggtgctcacaccttctgggaggctagaagtctacaaatcaaggtgttggcagggccttgatccctttgaaacctgtagggaatcttttttggcctcttcctagcttcggggggtatggcgggcagtcacgggctcttctcagatctacaaattctatgactccggtgcactaatagacggtatcattacagagtccatatccttaaagggacacttacttacagtctttactgctcgggcctatagcctgcaagtgggtgtccatattcatcatcatcatgtga

SEQ ID NO: 705828 - DNA, 161 bp, Homo sapiens
  misc_feature (53)..(54): n is a, c, g, or t
gactctacaggatccccctgctccgcccctctctgtcagcaccatctgctccnncctgctcataatccttctcaagggcagccaggtccttatgtccctctgaaaactcgcccccctccatcccctcacccacgtaccagtgaacaaaggcacgcttgtca

SEQ ID NO: 705829 - DNA, 106 bp, Homo sapiens
  misc_feature (81)..(81): n is a, c, g, or t
ttggcaagagggtgagaatattatatttcgatgtgtggatacgattatccgcatactggaacttttcattatattcacggncattggctttcactatccgttccac

SEQ ID NO: 705830 - DNA, 232 bp, Homo sapiens
tggccggccaatctccatgctaccagtcgaaaggcacatatatccacacatgcacacacagcacacacacaaacgcacagcacacacaaacgcacagcacacacgcacacacagcacacacacgagcacacagcacacaaacgcactgcacacgcacacacatgcacacacagcacacacactagcacacagcacgcacacaaagacacagtacacatggaatgcacacaca

SEQ ID NO: 705831 - DNA, 253 bp, Homo sapiens
agaggatccgtgagagtactcgtggtctgagaataggccatctgcgctgtgtgccgcaccagcctcaacggggcagtacagtgcgtacgtgagatgagtgtgctacttcactggcacatcacagatgtctcctcgtgatcgtgtatccagcggaaagagtatgtggcagcagtgcgcctggagcgatgtgtgctgacctgtgagctatgccgggcctgggcagagtgtgcgctggaccaaggatggagaggag

SEQ ID NO: 705832 - DNA, 419 bp, Homo sapiens
  misc_feature (102)..(102): n is a, c, g, or t
  misc_feature (117)..(118): n is a, c, g, or t
ggcacaaaaaccaatctcaggggctccacccagtggcagcagggtcaattttggggccaaaacccatgaagtcagcattatccccaaggatattattgaatncccaaataaaacganntgaaacatatttctccaaaaccttcccaagaagtcgactgttttctttagtaggctaactttttaaacattccccaaaaggaagggcctgcgggttccttttttaaaagctttgtgggttgattttttttcttttcttttttgcgccatttttaattgcagtttaaaagtgaatggtaaaagaacctcagcattgtgcccgataaaagaatgggccaggatttcagggttttacattttatctgtaaaatgtgacttttttttttttttttatcccaacaaaagtaaaatgttgctttgta

SEQ ID NO: 705833 - DNA, 993 bp, Homo sapiens
gacgtgttcggggagcaggccaccttgtggggtggccaatccgggacgggaatcttaaacttttaactcttggtgcaaagactgatccactggcggctttacggtgagcgggaacacacacagtcatgtgaagcttgcccaggtctcgagaccgaggtcacgaggttcagcagcctgccggctcccatttggcacccatagacgcagcagtgttttgcccgccaaaactggcaggacctccagcaattgagattcttgggtgtgcaccaggcctttcacgcgtcattcagccggcgttcctacaccaggcactgcaatcgaccctacacttgaggaccagcttatagggtcagggagaattggtgccatggaagtgagacctgctctctgctttcaaggctccagctgtatccactacatgtgctcaagggcaaaatcctctcatcctaggtcctcaggacttcttcatctggcaagaatgaccaggactggcggcgtccccggacggctagccggtacctaaaatgggttggaaaggccaagcaagccccctggaactcaggcaagcttcagccaatgaacaggagcacgaagccagggaagggccccggggcataatcggagcgaaggcaggatagagaaaggcaagaaaacgaagggcagggtgagacactttcaagagagaattggatgtctggggaaaaatacatgagaaaggaaattccccaagaaaacaggggacagggacaatgtggacaacgaccatacagataagaaagcagccggtcacagtatactcgcgaaaggcgacgacacggagcaacatttggcgcatgtgggcccataaagatgccaagaaacgggtgcgccaaacaaacgggaccatggcaccacagggacaggtggaaaggacacaaggacaagcactacggtgtgacagacacacgaggagaaaagacgacccgggaaaagcggggaggtgcgaaccaacgg

SEQ ID NO: 705834 - DNA, 895 bp, Homo sapiens
  misc_feature (52)..(52): n is a, c, g, or t
  misc_feature (64)..(64): n is a, c, g, or t
  misc_feature (67)..(68): n is a, c, g, or t
  misc_feature (79)..(80): n is a, c, g, or t
  misc_feature (100)..(101): n is a, c, g, or t
  misc_feature (114)..(114): n is a, c, g, or t
  misc_feature (120)..(120): n is a, c, g, or t
  misc_feature (135)..(135): n is a, c, g, or t
  misc_feature (137)..(138): n is a, c, g, or t
  misc_feature (141)..(141): n is a, c, g, or t
  misc_feature (145)..(145): n is a, c, g, or t
  misc_feature (147)..(148): n is a, c, g, or t
  misc_feature (150)..(150): n is a, c, g, or t
  misc_feature (154)..(154): n is a, c, g, or t
  misc_feature (175)..(176): n is a, c, g, or t
  misc_feature (180)..(180): n is a, c, g, or t
  misc_feature (185)..(185): n is a, c, g, or t
  misc_feature (188)..(188): n is a, c, g, or t
  misc_feature (199)..(199): n is a, c, g, or t
  misc_feature (202)..(202): n is a, c, g, or t
  misc_feature (230)..(230): n is a, c, g, or t
  misc_feature (244)..(244): n is a, c, g, or t
  misc_feature (262)..(262): n is a, c, g, or t
  misc_feature (275)..(275): n is a, c, g, or t
  misc_feature (278)..(278): n is a, c, g, or t
  misc_feature (302)..(303): n is a, c, g, or t
  misc_feature (306)..(307): n is a, c, g, or t
  misc_feature (309)..(310): n is a, c, g, or t
  misc_feature (312)..(312): n is a, c, g, or t
  misc_feature (317)..(317): n is a, c, g, or t
  misc_feature (323)..(324): n is a, c, g, or t
  misc_feature (327)..(328): n is a, c, g, or t
  misc_feature (332)..(333): n is a, c, g, or t
  misc_feature (346)..(347): n is a, c, g, or t
  misc_feature (349)..(349): n is a, c, g, or t
  misc_feature (351)..(352): n is a, c, g, or t
  misc_feature (357)..(357): n is a, c, g, or t
  misc_feature (360)..(360): n is a, c, g, or t
  misc_feature (391)..(391): n is a, c, g, or t
  misc_feature (397)..(397): n is a, c, g, or t
  misc_feature (401)..(401): n is a, c, g, or t
  misc_feature (404)..(404): n is a, c, g, or t
  misc_feature (410)..(412): n is a, c, g, or t
  misc_feature (415)..(416): n is a, c, g, or t
  misc_feature (418)..(418): n is a, c, g, or t
  misc_feature (440)..(440): n is a, c, g, or t
  misc_feature (445)..(445): n is a, c, g, or t
  misc_feature (452)..(452): n is a, c, g, or t
  misc_feature (459)..(459): n is a, c, g, or t
  misc_feature (461)..(461): n is a, c, g, or t
  misc_feature (466)..(466): n is a, c, g, or t
  misc_feature (478)..(478): n is a, c, g, or t
  misc_feature (482)..(482): n is a, c, g, or t
  misc_feature (485)..(485): n is a, c, g, or t
  misc_feature (745)..(745): n is a, c, g, or t
  misc_feature (786)..(786): n is a, c, g, or t
  misc_feature (849)..(849): n is a, c, g, or t
cccagtgattcccctgactcagcctcctgagtagcggggattacaggcaacngggagtgggccnggnnaatttttttgnngtttttaggggagatagggnntcaccatcttggncaggcnggtgctttaactccngnnctngggntnnanatgnctcaggcgctgcccaaagggnngggnttacnggnatgagcgcacngcncccagccagatatcgagctatttcatcnccatccagccttcnaacaaaagcattaggggnaaaaaaaggggcnggngggggggggggggggggggggagnnggnnannanggggnggagcnnaanncgannaaaacgctagagnnangnntcacnggnaagaataaaacaaaaacactattaatatgcntcaatnaccnttnttaagnnnccnngnaatccttcaggtttctcccacnggggngcttaangcaaaananatggnatttataaaacntttngcnttaaaaaaatactttccaaaaaatttggacaaaatttacagtcattatgtacaaaacactacaggtctacaatttaaaacatatttgaaaaataaaacagaacatacatcccagtactgtgcagacaatatatgtgaatgctacgtaaccaagaagaaaggacagaacgagggattagaagttactggaacttccacaggaattttagagccaggcagggcttctcataaaggtttcacagaattcaggtctgataagtntcaaaggccttttgatatcttggggcaagggagagtgaganataaactgaataagaactcagaagaggaacaactagtatgcagaaattaaaaacatgtatcanggagaggaagagtatataaagtaggatgctgaaaaagagaggcaag

SEQ ID NO: 705835 - DNA, 427 bp, Homo sapiens
  misc_feature (19)..(19): n is a, c, g, or t
  misc_feature (44)..(44): n is a, c, g, or t
  misc_feature (56)..(56): n is a, c, g, or t
  misc_feature (87)..(87): n is a, c, g, or t
  misc_feature (123)..(123): n is a, c, g, or t
  misc_feature (198)..(198): n is a, c, g, or t
  misc_feature (236)..(236): n is a, c, g, or t
  misc_feature (244)..(244): n is a, c, g, or t
  misc_feature (302)..(302): n is a, c, g, or t
  misc_feature (377)..(377): n is a, c, g, or t
  misc_feature (396)..(396): n is a, c, g, or t
ccggggcaaacctcagggncctcctgaggcccaaaatttgtgcnccgtgggacaantttggtataaccatacatttattttggtaantcattctcccaaatttgaagctttattaaagggtantcctatttcccactggcttccccttaacttgaataaaatttactccccagtgccgtggctcatgcctgctgcaancccagccctttgggaggccgaggcaggaggatggcttnaggccaanagtttgagaccggcctgtgcaacatggcgagacccagtgtccacagaattaaaaattnaccacgcagctgtaatcccagccacttgggaggctgaggcaagaagatgacttgagccctggcatttggctatgntcttgccactgcactctancctggcaacagagtcagactctgtctcaaaa

SEQ ID NO: 705836 - DNA, 813 bp, Homo sapiens
tacaggcttccgggtcttaaagggggcgggggctgggggcagttcatccaaaggtggctccgaaagcttgaggtcaacctttgggggtgggcctctgtgcagggcaaaggggatggtaaggggcccgtacaggcgtggggggactcttgaaaggcggaaggaaagccccagtgggttggcagccacagcttcaaagtttggaggaggagctttccctgtggcccagtccccagagaagttttcaacaacaaggcgagggccgtggggcccaggcaaaagcttgcatggccctctgtgggggcctccttgtggcaggcgcggtttcccacaggtgggccgggagacccccagggacgctgggtgtgggtgcccaccttgggattcccgtgccacagccccttgggccggggccctcggagagacccccgggggaacgcgaaccggcaataatctccaggggcgctttacacccgaggggccctcggtgggccttcgaatttcggaactctgtggactcttcgtgccccgcggttgtgccctcgttaaggtggtttccccacacagtttccggctcgtgggcccttttttcccaagttatgtgcctgtggttgccccccccggggtccacacagatgtgatcacaggtgtttcagcggctctacattgcgggcccaaacaaagtggtcacgccgaaaagatgttccggggttaaccatgtggcgaatggggaaccgcggtggatctccaacaagatgtaattgggggaagaggtgtttgcccgttaccttctggctattgccccgaagaaaacaa

SEQ ID NO: 705837 - DNA, 130 bp, Homo sapiens
ggctgggtatcgaactcctgagctcgttgatccccccgcctcagcctcccaaactgttgggattacaggtgtgagccactgcgcacagccccccgccctttttttttggagaccacgtggggtaggaggt

SEQ ID NO: 705838 - DNA, 422 bp, Homo sapiens
agcaagccttcaggaaacatattgacggtgcctgaaacaagcaggcacactggagagacacctaacagcactgtccagtgtcgagggatttctaatcatgtccatcagatgacggcagatgctgtttgcagtcctagccatggagattctagtcacaggtttactaggtcagacatctcagctctctgcctgttgatgggaaagccatacatgtggtctggacctgtgacacgtcatacatccaccgctgttcatacaggctgatactctgtgctctcacatctcagcattcacagcacactctcaaatccctagcgcaccacacagtttacagcttacagcctacagtgctcaacattatgggaggtgagattaagccatgaacagtctctttgtaccaacctgccagcatcctattctgt

SEQ ID NO: 705839 - DNA, 459 bp, Homo sapiens
  misc_feature (216)..(216): n is a, c, g, or t
  misc_feature (394)..(394): n is a, c, g, or t
  misc_feature (399)..(399): n is a, c, g, or t
  misc_feature (427)..(427): n is a, c, g, or t
aattcggcatgaggcgtgtggacactgaggcccttcctcgagctctttaaccaaacccaacctccccaattcgccgccttccccgctcccacaaccacacgttcccgtgtgagggcttattgcctccagccagccagcgtccttcgcccccacattcacgaggtttggagccggcctcacccgcggagacggacaccgcccacccgcgcgtgcacntacgcagtcatcctgcgacctccagaatccaccggggtgcagcgaggctgtggaaagtcccacccagaacgtgaggtgaagaaggcttgggctgcgctggttctgctctgtccgggtcggagatgaactgacccgggagagcagcggagggatgtttcttttggccaacagtggggantcacntgcacgttttgcgaagaggcccacagtnctttgcgtggcgctcggactacatttcccaac

SEQ ID NO: 705840 - DNA, 103 bp, Homo sapiens
agtataagtaacctaatgtatgtaatcagaatctatactaggtggccgtcaagcgtaaactgtgtttccctattatatccctcgtggagactgagaatcaaat

SEQ ID NO: 705841 - DNA, 394 bp, Homo sapiens
tattgagacgcggtctcactctgtcaccctggctggagtgcagtgacatgatcacagctcacagcaacctccacctcccaggttcaagcaatcaatcctcccacctcagactctggagtagctgggtacaggcatgtaccaccatgcctggctaattttttaactttttgtagagacaagggtctcactataatgcccaggctggtctcgaggtcctgggctcaagcaatcctgccatgtcagctttggaagttttgggattacaggcgtgaaccactgtgcccggcctagcctgagaattctaaactggaacctggctttccagataccatggtgtattttttaaggtaggagaagagaatgtgtcctctacgcttttttaagtttggtttgc

SEQ ID NO: 705842 - DNA, 122 bp, Homo sapiens
atttcaaattaaataattttaaagttgctggcctaataagcaatgttctcaattttcgttttcattttgctgtcattgagacctataaataaatgtattttttttttgcataaagtaaaaaa

SEQ ID NO: 705843 - DNA, 731 bp, Homo sapiens
  misc_feature (4)..(4): n is a, c, g, or t
  misc_feature (67)..(68): n is a, c, g, or t
  misc_feature (71)..(71): n is a, c, g, or t
  misc_feature (73)..(73): n is a, c, g, or t
  misc_feature (80)..(80): n is a, c, g, or t
  misc_feature (82)..(82): n is a, c, g, or t
  misc_feature (106)..(106): n is a, c, g, or t
  misc_feature (112)..(112): n is a, c, g, or t
  misc_feature (164)..(164): n is a, c, g, or t
  misc_feature (185)..(185): n is a, c, g, or t
  misc_feature (202)..(202): n is a, c, g, or t
  misc_feature (227)..(227): n is a, c, g, or t
  misc_feature (230)..(230): n is a, c, g, or t
  misc_feature (247)..(248): n is a, c, g, or t
  misc_feature (252)..(252): n is a, c, g, or t
  misc_feature (261)..(262): n is a, c, g, or t
  misc_feature (280)..(280): n is a, c, g, or t
  misc_feature (304)..(311): n is a, c, g, or t
  misc_feature (313)..(313): n is a, c, g, or t
  misc_feature (342)..(342): n is a, c, g, or t
  misc_feature (416)..(416): n is a, c, g, or t
  misc_feature (422)..(422): n is a, c, g, or t
  misc_feature (479)..(480): n is a, c, g, or t
  misc_feature (489)..(489): n is a, c, g, or t
  misc_feature (491)..(492): n is a, c, g, or t
  misc_feature (522)..(522): n is a, c, g, or t
  misc_feature (526)..(526): n is a, c, g, or t
  misc_feature (535)..(535): n is a, c, g, or t
  misc_feature (537)..(537): n is a, c, g, or t
  misc_feature (587)..(587): n is a, c, g, or t
  misc_feature (619)..(619): n is a, c, g, or t
  misc_feature (621)..(621): n is a, c, g, or t
  misc_feature (727)..(727): n is a, c, g, or t
tgtnaggtcaaataaaatttaaaggaattcgcccaaaaaaaaggatttgaaattaaatataaaaacnngtngntgaaaananacagcaataccaatcccatcaagnaaaaancgtatctgtatccaaccacagcaaaaccagtcccaaggaacacagggcttgnatggcagaactgccaaaacanaaagcggtgtgcaaganctggggaaatgaacactgttaccanggngaggaaaaaataattcnnagtnttggcaggnntccctgagaaccattttnccatcttaaaagagacaaaaattnnnnnnnngnttgttttttctttttcttggggtctgttnttctcgttcctatccatacctcagcggtttacaaaatagcgctgatctcagggcatagccagggggttcaattntaaaangtcaaactagcagtgggctgggcgcagtggctcacgcctgttatcccagcacttttnngtggccaangnnggttgtctgcttgttccaggagttcgagancaanctggtcaananagggagaccctgtctctacaaaaaataaattagctatgcatggtggtgcncgcctgtggtcccagatacttgggcggctggngnagtgcccacagcgtcaaggcttcagtgaaccttgatcacgacactgcactccagcctgggtgacaaagcaagaccttgtctccagaaaacaagaacaaaaacacanaaaa

SEQ ID NO: 705844 - DNA, 384 bp, Homo sapiens
ctggactggttgctgtcatcattcttcttgccatccctgtctcatgggtgagcacatttcctggactttaacctgtttgggacatcctgttgagaattacagattccagggaaggtgcccttcttggctcggggggtctgatcgtcagagctactcaggtgtggaagaagctgcctggagagggagtccccatctgcatggaatgcccccttcgtggggatggctggcacagctcacacacggaggcactacttcagtcctcccattaccaaactccagggcacacgtgccactgtgtcttgcccacaaacatgcacacagagtatcgatctgtctgatgtttcagggacccagccatgtcatggagggtacatgggcaggtac

SEQ ID NO: 705845 - DNA, 199 bp, Homo sapiens
ataacagatcatcatgctgtacagtgaaaaacaattgtattgtgtgtgaaataactatcacagaaataaaacataataataaaaaaaataactttgaagaataccacacagacacacacacacacattttttctttttagggtggcacctgtggcatatggacgttcccatgctaggggtcaaactgaagctgtaactg

SEQ ID NO: 705846 - DNA, 503 bp, Homo sapiens
gtaggattggagccctaacaggctcctctgtgctggctactcctcatccttgtaggtacaggatctccagaaacctctcttttacctcccttcctcccactgactctcctgcactcccccaggatactgtggggactgctctcacagatactgtgctagaaactcccatactatatttagagtcctctctagcaaggctcacaaagcactgcactggtgtctccattcattttatgtatcccataacacatgcagcaaccatgcatggcagcagaacaacaataaatacttggctaacattctagtcgactccactcattcaagttctgcccacgcatgtcccaaggtattcctgcatcacctagtacttgatgagcgcaactgtatccatcattctgcatgctgcttctccacaatcttttggagcgaatcgtatcgcttctgccaggactccatttccacttctggaccttctccactggtctgctccaaagcctgttagg

SEQ ID NO: 705847 - DNA, 257 bp, Homo sapiens
ctatcgcaaggccaagtccagagcggttagattaccgtagtagattccatggtatgcattcacatgtagtttgtccaggaaagagaagatgccctaaggcttcttcagactgttcaagatagagctacacctggtgcttggtgaacagacatctttggaagaatcatctggcacaagttcaagcagtgggttataccttggcacctaaataaaagatacaataggaaacgattcttggccttgccatatgcaggtac

SEQ ID NO: 705848 - DNA, 1170 bp, Homo sapiens
ggtccgtgcgcatatctcagggaactagtgaggttgtccgcagatcggcgactcctaacataaggctcgaacacaatttgaactgaaataatctctactcgcgttaacctggattgccatgatggaatatgcatccgaatgtagaaggtaggcggaaggttgacacacatccagcgcaacatcaagtccataattctgaccacactccagtagatcaccatcaaattgattcctattagtcgtatcaaatgtgccaggccagggagttcagtttgtaacctggaccgtggcatggttagatccacctaagtagcgttctggactgtccctctgagcagacaagtgctacaagcgtatgatcgctgacagaaggctcgttcaactataggatctgtggtgccatagctcaggcttaactactcattccgctctaaacctttaccgtaagatagcgccttgatgttgggggagagcgccatggctatgggtgttgcatgcagagtgtcagtacacttcaatgagtggagtgtccgaggaagcctagttgaccgatatgttcggtgtggtaccttggagaagacactttccagtagggaagggcgtcgtgtccaatgcttgcgctgtcagaacatcgtcccaatggagtccgggggactagattctcggctgtgtggcttatcccatgtctcgccctaccttggttggcagatgccatggttgggtccgtgatctacgatcgcacaagcgattgaagtgtaggcaacgtctgccgtgggagatccatcctgtgttggcatgggtacccccacatggtgcgtagtttggcccttgggagaggcccttgcgtggaacgcttcagcatttgttgcctcctcttgatggatatttgaccagccgtacctatataagaagcggatcgtggaattacctgaaacagcttgcatggcaatagggtaccccataacgtcatatgttcgcccatggacgcgggaacgggagtctggggggtgggcgccaagaacccttagtgaagagtttgggacgcgaaaagaaaaaaaggaaaccaacaagacaccggattagaaaggggtcagcgtgacaagaaaataaccatcttgtgctaaccgagtacgatcagacaaactatttcaacaaggagtatcgttccga

SEQ ID NO: 705849 - DNA, 214 bp, Homo sapiens
catgacttcccaggtccgctgtgctcacaagccctgctcctgtcctgtcgccctctacacctgtctctgctttatctttcctcaggactcttaccacatatatggcgtgcttgtgtgtgtgtataattcttttttttttttttttttaaaaaaaaatttccattctggtggcccaggtggaattgcaatggcttgatttgggcctcactgcacc

SEQ ID NO: 705850 - DNA, 664 bp, Homo sapiens
gggatgcccggccggagctgggtctggagacgccgtggcagcctgaacggacgtgtgcgacgtgattgggaggtttgtctacagattttgagcgttcgaagattgacccctgactaagtatagctttgcttgctccctcagcctttgaaaaaatgtctgtcacatatgatgattccgttggagtagaagtgtccagctgacatgctatctgggaggtcgggtgaactaacgaagctgtgacgtgtagacagctgtgatctgatcgatgggcacagccgccatggtgtcagccgacgctccagtgaacgtgcctgtcatgacgcgtggctgcgcatcgagaaggctgtatgcagcagcatgctcactgagtgggcccggctgctggaggcagcttgtgtgagaaatgggccccagtactgggaccgtggagaaggcctggatgggcttcatgtccgaggcagagagggtgagcgagctgcacctcgaggtgaaggcctcactgatgaacgatgacttcgaggaagatcaagacacgtggcagaacggaagcctttcacaagcaagatgatgggcgggcttcaaggagaccaaggaagcctgaggacggctccggaacggcacagaaagacctggggcaagaagcgtgacagaggtagaagcagca

SEQ ID NO: 705851 - DNA, 674 bp, Homo sapiens
aattcgaatgcgaggggcggggttttagattgataattactggccggtcgtccgtacaattgaacactctcagccctcctaatgacctccggcctagccatgtgattacacttccactccataacgctcctcatactaggcctactaaccaacacactaaccatataccaatgatggcgcgatgtaacacgagaaagcacataccaaggccaccacacaccacctgtccaaaaaggccttcgatacgggataatccatattatattacctcagaagtttattatacattcgcaggatttattctgagccttattaccaactccagcctagcaccctacccccacaataaaggagggcacatggaaccacacaaaagagcatcagcccgataaaatccccatagaagtccacactccataaacacatccgtattactcgcatcaggagatatcaatcacctgagctcaccatagtctaatagaaaagcaacacgaaaacacaaaaataatacaagcaaagcgacattaacaataattaactgggccctctaatataaaacctacacatacaagaactcagagtacattcgagtgtcccatacagcatattcgcgaagagattaagagatcaaaatataaaagtaggcagaggctacacggaatcaggtataatag

SEQ ID NO: 705852 - DNA, 321 bp, Homo sapiens
tacaggatcggattttatccccttcgtgtgtgtgtagtatggaacgtgtgtgtagtcaatggaatgtgtactgtgtgtactggaatgtgtgtgtgtatggaatgtgtttctgtatgtgtatggaatgtgtctgtgtgtagcgtaagcaatgtgtgtgcatacggaatatgtgtgtgtacggaatgtgtgtgtatggactgtgtgtgtgtatatggacatgtgtctctgtgtgtgtcatggcacatgtgtatatgggatgtgtgtgtgtgtatgtatggcatatgcctctgtgtgtttctcgaatgtgtgtgtgagtggaat

SEQ ID NO: 705853 - DNA, 631 bp, Homo sapiens
ttgagatcagcctggacaacatggtcaaggaagcttttcctgatccactaactaaggacaatcaaacccttcatgatctagaatctggagactgtgtcttctgggaatagtatcagagaaagactgcccttactgcccacatgtagcaaaactttgagacgttgaattatgggtccataatctcacaactcagaggggcacctctagactcttggaactgtatatctattggagactttaaggtaaagctgaacagagagacgtttttctccagaagcagacagcaccatagtcatggacagctttcccaagatcacagatcaagacttctctgccgtcatgagactcataacctcttaattttttcttgcttatgcttctgtgaacaatagaattggaacaaggggtggtcccgcgtgcacccatagggtatacttttatttgtggcaggattttgctgccaaccttatacatgggcaaacttatgccttcatggatggaagataaagggctaatatgggttagaaattttaatggtacctttgtttctccataatcattcagaaacagaacactggtccctcttggttaccctacatcatagttgaagagaacattgccggaggcctca

SEQ ID NO: 705854 - DNA, 427 bp, Homo sapiens
caccggcaggttgtactcaaagagattgccgttttcttctaaaagttctatagtttgagctctgaagtttcgctctttgatccagtttgaggtaaattttggcagatggtatgaggcaggagttgcgtttcactctcctgcctggggcggtgcctgcacggtgtggaaaaaggttgtccgtatcccagtgaacggtcacagctcccttgtctaagatcaacgagcgctgaacatgagggttccaactggactcttagttctacgtccacgtggcctgtgtctgcccaccattactaccgccgtgcgatactgaggtcaggctggggctttactgggctgctgggtgatctggagaatgcggttgtgtgagccgcaggaagggcagagctgagcgtatgaccgtgtgtcgtacccctccagaaatacc

SEQ ID NO: 705855 - DNA, 117 bp, Homo sapiens
gggtaggggggccccctcctgggtttgaaggggttaacttaaaccaaaactggggtttagaattagatgggggggttttattccggggcccaaattaggggagttttaaaaccttga

SEQ ID NO: 705856 - DNA, 246 bp, Homo sapiens
cgcagatggtatctgctgcagagcaaccacagaagaatgtggcaactgcacaacccgctccaaccgctcgaagccgatcaacaaatccagccgatccgttggcaagagcatctaacgccttagaaagcttagatgttgctccaggtctagaagaactagaaatgggtgcgcaacgtgtacaagttgacgacaaagcgatgattaactgtcgtgcggacttaaaccaacttgtaccgttcaaatacg

SEQ ID NO: 705857 - DNA, 195 bp, Homo sapiens
atttatcgaaatctttaaaataaaaatccattcgacagttgatgaacggcttcagcgaaggaaaacaaagacgaactcgagcttctctaatctgtccatttcgaaacaccaaacacagtgtatctataagtacagacatatgaatgaaaatatctgaactaaccatttggactttaaacaatatttacagaaact

SEQ ID NO: 705858 - DNA, 161 bp, Homo sapiens
tgtggtggttgaactgggagaagcctgggtggattgtgagcacttctgggacaaggggaaacgctgtgaatactccctagtgaggttggatggtcgaagttgcaactctggtatgggcagtacttgcactacttgaaatcctgttggcgctctcttgagag

SEQ ID NO: 705859 - DNA, 113 bp, Homo sapiens
atcccctctgagcagctggcagcgagggtatgtataaaatgcttggcctgcaccacggctagggacgaggaccgacaccaaggaggtcactgcgtcgtaggagagggccagcg

SEQ ID NO: 705860 - DNA, 424 bp, Homo sapiens
gtaggtggagccacatgctttgacagtatcgagactgtatttgaaggtgggtctcatctgtctactccgggatctgatcaatgctttgctggagtgatctcataaagaaggctggagatggtcaaagaagatcaaggctgctgggattccatccacgtggtagaagtgcaggagaaatccagcggtcgcaccggccattacaagttgagctccacggtgatgctgtggctgcagaccaacaaatctggctctggcaccatgaacctcggaggcaggcttaccagacagatggagaaggatgaaactgtgagtgactgctccccacacataggcaacatcgggcggctggtagaggacatggaaaataaaatcagaagtacgctgaacgagatctactttgggaaaacccaggatatcgtccatg

SEQ ID NO: 705861 - DNA, 383 bp, Homo sapiens
cagatatcaagacagtaggacattacaagaccaccactggaggaatttgccagcaaacacaagcaggaggtccggaagaatcctgagttccgtgtgcagtataccagagacatgtagtgcaaacatatagacgtgaatccgctgagacctactgagaacaggattatggtactgaaatgctagggcgtggggaacttctattacgaactaggtatccaaattatcgaagtgtgcctagcagctgaagcatcggaatggaggtctgatacctttggaggaactacatcaacaggtgttgaagggcaagggcaagttcgcccaggatgtcagtcaagataacctgatcagagccatcaagaaactacaggcacttggcactggct

SEQ ID NO: 705862 - DNA, 273 bp, Homo sapiens
  misc_feature (138)..(138): n is a, c, g, or t
  misc_feature (162)..(162): n is a, c, g, or t
  misc_feature (195)..(195): n is a, c, g, or t
  misc_feature (218)..(218): n is a, c, g, or t
  misc_feature (246)..(246): n is a, c, g, or t
  misc_feature (256)..(256): n is a, c, g, or t
tggtagaaacgggggtcactatgttgcccaggctgggagaagctttcccattgatggattgattcagggtctcgcttgtctgtcgcccagggtggagtgcagcagcgtgatctcgcctcactgcctcaacctctcaanctcaagtgatctccagcctcagcntcccaagtagctgggactacagatgcacaccancatgcctggcttaatttttgtantttttgtagagatggggtctcccctgtnttgtccaggntggtctgtaactcctgg

SEQ ID NO: 705863 - DNA, 118 bp, Homo sapiens
tgatctagacgatccttatgggtgcatgcatgtgtggctgggtggagtagctgaagccggtgcctgtggcgcaagagaacagtgcgtcttcttctcggggaactcgaaaccagtgtga

SEQ ID NO: 705864 - DNA, 109 bp, Homo sapiens
  misc_feature (99)..(99): n is a, c, g, or t
ctctagaggatccttatcagagcataccctccctctaattcctcacaagtgtgggcgcctcttcatcgaaaagtactgtgtattttactataccagggnatttttgaag

SEQ ID NO: 705865 - DNA, 138 bp, Homo sapiens
gtagatagtcaatcgtggatggaactgacttatttatcgcgaagactataatactgcatgtggccgtaatgaatccaaacttgtgtcatgcctgtatcatgcccatgtaaacactggaaataaaaagtgctctggtga

SEQ ID NO: 705866 - DNA, 461 bp, Homo sapiens
  misc_feature (413)..(413): n is a, c, g, or t
taaagcattcatctgcatgttatattacagttaatacaaggaggtacttaccattttatctttactttaaaaacaatgccttttccaaaatataaaaaaaagacctatttttaaagaactatttaaagatggctttgaaaacaacacttttatttacaacaaatagatggtagtgcaacagcactcgtggcttgtttcgataaataaaaatactattgttctggcattctttgggtacaggcccctttatatttatagatggctaccaagacttcttgaaataaaatcccttaagggcctttaatttggtattttaaacccgaatttggggaaacccaaggaagaattaatcttttttttttggggacctagaagcgctttttttttgaaaaactggaaggtttaaaaggttnttcaatttcccatttacccctggggcaaccaaaaatattttcccaaac

SEQ ID NO: 705867 - DNA, 984 bp, Homo sapiens
ggtgggacctcaacttcctgctggtgtcctccctcctggcttccctggcctggctcctggtcttcgtctacaagctgccgcagacggtactgacgagtctacatgcacttgggccgcggagtcttgctttcattgctgggcattgatcgaagccgtggtccggttctagatgtgggggcttgcaggccttgtgtactctgctagtatagcatgctgcatctggtctagagagcctaaagctcctggggcacctggacctcatcagtggggcacatgacggagcaggggagatacatggaccggggcgtcctcaatgtggtcatccagatgagcgcatgactttgctagcgcctaggcctgtcgacatctgtgccattgccattgagcctgggtaggcgtatatgtgatcaactagccttggtcaacatctgcctcatcggcactcagaagctctttgccctggttgctggccctgttgggatgcagatgaccggggcctctgtggaggatgacagacgtagctggctgccttcctagcccacgatatccagcagtggctgttggccatggaccatccttccttgggacaccctgccaactaggcctggagctgctggctcagatggccggctccatggccagcttttgagactggtcaatctcactgggattgggtgtagctaagctttgtgtgctggcagtgacggtggattgtgtgggcatccggaagttcaccctgatggttggctaaccaaggcactccagccagctccatgcccggcaatcctaccaccgttttcgagaaggatgtccatgcgggctcatctccgacatagacattgggcctccagacggactggagccgagactggaagcgcagtctgcaggctggcgagctgggcaaaacggaggaggggcacgctggaagctccacaagggtggacctaccagggcaccccaaataggaaccggagacaggaacca

SEQ ID NO: 705868 - DNA, 556 bp, Homo sapiens
ggccgagtatctgtgtatccccttatccagtaactctacgtgcgccgttgtcatagttgacttgtacgtgagtcagtgcctgagcaggttctagtaagacgtggtagctgcctaatcaccaagctaatgtggaaagtgagccaagaaaccttatcagaagaggcctcttctcaggcaaccctaccaaatcagcctgttgagaaagctatcatcatgcaactgggaactctgcttacatttttccacgagctggtgcagacagctctgccaatcaggcagctgtgtggacacctttgttaaagtgacttgtgcaaaatgtacaccatacttacagccctcgtcagatataatctccaggtgtgtcagagctcccggagaacttccaaaaaatatgggaaaagctggtgacgctagtctggtactcatctgacccccctgtgtaatgcttacatttcttacgtacagaataagagtaagagcctgaactatacgggagagaaaagggagaaacctgttgccgttgccaagccatggcccagagtcttcggggaaacca

SEQ ID NO: 705869 - DNA, 153 bp, Homo sapiens
cgtcggagttcccatatggcttcgctgctgtggtttcctgcaggagacgtagcagttgaggaacctcctgcgcatagcattagatgtctcgtggtggagcgtgccgatcatgaatacagtcttgaattttctgttgctggacaacactgggac

SEQ ID NO: 705870 - DNA, 543 bp, Homo sapiens
  misc_feature (39)..(39): n is a, c, g, or t
agcctccttccctctcaacaaagaattatccaggcccanaatgtcaagagtggaggttgagaaaccctgccatacagcagtggttctcaagccctagtttgtaccacaattaccttcagggttggtaaggccgattattgggcacaccctcagagtttcttactcagaaggcctgtagtggggtcccaagatttgcatttccatcgatttcccaggtgaagctgctgttagattgggggcacatttgagaaccactaccctagaaagtccccatgctctcctgattaggaaggagcgaggaaggtttccaaagtaggacaggggtgggagggtaagggagagtggcgggaagagctggcccgctggggtgggttatttcggccgttctggcctcgcaggcgttttcgggatccctctaggcgccgcggaggtcctggagtctcgatggtcgctcgggccggggcgtggcctggcccgggggcgtggcatggaaggccggccgaggtgcagcgagccctctggtgccggacgttgcgcggccgc

SEQ ID NO: 705871 - DNA, 596 bp, Homo sapiens
  misc_feature (565)..(565): n is a, c, g, or t
  misc_feature (585)..(585): n is a, c, g, or t
tgggtagtcttgctggactgtattgtgtcttgccacatgatagacatcaggaatttataaaactgtactgatgacctcgtttagaaatcgtagaagtcgataatcaagtcggtccgtagtgccattccaaactaagtgtgactcgtgggcctgatcacgagaggcaaccgtagtcgataacctagcaacaatccctaaacgtaaagtaacgctggctcgccgcagaaaaagctcattcgttcgatgacagaacttactttactgccttcctagaaattctagaacgagagctctatgaattgtgtactagagtctcttgaggacgacatgtagcagtacctggcacgcgttgcgtatttgcgcaatcaacatgcaagtatgtgcgaatccactttgccagcagtaggtagctggaaaaagatacagtttgattttctcacaactttggaacagagaagtgaaggtatggtaaaccatcgtcattgaagttctggcttgtatcatgcttatgttgacgtatatagtgacgtgttcctggtactaagcttatttacacgctgttcantacttcagaggcgggggctngtagacataaa

SEQ ID NO: 705872 - DNA, 239 bp, Homo sapiens
gagggcgagaagatccgaaagaaatacccggacccgtgtccgtgtatagttagaaaaggcctcccaaagcctcggataggagacctggacaaaaagaaataccctgttgtccttctgattctcacagtttggttcagtttctaccttcttgattccggaagcgaattcatctccgagctgaggatgccttgtttttctttgtcaacaatgtcattccacccaccattgccacattggta

SEQ ID NO: 705873 - DNA, 774 bp, Homo sapiens
tgcgcccctagtgtggtcagttaggtgcgcagctggcgaccaagctgagcatgtggttcactgaagcgtgttgttaaaagtacccaatagtcactcttgcctggggagaagcagcattttaaggagcatcgcattgaagactgtgggacgcagctcttccacttggcccgggcacacgctttcatgtgaaaccttcaaagtgtgcttttccgtggcctgttttgtagcctggcttcttaaatacgtctggattttgttgcagaatctagatgtctagccgcatgggtgctgtgtgtgtgacggtgggggccttaggcccggcccctctgagaccggcgtttctgtggttctctttgagcctgcggatcagccagcttttcctgggatggacagctgtggcccactggggcttcagcgcgtgggcaagatccactgcagaaccctaaggagacgtccgctcagcagccatagtgccttgggacacacggcccgacgctgcatcctgcgggccgtgatactctgctgcggtacgctcgttcctcgatctgcctccccacggagcctccgcgcatgcgctcacgctgtgagctgccgagggcgcccagcctccgtgttggattcgtcgtgcgccatggggggtcttcgcgtcgtgcatcttgggatgctattgatggtccttccctgatcgctgggctgcgagggtctgccttttttgcctcgacttggggatgcccctgtgtttctgccgtgttcagtccgtgcattctagggtcg

SEQ ID NO: 705874 - DNA, 121 bp, Homo sapiens
gttcatgttggcgagccccgagggttgggctgtttgcacaggcgagggatatcccatcggccccgtgcatgtcggaaagtgatggggagctggctccaaagcaagcgcgagggaatctccg

SEQ ID NO: 705875 - DNA, 202 bp, Homo sapiens
ataattgagtcagtaagtgatcccagggacattgaaaatccaaaaacagggctgagtgtggcatggtgcacatgcctataattccagcgctatgggagatcaaggtaggaagaccgcttgaacagaggaagtttaaggatgtagacagatatagattgcacacactgaaaacgagacactgggtgacagggaaacatacaag

SEQ ID NO: 705876 - DNA, 1055 bp, Homo sapiens
gaaccgtgtagcttggccaggattgtgaggaaccgcagcgcgccgcaggaccgggccgctgagcctgcagccgccccgcgccgtgacctgctgaccctagaccccgacatccctttggactcagcgccgctgcgccccagagcctcggcccgggcggcagcagactgggaggatgagcggcgggcggcggaaggaggagcctggctcagccgcagctggcctaacggtgtccctcaaatgtctccgtctggcatgtaaggtgctgcggacgcgaccgcggccctgggacggactaaggatgaacttctttagattgtgatctactggttccgacagatcattgcatgtggtcctgggatgtcatttgagggagttgtggccattacgagggtacttgtgaagtagcaggattctgtcctgaatcaatgacaggagtcctgtacctctacttcatcaattacctacacgattgagtgagggaaagcatcttggtgtcacgtgggaagcgatcacggacacgaacggggtaatcgcaactctcttctgcctgtgcttccatggtctgtcccggatctactctttatatcggctggtcatccaattagtgatttgatggtgtacaggctccacatgtgactcccttattccagtaccgaaagggactcctctttgatttcagcttcaggacacttgatcgctgggggaaacaccaggccccctggcgtaacttgggatgaacccgtgttaccctcggatctggaagtcagtagtcgagggcaatagtggtttactgcaggggttgtgacctgaatctttgaaaaggcatccgacttgggggaacgcattggtgatgttccgtttactgacccattatcgtgggaatacccacccagttgacgtattgtttccacgattggctgacattacagtattctcccttgaggcaaattagaccagaaaggtttcccgagccacacgcgtcgtaaagcaaggatcagggctaagccttttacacaggtgatccggccaaacggagactcaaagactggccagtg

SEQ ID NO: 705877 - DNA, 298 bp, Homo sapiens
  misc_feature (60)..(60): n is a, c, g, or t
cctaggggttgttgataattaggaaggtgagggtgcacacagccttgcttacagtgtggnccctctgggcatgtttttcttaaaataacagaacagagagaagtctttctggttttcagtctcctttgtggctcacaggccctgccactccggtgttctgaccttgggtgggttactgagccttggagtcggtttccttgtttctgttacaagcagtctcacgagggtggatggaaaggcttcctgcctggccagggaatggagaatcatagcttggtcattgcaacacggtctctca

SEQ ID NO: 705878 - DNA, 493 bp, Homo sapiens
  misc_feature (381)..(381): n is a, c, g, or t
cagataatgatagggtggggcgtgtgtcctcaccgaaaccaaatggactggtgtctcacagaatccccacgtgtggggggagggactcaggggaaggtaattgaatcaggggggccagtatttccggtgctattctcatgatagtgaataagtctcgcaagatcggatgggttcaccagaggtttccacttttcttcttcctcatttttctctggccacgggcatgtaagaggggcctttcacctcctgccatgattctgaggcctccctagccaggtggaacggtaaatccaattaaacctcttttccttcccagtcttctgtatgttttggtcagcagtctgaaaacagactaatacagatcaggcttatagggtcggntaaactaagtttgagtggtagattcagatgtggggataaggggactacttggtcagtgaccttgaccaggggagggagatactgaactatgtctccctgaaggggagccaaa

SEQ ID NO: 705879 - DNA, 358 bp, Homo sapiens
gcagcttatggcttaaaatgtactctccttttatgtggtctcttggggccgatggagaaagagaaatcaatagtgcaactgtttgatactgaatatgacaagtgtcttttcgaaataaaagaacagtccccaaaaaaaaaaacaacaaaacaaaaaaaaaaaacaatttgtggcgggccggcttcggcgcctgggaaaaggtttttataacaccaatcggtgggcgcggcgcgggccccaagaggggtaaggcgaactgcgggcaaaacggcgggtcccaaaggaaccccctgggcagcggaaagggggctgggttctcccccaattaaaaaaagcgcccggggggcacacccgggcg

SEQ ID NO: 705880 - DNA, 243 bp, Homo sapiens
atacatcacatatcgaagaaaagagtattacagcaaagcttagatagtttaacataatgatttgtacattgattcttagaaaagtcttggtcttagtgggcttttttcttcagcttacacattaaagatgctgctgcagtaaccagtgtgagggaagggacatcagtcttcatgaaccataaactgacagaagtttcaatacagtaggtttccatatggcaatttgtagtgcacatgacagta

SEQ ID NO: 705881 - DNA, 703 bp, Homo sapiens
ctcgaggagctgcatctgcggcaactgtgtgctgacgctacgtgcctcctggctccgacgtactcgcagctccccagtctcactccattccttccccacctggcgcgcacctgctcaagaccaggtcctgccaagcgctaggagggcgcgtgccagggctgctaggtgaactgcggagcgcgcgcgccatggggcctgccgcctggggccggggtctcctgccgggtggtgcggcttttccagatttgctggcatggtgcttcctgctggccctgagtccgcaggcacccgggttcccggggggctgaagcagtgtggaccgcgtacctcaacgtgtcctggcgggttccgcacacggggagtgaaccgtacggtgtggggaggctgagcgaggagggcgtgtacggccaggacttcgcccgctgggagccctgtgggctgggggtcctggtacctgccctgacggggccccggtggccgcttaaagcgcccttgtaaacccgcacacgaaatttcacggggtgcccacgggtttgggtgaaagcaccgtgcaaagtcttctttgggttagcgggcctcatccaaaccggcggccggtgggccttgacaccctttcggccatgcaccgaaggattccattctgggcgcttattgcacgaccacggggggccgtaccttgggagacccgctccactcttttcac

SEQ ID NO: 705882 - DNA, 444 bp, Homo sapiens
  misc_feature (6)..(6): n is a, c, g, or t
  misc_feature (88)..(88): n is a, c, g, or t
  misc_feature (95)..(95): n is a, c, g, or t
  misc_feature (132)..(132): n is a, c, g, or t
  misc_feature (173)..(173): n is a, c, g, or t
  misc_feature (178)..(179): n is a, c, g, or t
  misc_feature (184)..(185): n is a, c, g, or t
  misc_feature (194)..(194): n is a, c, g, or t
  misc_feature (209)..(210): n is a, c, g, or t
  misc_feature (216)..(216): n is a, c, g, or t
  misc_feature (226)..(226): n is a, c, g, or t
  misc_feature (266)..(268): n is a, c, g, or t
  misc_feature (277)..(277): n is a, c, g, or t
  misc_feature (302)..(302): n is a, c, g, or t
  misc_feature (310)..(310): n is a, c, g, or t
  misc_feature (315)..(315): n is a, c, g, or t
  misc_feature (317)..(317): n is a, c, g, or t
  misc_feature (327)..(327): n is a, c, g, or t
  misc_feature (345)..(350): n is a, c, g, or t
  misc_feature (361)..(361): n is a, c, g, or t
  misc_feature (367)..(367): n is a, c, g, or t
  misc_feature (379)..(379): n is a, c, g, or t
  misc_feature (383)..(383): n is a, c, g, or t
  misc_feature (394)..(395): n is a, c, g, or t
  misc_feature (398)..(398): n is a, c, g, or t
  misc_feature (412)..(412): n is a, c, g, or t
  misc_feature (442)..(442): n is a, c, g, or t
aaaaangcccatacctctgtagccaacaatgaaatacaggagaggacaaacaaacgcacaaattggaaagtagctacagatgaaaggnctgctgngagctcaaaggatgactaaatgggaaacacttttgtnttccacatgactgtggatatttacagttcttactccttgtngtttnnccagnncctcttgtncagcacggggcctgnngtcagncctgtcttgngccatctgtatgtcctgacagacgtcttgtcttctatttnnncgttaagcntgatccccttttcttgttaaaaggnaatctggnatttngncatgaaggcntcttgaagagattttttnnnnnngggatttattncgtttngtgtagagtgcntttntagcaaatttnnggncccagaaagctggntccaatagtgacctgggtacaccaatcggnat

SEQ ID NO: 705883 - DNA, 116 bp, Homo sapiens
gatcaggagtaggagccagagttactgtgccaagagacccgtccccaaagcatgcaagcaccttctcacagggcaaggccttggagcaggttcccaaggagcccctcctcatcctg

SEQ ID NO: 705884 - DNA, 157 bp, Homo sapiens
  misc_feature (144)..(144): n is a, c, g, or t
aaaaacggggggggtttttccacgcggttaatttatgcttaacttaggaaaagataaggttccttgagcaccaaagatgattcataactctgtataggtgccagcgtgcttataaaagcatcttagcagataagcctctccaanttgtgcttttgta

SEQ ID NO: 705885 - DNA, 542 bp, Homo sapiens
  misc_feature (52)..(52): n is a, c, g, or t
  misc_feature (90)..(90): n is a, c, g, or t
atctccacgcaggcatcgctgattaggagccagtcccacggctgggcctgcnttggctctgaccgctgggtgtcttagtagcctcaaatnttaaaaggaaaaggaaaaaagtgggggagctaaagaggagtttaaatcctttaggattttaaaaacatcctcacattgttatgacttaagaaatataattttctctttcacaaatctttcttagtcaaataaagacatgccccttctctgcagaaccaaacggtcctttgttcacgactcagaaatgcttcacctcccttggggacgctcccgaggctgcccgggaagtcgtgttggccccaccgcttctgcaaggatgagagcacacgtggtcagcagcacaattccagcaggaagatgtcaaagcattcaacaaaatctcagatgtgagcaccggggattaccaggactttcagattcacattcgttttcataatgtgcttcattttctgagaattctgtggcattttggcctctgccatgaggaatacattcccgttctgacaattcaa

SEQ ID NO: 705886 - DNA, 194 bp, Homo sapiens
tattagaggattcgtggtactctggagacagcgaggagcggtgacctggcggagctggataaactgtcaggaggtgctgaaatttgcaccctggagatgcttcctgcgtgcagtaccttggtggccatccccatgagaaaggcttgactcccaaggctgctttctgcgcgggtgccgacttgctctgctgccac

SEQ ID NO: 705887 - DNA, 182 bp, Homo sapiens
gtcagatagcaataagggtgctttgtgccaagccttagtacatcttctatgcccagaattcgcatgctagactatcaggtcaccatcttagcttagttctccagacatctgactcacggttcctttatgcagatcctgggaactgctcttcttgtagacagcatccataaacttctgaacat

SEQ ID NO: 705888 - DNA, 98 bp, Homo sapiens
gtccgtctccacttttttggagggcaagaaccccccaatgccaactcttaagtcttttgtaattctggctttctctaataaaaaagccccttagttca

SEQ ID NO: 705889 - DNA, 239 bp, Homo sapiens
ctcaattagcgtgagccatcatggctacagagccatacctgtctccaaaaagaaataaacaacagctacagatcggtaaaaatatttgcagaccatatttttaacaaaggactatcatatagaatatatacagaactctcaaaattcaacagtaaaaagccaaaatggcgcccgggcacggtggttcatgcctgtaatcctagcactttgggaggccaaggtggattgctcaccggggc

SEQ ID NO: 705890 - DNA, 1163 bp, Homo sapiens
  misc_feature (366)..(366): n is a, c, g, or t
  misc_feature (501)..(501): n is a, c, g, or t
gaattcagagttggactcctcgaaccagcagtacactgccatcatagttgatatccttcaatcctgctcaatactagtacatcaatcagctcttcctagcaggtagaatgatgattcatccaccagtcatccaaatgtcattgcacgaatattcaactggacctatctactatgttcagaatgaagttagtcagcgggatatctatcagaataaacacgtgagagcataggccaaatttctctacaatccatcgtagtgttccattgtcaactctcttaggcatagcatacctcgtgtaatatccatatgataatcctatacatatataaatcttctacattacgaagtaagactcatatcttagncctattccttcgggacaggacggcgtattgaatccccaaggcctaaattttattgtatacatattccccattctcctacgtaaataggatacacatggcaccgaccccccattctcgttcttaactcacggtatncgaccagaagagcccgtagacactgctctgctcctaatatatcactgtgggtcaatttaactgagactcctgggttgatcggagaacccaaattatacattcaggcattcgacacatttacttacacaacacgtaattcacacgacatagagacccatccgctattcataggctctcttaccctggtcgtatccaggcacaaaggcgggttaacaacagctcaatcccatttgaaaaccttacttggcctttgttcatggagccatggaaccgactcgtgaaaagttcttcttggcgcgaggctcattctatattcggacaaacctttattggtacttcctcccaattgatttcttacattctaaattcgggttaggacccactgtctcaaccttgagaacgcagcattgcaacggataagcgactcaatcttacactatgaggcccaagtgctccccatattggttccataacggaccattactaaggttggcagtagaacttggaagtcctttggtgaacgcggaacaatttctttatctttcccaataaccactatcaatagcggccacttccggtttcatccacatttcgagcgacaatttttggcgagataccacagatactctaacattcacatcttctacacacacacacttcaa

SEQ ID NO: 705891 - DNA, 124 bp, Homo sapiens
tagtgttataccttacccaatgaaagcaaagtttttatgtgctgtgcaaatggtcttcatgtggtctgacaatttatttttgccatcatttttttaattaaagaaaaaatttccagaagaggaa

SEQ ID NO: 705892 - DNA, 123 bp, Homo sapiens
tcagcattaatatgcttgtatattacgctgttactgatgatagcagtgatgatgcgggtgaaaaagcctgtctttaggctcaagaaaaggttaggggagaccaaatgttagcaagcagaaaag

SEQ ID NO: 705893 - DNA, 615 bp, Homo sapiens
  misc_feature (395)..(395): n is a, c, g, or t
  misc_feature (613)..(613): n is a, c, g, or t
gattcggcggcgctgcgattgcttggtgctgatgagctggcgaggaccacgtgctgcagcgtcgcagctgagtcgaggatgaaaggcggtctcgagtctgccgggctgcacgcgccggctgcttgcagaacccgcggctgatggcactcagctctacatgggtgcattcatgctgtcagagctgttcgtcctcatcctgtgtgcaactgatcgagctggaccgagacgtccaccttcgcatattgtcctcagaggcgtccctgggtcgaatgctgctaagacgtggaatctgcgttgtgatgagcgggcactaggaccgtcatttctcgcgattgcgtgcctgtgaacgactagaaagctggaacctttcgtaagggccacgggtgactagcaanaccaggcaaggcgtccgcatgtcagcctgatgcgtggactctgtcccttcccacgtagctgtggcggctcatcgaacgcttgacttgacgagacggcgatccgaacgtacgtttccgacgagcagagagaggctgggacgagccctggtggggcccagactaggccattgagcgtgacaacgaaagaggagcccttggttgattgccagggacaattntg

SEQ ID NO: 705894 - DNA, 410 bp, Homo sapiens
  misc_feature (52)..(52): n is a, c, g, or t
aagagaggagccaagaatgactcagaccggcatggtggttcacacagtaatncccagcactttgggaggccaagacaggaggattgcttgaggccaagaatttgagaccggcctgggcaatatagcaagaccctgtctctacaaaatagttttaaaattagccaggcaccggctgcccagtctggaaagtgaggagcgcctcttcccggcagccatcccatctgggaagtgaggagcgtctctgcccggccgcccatcgtctgagatgtggggagcgcctctgccccgccgccccgtctgggatgtgaggagcgcctctgccaggccgcgaccccgtctgggaggtgaggagcgtctctgcccagccgccccgtctgagaagtgaggagcccctccgcccggcggccgct

SEQ ID NO: 705895 - DNA, 144 bp, Homo sapiens
gaggcaaaaaacgggcgatgtcgcccgtcaattcccttcagcaggcggcttggccgccgatcgcgtgcccgacgttccgtgcgcttcagcgtgcgattaggttcacacgtataggcgcaccacgcagcgccagccaatgaaaat

SEQ ID NO: 705896 - DNA, 257 bp, Homo sapiens
ggccccctggggatatgcattgcctatctacgcgttgagtatttcatcagagatttgtaaatccttaccctgtaggtctccattattcgcaggtcgtgatctacaaaagtcttgattgcaacaagtgtggagttaccacatgggattcttggtcagtgaggatgaaagcaaactggatccaggcacagcagaacaagtccctgattttgtcaccttcctttaccaaataactagaggaattgcagcaaggagttatg

SEQ ID NO: 705897 - DNA, 189 bp, Homo sapiens
  misc_feature (95)..(95): n is a, c, g, or t
agttttgagctgccagtggaccgccccttttcccctaccaaaattaggtgatcccgttttccccatgacaatgttgtagggtccccccacccccncccccccaggccttggtgccttttgtatccctagtgctccatagtttggcatttgcccggtttcgaagtcattaaactggttaaacgtgtctca

SEQ ID NO: 705898 - DNA, 455 bp, Homo sapiens
tctcatggagctgtgagcacattaggccttcattcaagcaaatcacaacaaatgattaatttttggcccctccaaagtccctgttgtgtaacttgtgcatacctgacactcaacagtttattttcatggaaacacctggcacacaatggaaccccccagcctgcctccgttcgtaccacaggacacttctgtactagtgtggctgggaaatgccagtcactgtctaacttaactcctcaccctacttcctcagtggcgccaggcattttacatttattttccttgcttcttacgcatccagtaagcagcaactctggcggcagaagtgcatatgacatcagaattctcagagctaagggaacttgcagagatcattggactcatcactgacctgaaaccatgctaaacctcttctttcccaagcacacaagcaagctgtgtccctcaaatgacaa

SEQ ID NO: 705899 - DNA, 235 bp, Homo sapiens
  misc_feature (89)..(89): n is a, c, g, or t
  misc_feature (217)..(217): n is a, c, g, or t
agcggggaacaatcacttgatgcccatggattgagaccagcctgggcaacacagtgagaccctgtctctccagcaaaaattagccaggncatggtggcatgcacctgtcgttttaattacttgtggaggctgagacaagaggattgcttgagcccagtgactttgagtgctgtagtgagctatgatactgctactgcactctatgccttgtgtgacngaaatgtacgtctgagtc

SEQ ID NO: 705900 - DNA, 394 bp, Homo sapiens
agaagaaagagggtctgacacatcgagaggagttcgtctggggactgtcagagagatcagccatggaatggccaaaccacaggggaagattatcttctcactccatccgctttccagctccccatccatcctgctgaaagcctcctccatcattcaataaaatctctgtattcaccatccttcaagtctgtaggacctgattcttcgtgaatgctagacaaagacccgggtaccaagagcacagggcgtaaaaggctgccaccttgactctcctctgagctggtttaacacttagccatccgcgacacagcaactgctaaaagagcattaattgtaacacacccatagatgctgccatggggctagagcccaagagcgctcaccgcgtctcgtg

SEQ ID NO: 705901 - DNA, 419 bp, Homo sapiens
  misc_feature (1)..(1): n is a, c, g, or t
ntgggttgtcatctctgtgatgcaagaagcgttcgtttctagcagggtcctgttaagcacagcagtcagccgtttccccataggtttcgcgaatagcgtgcatatgtgcatgatctgtctccaaacagggtatgaagtgatctgtcccagtttacagatctctcttcggcatcgcatggttcagcaaatgcagttaccacagccgcgaaggttacatggtctccaaatgtaccctgatagagatagtgagcacagacaatctaccgcaagccagtgagatttgcgtctcccaaatctttactgccatgagcaaccggactctggtgtgcatcacgccgtcacgcacatgtggaataacacgtgctacacagactatctatcgcgctctcgctctctctctctctcgctctctctctctc

SEQ ID NO: 705902 - DNA, 632 bp, Homo sapiens
gtatattttttgggatctcaatatatgatctgtggactcgaagatctgtgctatgtaattggcgcgctgtgtattaagcgcttatatattcgcggtgcagggaccttttacctcggattcactgtgcccacacttattttatgtttaccactggtgccttactcactggggatgcacatctcatagcagcgttaaacagcgtgttacgaaaggctttgattcctgataagcttatatgttaccggtgaggctttattacttgagagaattttcagggcctgttagcatgaggtctagcctctaaccgaccattgccagggctatctttggaaggccaagctagataatgtctgtagaaagacgggtctaactaaagatgccgggcgaatgagttcaataactcgtattatctttctttgtgcaaacgccaagccggacttgtggggcttggttcaacaatgttcggaaccttattcccctgttttggcgggaattaacgggccgcctttcaaagccgggggtcactttaatctttaccaacgccgggatccaatttgcccaaagcgcgttttggtacaattcttcttcataggcaataaagggggataacaggactgtgtttccttggccgc

SEQ ID NO: 705903 - DNA, 458 bp, Homo sapiens
  misc_feature (346)..(346): n is a, c, g, or t
ccgccgtaccagttgcggtgtagcacaaggtcacatcttgtggtggtgctgactctgaccatctgaccttagccaaggcatctgcctcatcattactaggggtggccaaaggcatatggcctgacacatgataaatagttacctctttttgatgacctatttcccaaaggtcttgccatatggcttggctcaaatgggtctgtggctcactagccaattctgtattttccaagtagttaaccacaaggttaagcctcagtagactgcccagctatcagtacagattaccacagttgtcacctccttggtgatcaccatccacactgctctgagttcagcccattgnctactttgtccgcacccagtttcaaaccatatggtgtcagtactaggttggactgcaacagtggtccaggcagcagtagcacctcatctactgtcgcaactggtacggcggg

SEQ ID NO: 705904 - DNA, 145 bp, Homo sapiens
ccttccagagagcaaatccccagtcttctgcaaaggtatgtacaaagatagttcctcaattgtgtggaaggggatgttactgaagtataaagcgttgagcagaagaaaagttggaaagtagctgaggttgactggcttatgttta

SEQ ID NO: 705905 - DNA, 277 bp, Homo sapiens
acccagtgaaatatctccggataaacaggtccctcgcatcacccgacgacgcggagaacctctccgggctcagagggccaccccaaaaccccattcgtggcacggaacaacgtctcccgagcatcggtggctctaacgccaacagctcctcctagaacaggctctgtgcagacacctccagatttggaaagtcctgaggaagtcgatgcagctaaaggagccccagacgtggtcggacctaaatctgaagtggaagaagggcatggaaaactcccat

SEQ ID NO: 705906 - DNA, 103 bp, Homo sapiens
agtgtgtagccaaggacctccttctgcacgatccaataggagacaccagtactagactgaatcatgcccccaactaaagtcacaaacatgagcggacgtaggg

SEQ ID NO: 705907 - DNA, 740 bp, Homo sapiens
  misc_feature (275)..(275): n is a, c, g, or t
  misc_feature (334)..(334): n is a, c, g, or t
  misc_feature (364)..(364): n is a, c, g, or t
  misc_feature (684)..(684): n is a, c, g, or t
gggacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgtttcactgaaagatgttcaagagatagcaactgtggtggtacccaaacccaaacatttgccaagagaaaatgcaatgtgaggtaccaagatgacacacgatgacntgcaacatggaggactgatattaagagaacacaacagagactcttctagaccagcatgnacagtacccaatatggatgaaccaaaggcnaaagaacaaggctgaaggcaacagcgagagaaaagaacgggggaaaagccaaacgcaaaagcagtgaaatgtggcaaagggttgtgcctggtagactcttaaaaccttggaaaatgccacatgggatagattgacggattagaatgtatacaccatgtatactttgatttcaactgcaccaaattgaaaaaccaattgtttcctatttaacttggccttttttcttcaattcaaacccagcataactcctcaagtttgtgtatgggaacttgaataaacatattttcttgtgatacatccaagctctactgatacttaantggtgctacccaatatccagttatatcagggctcaacgtgctgtcaggtattaatc

SEQ ID NO: 705908 - DNA, 263 bp, Homo sapiens
aatgccccccccataaaactccaacatcaatttcattgcccagactgactgtagttaattttgtcccagaatttatgggctgaatttaaggcttccaaaaatgttgtttgtttgcaaaaatcaaacattgttaggcaagaaattttttttttcaaaatgaagatttatccccttgtggtttaagctgtactgaactaaatttgtggaaagcattgtgacctgtaaaagcaaagtatcaataaaggttatagcctttcccccca

SEQ ID NO: 705909 - DNA, 224 bp, Homo sapiens
gtatgatcctaacaggtgaggagtgagggtatcagggtgagtgagggtgtcagggtgagtgagggtgtaggatgagtgaacgtgtccagggtgagtgagggtgtcagtgtgagagtgagggtcagtgtgaggagtgacggtgtctggggtgagtgagggtgtacagggtgaggagtgagggtgtcagcgggtgagtgcaggggtgtaccagggtgagtgcacat

SEQ ID NO: 705910 - DNA, 313 bp, Homo sapiens
ttagcacaacctagggtcagttttgcaggtggtaagccatttaccaagatagtgtaggtaaagaagggcagatttattagagaaatgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 705911 - DNA, 372 bp, Homo sapiens
tcttgagtatcccggtcagcactgaagcgtggtcagtcctgagctgtgggatcaccaggacatcaccgaagacatgcttttccctcttctggttgctggagctccgagctagagatcgtggtggtggggactggagatcggaccgagaggctgcagtcccaggtgcttcaagccatgaggcagcggggcattgctgtggaagtgcaggacacgcccaaatgcctgtgacaccttcaacttcctgtgtcatgaaggccgagtaactggagctgctctcatccctccaacaggagggacttcacttacatctttgggccaagctgctcaaatgacacgccaggaactgacctgctgactgcactctggcagggt

SEQ ID NO: 705912 - DNA, 123 bp, Homo sapiens
ttggtagtattgcactccacaaggtccaaaaaaataatgtggtaccttaaacttgatctaatgcatgatggcactgagatattctattatggcttctcaattaattaaatagagaatcagggt

SEQ ID NO: 705913 - DNA, 453 bp, Homo sapiens
  misc_feature (69)..(69): n is a, c, g, or t
  misc_feature (73)..(73): n is a, c, g, or t
  misc_feature (83)..(83): n is a, c, g, or t
  misc_feature (90)..(90): n is a, c, g, or t
  misc_feature (125)..(125): n is a, c, g, or t
  misc_feature (138)..(138): n is a, c, g, or t
  misc_feature (201)..(201): n is a, c, g, or t
atgaagaaaaacgagcctcaacacagaaatgtagttggaaaaggaaggcatgtgttttaaataaagccntttncagattgtgnataatcnttgggactatgccaaaactctgataagtggtagcntctttttttttanttttttttttttgagtctcgctcttcttgcccagactagagtgcaatggcctgatcttggctnaccacaacctccacctcccgggttcaagcaattatcctgcctcagcctcccaagtagctgggattccagacatgtgccaccacgcccagctaattttttttttttttttttttagtagagacgggatttctccatgttagtcaggctgatcttgaactcccgacctcaggtgatctgccccctcggcctcccaaagtgctgggattacagcatgagccaccacgcccggccgacaagtggtagcttcttaaa

SEQ ID NO: 705914 - DNA, 333 bp, Homo sapiens
  misc_feature (110)..(110): n is a, c, g, or t
  misc_feature (275)..(275): n is a, c, g, or t
  misc_feature (329)..(329): n is a, c, g, or t
tgagacagggtctcattctgtcacccaggctggaatgcagtggcacaatcacagctcactgcagccttgaccttctgggctcaagcaatcctcccacctcagccgggacnggtatccacagacgcacacaaccacaccctgctaattttgtattttttgtagagatggggttttgccttgttgcccaagctggtcttgaactcctgagctcaagcgatctgcgtcagcttcccaaagtgctgggaagaacaggtttgaaccaccgcgcccagctnaaaaaagttaaaatttatcaaaactatggcacattcaacatttacagaaccatnacgt

SEQ ID NO: 705915 - DNA, 203 bp, Homo sapiens
tgagccataggatacatctttcttattcaccgtaggtaggcatgactggccattgtattagcaaactcatcactagacatcgtactacgcgacacgtactacgttgtaggcccacttccactaatgtcctatacaataggacgctgtatattgccatcaatacggcggcttcatatcactggatttcccctaattcatcaggc

SEQ ID NO: 705916 - DNA, 111 bp, Homo sapiens
acattagaggcgcgtcacttgtgggtttgggccggcgttcacgtagagcaggttgacctgcttggcctgcaggtatcacgcatgcgtgaggtcagccagatgctccattga

SEQ ID NO: 705917 - DNA, 126 bp, Homo sapiens
ttgctgaagatcatgaccgccactcatgggccaccggatgtggtccttgtcccatttgttagggctgcatccatccttctcagaagatgagtcctgttccttgcgcagggcactgtttggactctg

SEQ ID NO: 705918 - DNA, 256 bp, Homo sapiens
gaattcggcacgagggacacccctgctctacccatgagcctgcccgctgcaatgcctagacttcccaacagccttagctgccaagtgctggtaactaaccaacaagggttggaaccccaagctaccccttctttgaagggctaaggcccccaaccatagcccctgcccccgggggaggccttgggggaacccatgaagttgtcagctttgcacttaatctcctgcctctctctaaagactggccctccttgggctg

SEQ ID NO: 705919 - DNA, 221 bp, Homo sapiens
cggtttttgttttggggggttggggtaacccccctagcccaaattgtttggttttaggggggctaccaatacccccttggtttgggaaatgccaaggttaaaaatgtttttaggctgcctgttgaccgggttagggactcctggttttggggaattttttttccaatttttttgtttttttataattattttgttggccctttttttttttcccctcctta

SEQ ID NO: 705920 - DNA, 262 bp, Homo sapiens
  misc_feature (22)..(22): n is a, c, g, or t
gttcagttccctccagggattnaaatcgggtctgatgctggccttcggtgcgcagccagtctttgatcgacgcctgatctgtgctgaaaccctcgccttagtcgggctatcaagcccatcgagcacgccattccagtgggagatgcggatgtcatcgatcgggccttcgagtgattgggtcaagctgattctggggttcaccgggtcctgcagaatcgcagcgtgttgtcgatctgatgacgaggcaatgtcgggaaatcgc

SEQ ID NO: 705921 - DNA, 244 bp, Homo sapiens
  misc_feature (29)..(29): n is a, c, g, or t
  misc_feature (71)..(71): n is a, c, g, or t
  misc_feature (87)..(87): n is a, c, g, or t
cttccctgatttttatgttgtaacaaagnaaaaaacaaccataatttacttgatcagcgtgaaaaagcggnaatcatacacttctgnaatctgaactggcaatcacatatttcacaacgagggcgcgaaaagatgactataaaatgttcatgagggactgaatactgaaaactgtgaaatgtactaaataaaatgtacatctgaagatgattattgtgaaattttagtatgcactttgtgtacg

SEQ ID NO: 705922 - DNA, 362 bp, Homo sapiens
  misc_feature (158)..(158): n is a, c, g, or t
  misc_feature (230)..(231): n is a, c, g, or t
  misc_feature (291)..(291): n is a, c, g, or t
tttttaagattcaaagtcaaaattgttttattgtcactcacatatttaacaataaaaagaaatgcagaaaatggctcaagtatcgtattgaaaaaaaatcccaggttgtgcagcttgttctattaacatctgggagaagagcttgttcccacatcagnacagcagctgcagttctccaacgtccctttgcagacacaccgtggcacacttgcacaccacggggcagcagnncagcagctcttcttgcaggaggtcatttgcactctttgcacttgcaggagccggtgcagntgcaggagacaccagtggtgcaggagcagttggggccatttcgagccgcggtaaggctggagatctcaagc

SEQ ID NO: 705923 - DNA, 774 bp, Homo sapiens
  misc_feature (329)..(329): n is a, c, g, or t
  misc_feature (386)..(387): n is a, c, g, or t
  misc_feature (392)..(392): n is a, c, g, or t
  misc_feature (407)..(407): n is a, c, g, or t
  misc_feature (409)..(410): n is a, c, g, or t
  misc_feature (415)..(417): n is a, c, g, or t
  misc_feature (423)..(423): n is a, c, g, or t
  misc_feature (433)..(434): n is a, c, g, or t
  misc_feature (436)..(436): n is a, c, g, or t
  misc_feature (438)..(440): n is a, c, g, or t
  misc_feature (533)..(533): n is a, c, g, or t
  misc_feature (536)..(536): n is a, c, g, or t
  misc_feature (541)..(541): n is a, c, g, or t
  misc_feature (553)..(553): n is a, c, g, or t
  misc_feature (556)..(556): n is a, c, g, or t
  misc_feature (558)..(558): n is a, c, g, or t
  misc_feature (567)..(568): n is a, c, g, or t
  misc_feature (582)..(583): n is a, c, g, or t
  misc_feature (594)..(596): n is a, c, g, or t
  misc_feature (599)..(600): n is a, c, g, or t
  misc_feature (605)..(605): n is a, c, g, or t
  misc_feature (608)..(608): n is a, c, g, or t
  misc_feature (612)..(612): n is a, c, g, or t
  misc_feature (620)..(620): n is a, c, g, or t
  misc_feature (634)..(634): n is a, c, g, or t
  misc_feature (640)..(641): n is a, c, g, or t
  misc_feature (644)..(644): n is a, c, g, or t
  misc_feature (654)..(654): n is a, c, g, or t
  misc_feature (661)..(661): n is a, c, g, or t
  misc_feature (664)..(664): n is a, c, g, or t
  misc_feature (669)..(669): n is a, c, g, or t
  misc_feature (677)..(677): n is a, c, g, or t
  misc_feature (679)..(679): n is a, c, g, or t
  misc_feature (755)..(755): n is a, c, g, or t
tccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgtctctctccaactccttccaccacctgcagctctttgaccaggacagctccaatgtggtgtcacgcttcctccaggatccctactccaccaccttcagcagcttctcccgagtgaccaacttcttccggggtgccctgcagccanagcctgagggagccgcctccgaccttcccccgccacccgacgattagcccgagcctnnattcnaggtcatttcctgtntnnagctnnngcctcngccaaccgtnnancnnngccctccagttacagaggaggagtgggcacgccacgtgggccctgaaggtcgcctgcagcaggtccctgagctgaagaaccggatcttctctnggngtctnagccccagcctncgncncgaggcctnnaagttcctcctagnntacctcagctnnnaanncacanctnattntcacaatncccacatactcaanaaaacnnatnagtatttccncatgaanctncagtngaaatctntnagccctgagcaggagcggagaaactcacttctgcatggataccgcagcctcatcgggatgtgagccgcactgacangaccaacaagttctacgat

SEQ ID NO: 705924 - DNA, 188 bp, Homo sapiens
acacttgcactgttttgtctgtttgtagctcatcagagactcccgatctattaaaagaaactaacaaaggaaatggtcaaggatgaacgatagaagacttgtctgtacgtattcaaatgttagagctatagtgatccacatccagctaggatctggttcttggaacaccaaatgcattgacatggagt

SEQ ID NO: 705925 - DNA, 111 bp, Homo sapiens
caccagcccagtctgcaggcctgagctctggccttgggtgcatgctgccggcagacaagatggggcaagggccttcctagaaggatgacatgaggattaggcccaatctgg

SEQ ID NO: 705926 - DNA, 143 bp, Homo sapiens
acccccccccccccttgggggggagggcgcggcctttggggggggggcccccccacgggggttttttttttttccctttttcccctgggccccggggggttttgggggttttttgttttttaagggggggtttttttttttta

SEQ ID NO: 705927 - DNA, 482 bp, Homo sapiens
atcacaccgctgaatctgacccagtggctgatggtgctgaaaatctccttgcctgtgatcctcatggatgagacgctcaagtttgtggcccgaaactacctggaacaacccggtaaagagtgtgtgcagcctgccaccaaatcttcctgctccctgtcggcatgcaccgatggcatttcctggccgtttgtgctgctcattatgcccctggtggtctgggtctacagcacagacactaactttagcgatatgttctggtcttgactgacagcgctacatacagaagatgtttaacttaatcaattaattttttattgtttaaagcaactgtctatttctgctgaattttcacatgaacatattggctggtgaaggaggtttcatatctagattttgttttgctttttctgactccagtgggacaagattttcctttttttatacacataattaaagtgtccattgacgtgtacagagaacta

SEQ ID NO: 705928 - DNA, 187 bp, Homo sapiens
  misc_feature (9)..(9): n is a, c, g, or t
ccaggttancggcaccttggcgtaccaccacaccgccgggcttatgcgccgtccaggcgcgtcctatgcggattttttcttcgcacttggcggatttacaccgctaatcggtacttcggttgctacctttccgaagttttaacgaattgggcacctcaaacaactggttgtggcgctaattaaccac

SEQ ID NO: 705929 - DNA, 168 bp, Homo sapiens
tcttacatctacaaccaggtatggggtgatagactattgtttgacatggcacaactgtattgaattgggtgggaatcttttcccccagttagaaaaacagatttaaataacttggtgctacgtgaaatcatattttacgcgaacaaatagagatagtgaatacagttc

SEQ ID NO: 705930 - DNA, 190 bp, Homo sapiens
ccgcggccaaggcagggtgagtgctgtataaaatattctatgttacttcaacttctgttctggctatgtggtatctgatcctagcattagcaatatgggtacgagtaagcaacgactctcaagcaatttttggttctgaggatgtaggctctagctcctacgtggctgtggacatattgattgctgtagg

SEQ ID NO: 705931 - DNA, 440 bp, Homo sapiens
ctcacaaatccggccatggagtgcccctaaggtaggccggggtgacctggacatccagaatgcctgggaagccatgtcttgggagcctggtggcggccatgtctgggagggactagcagagatctgggccaggaagcatcagctcagggccatcggcccttttcctggtgccccttgggagcaaggggccagatgccctagaggtgtacctggctgggaggctttcttggctatggggcacccccagtgaaggtcccttcccagtgctggagttctacgggcattggtgcttgcggtggctggcattggattgttcttccaatctctgggagaagacgggctgcttgagaccctgttggcccatactcaaacctttctcttttttttgacatgattgaagcaatgctatgccaaccaccttaagaagccacggtcaccgg

SEQ ID NO: 705932 - DNA, 931 bp, Homo sapiens
ggggcggcggtggcgattggacttggtgggtccgggccagggcgggctgccgcatggtgtacctgttcggccgcaagaagcatgagcctgcgtcacgtgagcatggacaatggccatcctgcaactgaagcagcagctgtggacaatgcttgagtgcagtaccagaagatggatcgcccatgcgagctggatgcgctgatgctgcgccctggccctggcagtctgctgcgggactggccaggaacgtgaactggtgccaatgctgcttgctctaagaagaacgctgataccctgtgatgcatgccgtcctgtgacatgtgactgtgatgacaccaagatccatgcatggccttggcacggcacatgtgttcagagacgtacttcgactgttcaccgcacgatcggacacacttgacacacgttgactgcgacggggggctgcaggatattggtgagcaatgatgcatgctcttgagacgagagaagttgccaccaggagttgatttgtccgatttgcaaggaagagttgggaagacggggatccgttgtgacggaggaactggcaggggagggccggtgcggcagtacccagagctgtgccaacattatgacggatgcttcctttgtggccacgcgaaagcctttcagcttcaagtgcagcgcattgaacagactgcccaatcccttgcgcaaggaacgcttgacgccgcaaattccaccttcaggggaaagcaacactacgaaggcttgcgcacgaagggtttcacgcttccggaatgcgcccttttcccttgaaggaacagattccccaggagaacaccgtgtcccattggtccaaagggcccacgggcccccatgtggccagggccgggacgccttggcctgggcagcgcctttccgttaacctgtaggcccttccgtctttggtcgg

SEQ ID NO: 705933 - DNA, 393 bp, Homo sapiens
  misc_feature (19)..(19): n is a, c, g, or t
  misc_feature (54)..(54): n is a, c, g, or t
gcgcttaacgggtccaccnagccctgggggaaaatgtccatctcctccattggngtagtgggcgcccccgaggacaaccgcagccacagcgcccacttctttgagtttttcaccaaggagatagccctgggccaggaccggaaaattatccgctttttccccttggagtcctggcaaattggcaaaaaagggcgggtcatgacttttttatgattgggcccggagggatccagggcatctgtgaactggctgctttttccaaaaagatctcttggcaaagggagggcctggaaaaaaccagctttggattatcccgcaggccccattcctggggtcccaaaatcctttttttcccccccaaatgaaaaaaaagaaaagagcttcccccttcca

SEQ ID NO: 705934 - DNA, 261 bp, Homo sapiens
caaccttccagcctcctttgctggcattgatgggggtccctttttgaatgaactagtttaatgtgggtcccaatttattgggcatattctttcgttttggttttccaaaaatgggttattcccatggaaatggacccccgtttagccctgggccccccccttaccctcatatgtgtaaaagcttaccccggtttcagaaaataaatgggttccttttctcttaaataactaggaccaaataaaaccgatgtccgttgttta

SEQ ID NO: 705935 - DNA, 682 bp, Homo sapiens
cttaactccagcccccacccacaccaccatccacccaagccacaggccccacttgctaagggcaaatgaacgaagcgccaagctacctttcggacgtaatcctgccgtgggaaggcagagcatgtaagtgcacatgttacagctggggtatgcctatgcatacgagagtattaatcttacgagaacaacaacaacttgtcacactactcttgtatttcaggttcccatcaggtgccgttccctccttatcccgtttgctcgtacgtctccacccctctttatgttccccccactacctcaacatggcatataaaacgaagacagccagtcacgtgcaaccgtatacggcgaacgaagggtaagcagccaggagagtcacatagaaaccccctacaacccgtcaagcacaacacaccaacaccaaagaggacccacaatccaacacatcacaacgattggcatcccaaccctgacaccacaccccgtgtcccagctacgcgatccttcagcagcccgcactcttctctatgcggagaaccatcacatctgttgtgccagctcgagactattaacctccctactctaggaagccatggcatcattatatcctccctctcgctccgccataatgactcactccctctctcagatattattcggattccgacgcgtactgatcagc

SEQ ID NO: 705936 - DNA, 755 bp, Homo sapiens
tcatctgtgagaataatcgctatggaatgggaacgtctgttgagagatgcggcagccagcactgcattactacaagagaggcgatctctcattcctgggcctgtagagctggcatgcgcatatggatatcctgtcgcgatccgagcaggcaacaaggctttgctgctgcctattgtagatctgggaaggggcccatcctgatggagctgcagacttaccgttaccacggacacagtatgagatgaccctggagtctagttaccgctacacgtagtaagaaattcaggaagtacagcaacgtaagagtgaccctgattatgcttctcaaggacaggatggctgaacagcaatcttgccagtgtggaagaactagagaggacaattgatgtggaagctgacggaaggagcattcgaggatcgctgacgccagtttgcctcggccgatcctgagccacctttggaagagcgtgggctcaccgactatctgactccagcgacccaccttttgaagttcgtggtgccagatcagtggatcaagtttaagtcagtcacgttaaggggagcggagcaatggagaggttataccttcagggggctaccagacagtgttctcaccttggttaaggaggaagaaaacccagtcaatgatattcaatgaattcttggaaacttccattaagtgtgtagactgagcaggtagttaccgcatgcagtttgtacattagtgcattaaccatgatatgagtgctagaacc

SEQ ID NO: 705937 - DNA, 219 bp, Homo sapiens
cccaaattttttttggggaagaaggggggggggaaaaccctatcccccctggttttttggtttggggccccccggccacacaaaatttggggcaaaaagcaaaaaatttttttttttccccctttttttttaaatgggaaggggggggggcggcccctttttttagacctttggcctttggaaaaagcccctcccccgtaaagggttttttgggcccta

SEQ ID NO: 705938 - DNA, 201 bp, Homo sapiens
tttcccgggggggggggcacctttttccggggggaaccttaagaaaaaaaaagggtttaaaaacccccggggcctttttgggttttttgggggggggaaccgcccgggttaagggggggtttccggggggttggggttggaaaaagggggggttatttttggggggttttagggggaattaaaaaaagggggcttttggga

SEQ ID NO: 705939 - DNA, 204 bp, Homo sapiens
gcggtcacacgcacggagagggcgagtggctggcgttgtggtcatgctgtcgggcgtgttcgatcgaatggttttattgtgccgaattccgggcggggtgtcgcctatgctgcggataggtgcgtatgtctgacatggggttgtatgaattggtttgaaaggggcacggtgtgaccgacaaggcgccttctccggtggcgtggt

SEQ ID NO: 705940 - DNA, 912 bp, Homo sapiens
ggcctctcggagctggaaatgcagctattgaggtcttcgaatgctgcggagctggaggcggaggcagctggggaggtaccgagcgatgtgaccaggccgacatacgctcgtactacttcctctactcctgaccgcctcctgtctacgaaaaataactattaactaggtctaacaggacaagcaaaggaccaaaaagtagtcgtccgacccttcaggccctctcttccatctcagcctttccgcccggtgagggaagccacggggttggacatggaaccagaacaaaacaggaagaccagagaccaggacgaaagacaccggaacacggacacacaggacaagacacaacaagaagagcaccagaccacacaaaaaagccaataccaaatcgtaagaaacccaccggggagccacagggcgcaccccagaaggaacatgagcggccgaggcaatcacagaccggacagaggccggatcgctaacgatataacaaatgctgcgcaaagggtgggagaagacgaggcgcaaaaccacaaagggggggacatctgacaggaacgaaaccgagaaatcgcgctatacgcgtcggtacgcagaggcagcccccgattgccggcgtccccccaggaaggaacacccatggccctaagcgccgcaccaccatacgtctatgtgggagacgaggaaaaggacagacatggatgactagatgcagcgcatttcacgacacacgaggggactgaacccccaagaagcaaaccgacatcaggccccacacagcggtcccaaaacgaggcaaaactcgtgggggcgtatcttagcaccgggaacgctgatagaagatgacgcgggacactattctagaaccacgccgatagagagaagacgacaagtgggactaagagaccacca

SEQ ID NO: 705941 - DNA, 495 bp, Homo sapiens
  misc_feature (402)..(402): n is a, c, g, or t
  misc_feature (428)..(428): n is a, c, g, or t
  misc_feature (475)..(475): n is a, c, g, or t
gctttgtaaacacagaggcagctgaagttgccctgccccagccccaatatcctcctgtgcactgattgatttagatgctggtaatgcttcctaccagtgacagggaacttccagtctatctgtcaatggatcatcttttgatttcccctatctaatttcccctgctcaggtaatctatgaacacatattgaatgacatacttaataaacattttatcaatatttttaaatagttttggcttttaaaagactgtggccaggcacagtggttcacgcctgtaatcccagcactttggggaggttgaggctgggcggatcgtttgagcccagggagttcgagaccagacttgacaacacagggagaccctgtctctaacaaaaattaggccgggtgtgggtggtnttgccactgggtaggttccagtttgntcaggaggtgaattgtgggaaggattcttttgagcctgggaggcagnggattgcagtgactagcctg

SEQ ID NO: 705942 - DNA, 1371 bp, Homo sapiens
gacttcgtgcatcgtgtccgttcttctgggactgcttgcaaaatgtctcccttgcatggagacggtgtgggagtagactaaggtccggtgcctgactatgcgatagcgaagatgaatagtggcgagagaattcaccaatcaacaattgactagagtcaacactgctatggcatgtgtgggacgttctaacgtagacgtcggtagcgatcccctgtcgacatgtcgacatgacagtaccaatggatgagccactgtagggcagagtggtaaccactccgatgaatgctgtcgcaatttgtaacaacgcaaggacttccaagaccaaagaaggcttagctcttagggagacgcaggaggggcaagtgtacgagaaagtagatggtcccgattaacacggaaggtcactgtcgttcgacggtgccagttagcgacgtaattcccgacttcatcggacgtgtattagtaaagagtagcaagcgaaaaacttaaaggacgtaaatgagtacaacatttagggttgaaatcgcattaagtgggtgacccacgtaggtgtaaacgcaaagcatatatgcgataggaacagacatccttgaacaaggaaaccgaagatgcaataaacttaggtttggtgcgactttggagcaggcaaacccttaaaaaagtccccgccatttgggaaatttccgggtcccaacagaatattcctagaagagagtttaacacgaagggctctaagattatgcagacacacgttttaggggcgaaacaagctggcaaacgctgctcacaacagcgggcaaccttacgaacgagccacacggcacaaacaagcaacacacaacacaagcactaaacagagccaacacagaggcaacctgcccacaagcgaggcacagggccaacacagactacaaaactttcgagaagcttgacaagtgaggcagacacggaaaaacccgattaaccagcacagcgaaagcgaaaaccaaccataaagggagcgcgcgacaacgcaatcgaggggcaacgccccaaaagagaacaaagaccaccccacccactaggaacctggggacgacccccataccgaagagcgctctcgaacaggcgtgacagcatgaacacagcgataacatataggggagaaagcgaacaaatattaaccgcatcagcaacaaggggcgaccgggaccactcactccgacaccacatatataaagaatggaaaacgcgattgggcgagacaaacaacgttcacacacacaacagacctactgggagaacacaagaggaaccacccaccatagtaccgagacatagctcatccaacagcatgcggcttaatgagaacataacgcagcgataacaagg

SEQ ID NO: 705943 - DNA, 177 bp, Homo sapiens
tctcggcgactctagagatccccacttgatgagcactgcattagcatttaggtatatacacagagatagagagacatcccgaaaaaagacattagaacgtatttccaaacttcactctatagttgtacatcttgatcaggaagctgtaccttttattttgaatacggatcccctagg

SEQ ID NO: 705944 - DNA, 451 bp, Homo sapiens
  misc_feature (157)..(157): n is a, c, g, or t
  misc_feature (337)..(337): n is a, c, g, or t
  misc_feature (415)..(415): n is a, c, g, or t
tccatagtctcttctgattcccctgcagacctggaattttgaggtctgacccaaataccgtttaattttacttcgtaatttaatagtggcatgcatttgatttctgtctttatttctaagctgagggaaaacattatttgaaataaatgtgaaaaangattctttagtggtctccaaataattttaaatttactgttttttttattagaatcccgctaggaacatttcagcattattttaataattgaaaccattgaaagaatcatttattaagaaattagatttgaacattttaggatttcttgaaatctcattactttttgtggatctgtgttantcatggggtcttcctgggtattaaggaagatggatccaaaaggggtggggtgccggtcagtgggctcacgtctgtaantcccagcacttaggggtgggccggagcagggcctgg

SEQ ID NO: 705945 - DNA, 863 bp, Homo sapiens
  misc_feature (863)..(863): n is a, c, g, or t
ggcagagccttggtacttggacctgaaccttgctccgagagggagtcctcgcggacgtcagccaagattccacgaatgactactatctggacttacccctttaaagaatcttcccactgcatcaaaagtgggccctcagattttccataagacctctgagctgtcctcccagatacgagctgccccagctgtccagaccaaagacgaagaacgacgttagccaaacccactatcaggaatgtagtggtggtggctggtgttcgcactccattttcgctagtctggcacttcagtataaagacctgatgccagcatgacttcggctagagcagcgctatacgggttagttgcatcggaccagtgtccctaaggaagtagcttgacttatatcatcttgggtacagctcattcaggaagtgacaaacaagccaactgtggctagcagcaggctgccctaggagctggcttctctgcacaagactcctgctgcacacctgtcacacatggcttgtatctctgccaaacaagccatgaccacaggtgttggcttgattgcttctggccagtgtgatgtgatcgtggcacggtggggtgagtttgatgtccgatgtccctattcgtcaactcaaggaaactgacacaatggatgcttgatctccataaggccagatctatgggccagcgactgtcctttactctctagattcccgaagaattccaagcacctgagctcccgacggaacactggagtactccaccagtgagacatcggccacaccagaagaccagacgggcgcgcaacacgcgcaaccggccgcgacaggacagcaaatccacgaggcccaacagactagacacacagn

SEQ ID NO: 705946 - DNA, 122 bp, Homo sapiens
gtttttttttaaaaggcttccaaaaaattttcttttttggggggtttttgttcccccccccaattttttgggttttttttggggggtttttttggggggtttttttttttacggggccccca

SEQ ID NO: 705947 - DNA, 1439 bp, Homo sapiens
gagctttcctcttctgtcaaccccacacgcctttggcacaatgaatgtgtgcgatagacctcttagtttccctgtctctctttgctctttgaggctcgcgcgttattccagggtgtgtgtctgctgtcgtagatgcacgactaagagtgaggttgcctcatcgtgtttgaaagactcttggtgcatgaacgatagaatattcaaacgccttgcgattgctgtggaattagcacttatgcatctatgctcaatctcttcaggcgaaggtgtccattgtatgacatggactccatgtagagagaatctcatgtggagacttgaccgtagagctcgaaaatttatagctagaatacacgattgttggttcgcctaggaatggaaggttctacgccttaagacacattcttgttgcagcaccaaagtcaacgtcttcatgagccctatgtttggggaagacacagatgtcatggccacaagtttgtcagagcgtcctttgccgttgaaaaagccttaatcgggctgacacatggtgtcttcgaactcgtctagttggccacatagaccaatatggaaacccttgaacgaaggaaaccattcgcacacttcgctttacctttcgtcacatccatccaagaggaattagacctatgagccaaataaacccgtcccccccccgggaagtgttgggttgaaggaaacacaaggaacggtgatatcgaccgtagtggaacttgatttgcatccgattgacattgtatattcaatttggaccacattttgacagggaatggcactaacttttttgcgtcgaatccgactaaattaaccttttacttattcgaacacaactttgtgcgccaaggaacagggaccacatcacatttaaccattttttagttgacaccccacgggaaaacccttcccctttttttatcctttttggcctcaacacacaggtgttaccttaacaacgactggtattatttttaaccaagggacaatggttttggcccaaagggctggccttggacttaaaaagggccttgccccttgtcctgtgttttggcccaaaagaggccttcgcaatagcacacgtcttcgcgggcacttgacacacggggcaaggagccttatccggtcttgggccagaagacaggaagaaacttcccacaggttggtttgccccaaggtcactcccacaacacaacaacttttgggtgacggaaacacagaaagtgcttgtgcaacaaacgccattggggccaagggtaagctctcggcttgacgcgcacgaagggatttttccccacaaacgcgggctggaggtttggcgacaaggaacaggtttccccacaagctttagatctgaccagcaaccctgttaacccaggagggcttccacacaacgggaatggcgatgcaccatggaaaaattctcg

SEQ ID NO: 705948 - DNA, 649 bp, Homo sapiens
  misc_feature (614)..(614): n is a, c, g, or t
aactcttcttgattctgaatagtatttggtcacaccagatgtattacatgtgtggcttcctatttctggagcttatcattttggttattacctgatctgaagcaactatacttctttgctgattccacctatgtgcagaggattatcattgtcaacggcgttcattccttacgagtggctttactgcagtttatttcttaatctatgcagcacactacttcttttcaaaactgcagatcacgggaacagcatgcacaattctgtactttggttataccatgataatggttttgatcttctttctttttacaggaacaattggcttctttgcatgcttttgatttgctaccaaaatatacagagtggtgaaggttggctgaagaagtccagtgtgtccagttcagaaataaattaaactcttcatcaacaaagacctgatattgtgactgccttgagctttatcagaattattgagctagtaatccttcagaaacactcgaattctaaataaacctcttcccatacaccttttccacatgagatggtgtttaacactatgcattagcattgtgatctgacaacgtatatcattgggtgctctcaatgaagagcanatttagatattatgtgcatttgtctacagtagctt

SEQ ID NO: 705949 - DNA, 165 bp, Homo sapiens
gactctagacgatccccagttgagggcgggcgacttcaccccctccgccgacgtggagatcatgaaccccgacctccacatcgccaccctcgaggagggcgggaagctctacatggaggtgcgggtggaccggggggtggggtacgtgcccgccgagcgccacgg

SEQ ID NO: 705950 - DNA, 1015 bp, Homo sapiens
ggcaggctccggggcgctactccattggcggcgggatggagactatgcagagcgcagcggatgcagcctggtgtgggcaccagctgggaggggcacctctccgagacctgctgtggcctggagtgactggttgcgcctgtgtgtgccatctggcaaccacggtggcaggcgccgcgagtagagcccacaagcgaatccacaaggcgagctgccacatgacacaggggagcagcggacacgcggaccggggagggggcgccgagcacgccgtgcacacagccaacggcgagcggaggcgagaagcaagggaagagacgggaccacacagccagcgcagcagagaacacacgcccaaagggcgagagacgacgcgcacacgcagcgaaagctaacgcgagcgcaaccctgacaggacaaccaacgacgaacgaaaacgcaggcgacaacagaacaagagcgacacagacccgagcgcggcgagtcgacgagcacggaggaacgaacagcgaacaccggagacagagggagtccacagctaacggagcaccacgagggaacagagaacgaacacggcgaccgcagcagaacgagcaaagcgcggccggcacacagccggccacggggcgccccagaccgaacgaggggcacacagcagaccgggacgagaagagacagcgccaaaggacgggagcgcaaacgacagggcaggagccgcagcacgccaacggcgcaccagcgagggcgccagcaagcagacgccagcgcaacgcggcagaaggacagcacacgagaagaaaagagagaggagacgagaagcgcgagaagagagacagacggaagagagagcaagcaactagcacggcagacgacagagacgaagaagcggagaacaggcgagaggacccggcggaagcggcgcggagaggaagcagaaccgagagaagaaaaacaggggaagacagaaggaagagagaggccgcacgcgggggcaaagggaagagcagacgcggcggag

SEQ ID NO: 705951 - DNA, 788 bp, Homo sapiens
  misc_feature (47)..(47): n is a, c, g, or t
  misc_feature (82)..(82): n is a, c, g, or t
  misc_feature (107)..(107): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (255)..(255): n is a, c, g, or t
  misc_feature (281)..(281): n is a, c, g, or t
  misc_feature (284)..(284): n is a, c, g, or t
  misc_feature (297)..(297): n is a, c, g, or t
  misc_feature (320)..(320): n is a, c, g, or t
  misc_feature (326)..(326): n is a, c, g, or t
  misc_feature (370)..(370): n is a, c, g, or t
  misc_feature (395)..(395): n is a, c, g, or t
  misc_feature (400)..(400): n is a, c, g, or t
  misc_feature (414)..(414): n is a, c, g, or t
  misc_feature (423)..(424): n is a, c, g, or t
  misc_feature (439)..(439): n is a, c, g, or t
  misc_feature (445)..(445): n is a, c, g, or t
  misc_feature (453)..(453): n is a, c, g, or t
  misc_feature (456)..(456): n is a, c, g, or t
  misc_feature (506)..(506): n is a, c, g, or t
  misc_feature (567)..(567): n is a, c, g, or t
  misc_feature (570)..(570): n is a, c, g, or t
  misc_feature (573)..(573): n is a, c, g, or t
  misc_feature (584)..(584): n is a, c, g, or t
  misc_feature (590)..(590): n is a, c, g, or t
  misc_feature (648)..(649): n is a, c, g, or t
  misc_feature (688)..(688): n is a, c, g, or t
  misc_feature (693)..(693): n is a, c, g, or t
  misc_feature (747)..(747): n is a, c, g, or t
cgaaggggaagagggaaggaagaggtgacagctcagggcaccaagangtggagacagagatggagacaccccagccccaccnctctggaacaggaaagatgaaaagngagggagcacaggtcagcgtgggaagagggtcatggtggacanggnggtggngtggcctccccaccccctcacattaggcctacacgaacacagacacatgcaggagcctttgcagaaacaaagtcagggttcttcaagtcacaaaangaagggcaggaacaactctagcctcncantgccacacaaggnagctgtcacacactttacaagcngggagncacacatcagacccctgggcactgtcactgcttgccgcctgagngtaaccccctccttttcaaactganctctnccccctccacatcncgcgcagcnnccacagccccagctnatcacngctcttanggngaaccaggccagcaatgaggcccacgatggggatggtgggccgggaaganagctgcccatctcagggtgaggggcttgggcagaccctcatgctgcacatggcaggggtancgnggngccgcgccagngggcgnccaccacagccgcccacttctgggaggttccatcccctgcaggcctggtctccacganntccgtgtcctgggtctggtcctccccatcccgctgccangtcantgtgatctccgcagggtagaagcccagggcccagcacctcagggtgggctcatngtcagagatggggtggtgggtcatatgtgttttgggggggt

SEQ ID NO: 705952 - DNA, 297 bp, Homo sapiens
  misc_feature (39)..(39): n is a, c, g, or t
agctttggtaaaaataatagcttgtaagtaacactaccntgctttatgtctatataagtgaaaaacatttttttgttgttgttagagacagggtctcgctgtgttgtccaggctgaagtgtagtggcacagtctcagctcactgcagccttgtcctcccaggctcaagtgatcctcccagctactcaggaggctgaggccagaggatcccacaagactgggaggttgatgctgcagtgagctatgattgcgtcactgcactccagcctgggtgacagagcaaggtcctgtctcaaga

SEQ ID NO: 705953 - DNA, 1289 bp, Homo sapiens
gtgtatatacacattggaactattattcagccgtacaaaacagaatgaaatcctgtcatttgcagcaacatggatggaactggaggtcattactcattacggtgacatgagccaggaacctgaaccgacaaacaaaccatcaacatactggtcaatcctcacaatggggacgccaaaaacaaacaggggattcccatgtggatggcacgaaaagcgtggacagtggcaggttcgcaacgcgccaagcaccaaggggacaaggacaacggacggaggcgaaatggccacacaaactgtgcatccacatgcggtcaccaacacaatacccgtacaagcacacacggtgcaacgacgcttgctacccaatttcgcaatcaatccaccaagtacacggtgcaaaaatacttacgtttcatataccatcctaatcggttaatgcatattccaagaaaattaagccctcagcaccaggacggaaacgcaaggtttggcccgtggctaattcccccaatcaacacagcctgcaattaaaagcggacgctggacaagtggcaatgagaaacaagaaaccgacgccaaaccccacaaaaaacggggatgaacataacaacaccaagtaggggacacataaccggtccgtgagccaacaacagaactaccccaactggtcaccgcacacccgacgaagaacgacaatgccaacaacaaaaacgactaggaagtacaaacaggcgcacagatgttacagcatacacgcacacggaaaccactagggaacattggaagatggccagagcaagcacacccaacgcaaacgggggcaacgagagtgcaacagtgcaaccacacgagatacagaacaacagcccctgaccacgaccagggaggcaccagaagcaaaacccccaaacacgcgaataaagaaagcagactaataaacagcacagaccaactatgccaaaacagacacacggatagcaaccactaggacgtgggcaggacattgctcacgagaacacacgcacagcgagcaacaagcggaggggacacaaaggcaaagctgacacaccacgaacattatgagagtagaaaatgggagagtccaaaacgtgctcagaaacaagacaggaaaaagcaaggcggcgcaacagacaccgcgcgggagaaacgagatcgagaccaagatggagaggaggacgcagataaagcaagcaaccccaccgcgacgcaacgaagaaaaaagaaacaagacacgaaaacgatcgagacagacaagcggcacaacagaa

SEQ ID NO: 705954 - DNA, 456 bp, Homo sapiens
ggcacgagggaacctgtctctacaaaaaatagaaaaattagccgggcatggtggcacatgcctgtagtcccagcgacttgggaggctgaggtgagaggatcccttgagcccggagttcaaggctgcagagaaccaagatctcgccatcgcactccagcctgggcgacagagcgagaccctgtctcaaaaaaaaaacaaaacaaagtgtatattgtatatatatatacacacacacacacacacatacacacacgcacacacacatatatatatatagttcttaaaatttattccataaagtacacatttccctgtaaactctctacatatacacaagaggtaaaaagtgaaacaaaaaaattttttggggcacagccttgctcttgtcgcccaggctggagtgcagcggcaccatcttacctcactgcaacctctgcctcccgggttcgagcgatt

SEQ ID NO: 705955 - DNA, 345 bp, Homo sapiens
gcagattaatcccaattgttccactagtattctagttttgatgagacccagatttttggtgttgtttatttttgtttttttgaggggtggagtcttgctctgtcacccaggctggagtagagtggcgtgtctcggcttctcccacctccgcctcctgggttcgggcgattctcctgcctcggtgtcccgggtggctgggactacaggcatggtggcgtgtgcctgtaatcccagctactggggaggctgaggcaagagaatcactggagcccggaggcagaggttgcgatgagcctagattgcgccactggactccagcctggcaacagagtgagactctgtctc

SEQ ID NO: 705956 - DNA, 332 bp, Homo sapiens
  misc_feature (174)..(174): n is a, c, g, or t
  misc_feature (197)..(197): n is a, c, g, or t
tgataacgaagatcgaggatcgagtaaactgcagtcaagaaatcgccggtcaaagaagtcgcggtcggggttcttgcggctgccatctgggctccggatgttctcgatctgctggctcaggctcttagagggtggtgtccacaatggaggtcacaggtcacgaaccacattggnatcatcagcccggtagtagcggncaccatcgtgagccttctcttgaggtggctggggcaggaagctgaagtcgaaaccagcgctgggaggaccagggggaccaggaggtccaggagggccggggggaccaacaggaccagcatcaccagtgcgacacg

SEQ ID NO: 705957 - DNA, 446 bp, Homo sapiens
tttgctgtctctagagtatcccgcgtcggctgcggcacggagagatgtcaccgccgtaaggagggctcacggcagtgggctgctgtgctgtccttgcctgggggatgtgtagaggcccggtgaggtgcgcgagggccgaggcagtgcaggagatggagggagagcccccttggccaggttgtgcacccggtccaaggagctgtgcttggtgggcgaggcagttcttggtgagaccttggcagtgctccttgataggtgagaggacgacagagcgaggggcgcagctcgtatgccggctgcttgcgtgggctctggtgcgcgggacccccttctcaggcaggtagccgtggtacagggaggcacgccgggcccgggctgggcttcggtatgccactcggaaagccccagggccgttagtaggggtatttccaggcacgaaggccggg

SEQ ID NO: 705958 - DNA, 126 bp, Homo sapiens
cgataacatacaagcgatactatctgttctcacacctacagcctttaagtagcactatgtacacaaatcaaggtctagtagcatatacatttagcactttctattatatttacttatattccatta

SEQ ID NO: 705959 - DNA, 130 bp, Homo sapiens
actcggactaccccgatgcatacaccacatgagacatcctatcatctgtaggctcattcattctctaccaccagtaattattaatgatttcggatgatttgagaagccttcgcttcgaggcgaaaagtcc

SEQ ID NO: 705960 - DNA, 478 bp, Homo sapiens
tacaaccacatggccgatgttgacgtactgatagctcactacctatcagaatgtgactgtatctagaaacagggcattatcaagtagacaaattaatgtgaaatgaggtcatataggtcgactctaatccaacagtatctatataagaggagatttacaagacacatagcacacagggaacatcatgtgaagacatcaaaggaagatggctaatatggttcggctgtatccccacccgaatctcatcttgacttcccacatgttgtgggagggagtgggtgggaggttaattgaatcatgaaggcaagtctttcccgtgctgttctcatgatggtgatttaagtgtcacgagatctgatggttttacaaacaggagtctccctgcacaaactcttttttggcctgctgccatccatgtaagatgtgacttggtcctccttgccttccaccatgattgtgaggcttcctcacccacatg

SEQ ID NO: 705961 - DNA, 216 bp, Homo sapiens
  misc_feature (23)..(23): n is a, c, g, or t
  misc_feature (29)..(29): n is a, c, g, or t
  misc_feature (41)..(41): n is a, c, g, or t
  misc_feature (128)..(128): n is a, c, g, or t
  misc_feature (170)..(170): n is a, c, g, or t
tgatcgtgctcggtaccagattnactggnagcacaatctanctccatctgctaaccactaaaacactcaccaatgacctcaacccctgacccccatgcctcagggatactcctcaatagccatctacntgttcctggggttgatctctagagtctgacctgcattgcatngcaatgcttgtgcacttggcctgtctcgttttaccaactgtctgtc

SEQ ID NO: 705962 - DNA, 1296 bp, Homo sapiens
ggacacaaggtacccaatgcctgtttattcaccaatcaacaaagcaagaccacacactgggaaacatcattaaatcacgttgcctgcttcgcccttcagccttcctgccagtgacttgtcagctttccgtgcagcgccctcgccccaggcccagcgcattccttgcttaccagtcccttgccaggaaacctcgtgaccccccagcaagaccacagtcacgcgcttaatgcttgacccccccaaggcggtccattcgagacagccgcaaccaacccgttgtgcggcccgagggcgcaacggggcctccgagccctcccgtggagattccccaaaccaccattaatccaatcccgcacccatggggcaaaaggtccgaaggcgcccccattcccttaacgcgggacctccgaacggcgctttatccgaacgggcgccgaaggcccgccccaaaccgaagcaagcccaaagttcccgttccgcttggccaaacccatttctggaaggcaaactttaaaaccccccaaagattttccactttgggcggagcccccatatggccgcccattggcagacactttgggcagggaccacccagcccgattcccgaaaggggaccccaaaaaaagccccaggacacagccccgagaaagaccgcgcccgcccccaaacgggacccgaaaaaagagcgcgccgcactttaataaccgcaagataacacccgcgaacgcgagagctccggcccgaccccgcgccgtgaaacccgcggagcggcaccccaaaaagcccccaaaacgaaaccggaatcgacgcccccacccaaaaataccccagtgggggcacaaaaacgccctaaaaaccctttttttcccaacacccacccccatctcttttgtggatgccccacgcgtgttaccccagcccccgatttgggggcgcccacccccccccgaaggatgaaagacgagacccgattttgcacgtatgccgcccgttaatttccggacctccagtccgcgaaagtgcggtcccaaaaaagggcgcgcggggcagggaaggcggggcaacccccggccgttttcagcaaaccacccccgatctttttaaaaaagcgctatatacccccatgtatatacccccgaaaaagacccccaaaaaaaatacccccaacaactattacgggccccacacacaggcgccgcagaggagcggcgggacccccaaccaccccgcagaaaaaaaagaccgccccactccccccccccgaggagtgaagcaccagcggggcccacatcttgc

SEQ ID NO: 705963 - DNA, 104 bp, Homo sapiens
ctgtgaagtaccagggtcctcgggacttccagacactcgaaaactggatgctgcagacactgaacgaggagccagtgacaccagagccggaagtggacccccca

SEQ ID NO: 705964 - DNA, 169 bp, Homo sapiens
tcttcagatggtagtacctgtacatcagttggtatttttttcacttagtttttttttttaacaggtcataaaattcacccatttaaagtacaattcaggggtttttagtatatttacagagtggtacatctatcaccataatctaatttggcaaccgcatcaccggttg

SEQ ID NO: 705965 - DNA, 168 bp, Homo sapiens
tgaaaaagatcagacagactgtcatgtggtgcaagcggggtggcaggtgaatatgatccagaagtgaagaacatagaaaaaaaaataaaagtttgaaatcgtttgaagtttgtttgaaattgtatgtttatgaaaaatctttcaaacatcaatttcaaacaaacttca

SEQ ID NO: 705966 - DNA, 574 bp, Homo sapiens
  misc_feature (358)..(358): n is a, c, g, or t
ctcggtacccgtcagacgctgaactatgtgcacttcaaatattatgccagaaattttgtccaaatattcatgttcggtaaacagagacacatagttttcttgatttgaaactgttctgaggacttgagaaactagagaaaacaagaaaatagcagccccacaaatttaaaagctatcatctctaccattagcatataaccatccaaaaatctgtggaatgtttagatttactcatgaatgatgctcattcgtagaaatattttgaacaccagtagtgctatcaaggcccagtaatgttccaagataagattgttctctaggatctagcatctgttcaggtcgaactgggtgaactatntttgcaggttgaggagtaagagtatatttttccagaaaagctaaatccgctgctcgtggataatcagttgactgtggctgtggtgacagaatctcatgagaagatggtgggagtgtggtagtatgacgcactaggtcactcggagtgtcaggcatctgaactggaaccagagttactggaacacatagttcagcgtctgacgggtacgagcatata

SEQ ID NO: 705967 - DNA, 880 bp, Homo sapiens
  misc_feature (70)..(70): n is a, c, g, or t
  misc_feature (384)..(384): n is a, c, g, or t
  misc_feature (728)..(728): n is a, c, g, or t
  misc_feature (755)..(755): n is a, c, g, or t
tattcccctatcatataatgtttctaaacaacctcttatttccgtttgttagtatggatttcctttgatnttgttaccactatacgtattcatatattttacttcattcctcgctcatctacgctgtctacacgctaacacctattcttgacattccacactatcgatccacgcgcctcccgaccacacgactggaagaggcgactcgcgcgtctacgcccacatcatagcacttataccgtcatttgtcacgcacgaacgatacagagtggatctaagtgtgcatctaacgtcgagcgcgggcgggcgcgcttgctagcgtagtgagtacccgcggctggaggcgttcgctgtcgcgcgtccggacgcgcccgcgcctcatgntacacacagagtcccatctatcagatacgctgcgtatcggatcgccccacaagcataccataccaaaccgatgacatatgctacaaatatacagtatttgagtcgccgcttgtcgtggtacgcgtggacatgggacatgagatcacccccgcatcgtctctccgcccactcttctttccgtcagtgctccatctcactttcttatccctctcatccatcacgtcatcaagagcggtcccacctactgcacttgagcgatcttgtcatagccatcgcactacgtcgcgcgtacgacgcgtaaggagtatacgagcgtctcgcgcggcactacggctcgccatcanacaatgctcacgtatgtggatgtttantaccccaactctgcagactcccgaacacgcctagccgcactgctcgcactactttgagcgacagccagggaatcctctgcacgcatggccagcggcacagccacatcttaactactactagcgat

SEQ ID NO: 705968 - DNA, 294 bp, Homo sapiens
cctctgtttcgtgtgctccttgccaagggctcagtgagtgcacagaggatacagagctgctctgtgctgttgggctgagaagatgctgcccgtaagcctcagagcagagcattgtgctcgtgtgtagtgtgtaagtgtgcagctgtaacccatggcatcagctgggcacattgcagcatcagtgtttcttgtaccaagaggttgtatgcacgaccttccctccgttcccagagggacaaatagaggtagctgttggggaacgaataggggagaaataaagaatgggaagctgga

SEQ ID NO: 705969 - DNA, 847 bp, Homo sapiens
  misc_feature (658)..(658): n is a, c, g, or t
atccttggtcttaaaaaaaaatcgccaaatattaggccaaactttaaaaccatttttaactatccagtatatccaagagagatgcccacacattggtatttggtttgccagaatggtccattggtgattaccaaactggaccaataacccattcaggttgaaggttgattggaaaaccttaaacactatttccggtctcatgggccatacccaacctggaacgcggcctggatctcggtctggatctcgggaagcctaagcaggggtcggggcctgggttactaacttggactgggaagacacttaaaacctaatttccctttttttatttcttttttgggaatggacgcccggggtgacaacgaagccagaactccggtctccaaactaaactaaactaaaaactaaaacaactaaagcctgaatgactcacagaatggccgtcacacttttcctgaggttcctaggcctctatggcacgtggcaacctagcctcacaaacacttggacccaggcactggtaagagtcggcaccggccataaaggagctgagcccaagacgggacaggctggggccccgtagccaaagggtaccgcagacgggagacctaaagatgccggtgacaaagactctggcaacctaaagcctatccatggnaccacccagaaccgcggccccggctgacactggggatacccggcgagtccccaggaacccccttcatgccagggatcctcactgggccccccgtggcccggaaagcgaacccagacgggcgcaaagacccggctccgcgcgacagagcccaccgcggacccactggggggcccgaggaccccacagggg

SEQ ID NO: 705970 - DNA, 160 bp, Homo sapiens
cttgtgtatggagatagcagacatgggtgcgtgggctctcccgcaggcgctggtgatgatggagtatagcagacatgggtgcggggccctcccgcagtgtgctggtgatgatggagatagcaggcatgggtgcgtgggctctcccgcaggtgctggtgat

SEQ ID NO: 705971 - DNA, 1054 bp, Homo sapiens
aagcagtggtatcaacgcagagtggcattacggccggggggggtcaaaaaaaaaaaaaaaaaaaaaaaaaaaaaaatggggggcggcgggccgaaaatttaaaccctgtgggcggggcgggggcgccaagttaggggttagttgaaaccgtggccaataagcggggtccataagggaaatccgtcgcaattgcactaagggcgtgggggtttcccaccaaattaaaaaaacgcccggtgggaaaccgagggcggttcgtgcacacaatccaagggggagggtccggagggccacaatagcgggacttcaaccaaacaggggggtacaacgaagagcgaaattattaaaatttaacgccccgggcacgagggaagcacactggacaacagtgggtgggcaacaacaataaccaacaccgtcgtcctgaacgacagtggaaagcacccaacaagccaacaagcgggccaagatgcgaataccatgaagtggcgccacaggagacaatcacaacccacattggtcgagactcgggggatacaacaaatagtgaagcacaggagggaagacaaaggcagacacagcaaacagagtggcggtcaatgtggagccagcacagataagcacacaaaaggaggggtcacacctcaccaacaagagatggaaggcaaaacaacaaaaactggatcggcacgaaacccttgagacaaatcggcagggtccacggagtaaacaccaaccagatgagcagagttttgtgtaaacacgacagcagaatcgcgagatatgcactcccaaaggagaaacggtcgaaaagtataggagaacggtgaagggggcactaatacaaataacgacacagctaacggccaagcaaccgccaaaagctcaagcagaaagcaacaagggcaaacgctgaattcttcaggtcacggcgagaccgacgcacgtatgcaagaaaagagcaaggctcaacggatacgagactacaacgctactcgagaacacagaaaacggcaccgcatgagaataccaaaagcacatatagtatattatg

SEQ ID NO: 705972 - DNA, 442 bp, Homo sapiens
  misc_feature (11)..(11): n is a, c, g, or t
cccccaccagncctgcagctgcccactgagccagcccctctgcccaaggcccctccctggggcgatggcagccaagggggcaagtcacatggctgccagctggagcccaggcggccgatccacacaggagccctgtccgtgatgtcagcaccaccaaagcatcctcattaaccgccccctgggtgacgcagcccagcttttctgcgtgggatgggtgggggactcactgagacccaggtgttcgcaagaagccaggatggaaagtatgactcgctccttcccaaacatgggatggcttttccattgctaatatccgaggaatccggtgaagtagtggaaagaccgagaaggcgggagactggttctcaccctggcccatcctggctttagaccagaagcccagagcctcagtctccccttctgtccaccagaaaccacagcc

SEQ ID NO: 705973 - DNA, 204 bp, Homo sapiens
  misc_feature (94)..(94): n is a, c, g, or t
  misc_feature (104)..(104): n is a, c, g, or t
ctttcctagaaacatgaaataagcagggcaaaaattttatttaactcattgatgtggatgaactgtaagtccaaagacatgtgtatttaaaagntacacacagnggagaagaccatgtagagacagagtcagggactgatgtgatacagacacaagccaaggaggagtcaccagaagccaaaagaagcaaggaacaaaatttct

SEQ ID NO: 705974 - DNA, 121 bp, Homo sapiens
cacgaggatcatgctcacttctaaacacctgaaatatcaagacttagacattatcgctcctgactgggtgctgagtcacactcctgtaatcctagcacatttcaacagccaacgaacgcag

SEQ ID NO: 705975 - DNA, 206 bp, Homo sapiens
ctagaggttccgttcgacggaagcagatagtgaggtttagttgagccaataatgacgtgaagtcctgtgggaagcctgtggttacaaaaaatgttgagccgtagatgccgtcggaaatggtgaagggagactcgaagtactctgaggcttgtaggagggtaaaatagagacccagtaaaattgtaataagcagtgcttgaattatt

SEQ ID NO: 705976 - DNA, 272 bp, Homo sapiens
gaatctggcttcagttaagtctgggacggaacgagaataaggtggagtcgaccagcagcgccaacgaggacgatgcctggtggagaggatcctggatggctgagctggacgtggagcccaatgaccgagacctacgtggagtgctactgcaagcacaatgtacccagagcagccgggaaggttcgctaagctcttgctccctgcctgccggctctgcgctccatcggggctcaaatgcctggaacatctcttcttcttcaagctcatcgggc

SEQ ID NO: 705977 - DNA, 847 bp, Homo sapiens
ggatcttgcgcagggtcggtgtgggcgcaggctgagcgccggaatcgtgcgggtaggcgtctgcggctcggttgagggctcgggcgggttcctgtccttcttcttcgcggtgcagctcgggacttcggcctgacccagcccccatggttcagaagagctacagaaagatctagaagaggtaaagtgtgtggctggaaaaggctactaggaaaagagtacgtgatgcccttacagtgaaaaatccaagatttgagacagaaatcaagaacaagatgcaaagaaatcacagaagaaagcagaacttctgtgataatgaaaaaccagctgttgtggttgctcccattacaagggctatacggtgaaaatcagtaattatggatgggatcagtcagataagttgtgtgaaaatctacattaccttaactgagttcatcaaagttcccactgagaatgtgcaggtgcttttcacagagaggtcatttgatcttttggtaaagaatctaaatgggaagagttaatccatgatggtgaacaatctcttgaaacccatttctgtggaaggagtcaaaaaaaagtcacgactgatacagtcttatatgtgtgaagaagtggaaacacagtgtggatactgaccagttgaaaggggtgcaagaaaaggaggctctatggatgaaagatctatgaggatgggaaggtctaggaatttgaatgggcgtgtgaggcacataaaagtggggaagagacagcaggaagattgggataggtggaaggggagggaaaggtccagaagggggatatggagaaaaccaggaactgggtgaatacgttttgttgcttttctttgttc

SEQ ID NO: 705978 - DNA, 944 bp, Homo sapiens
cacatgccggctgatccgatgaccgtgttgtaagtgtctaagctagtcgcccgttggtgtatttctctccgggcaaatgtgtcctctcccgggtgtccctttctgtgtcgcccctctaggcctcgtctgcctgtgtgtcaacctggaaatggtatactctctgccgtgtcctccctttaatagtgcgctttgttcggtaatatccgaaagtattcggtgctcctcggctatgtcgtctcgtgtgccctccagaagggctgttgtcctggcgtctccatgccctgtttccatcagacgtgtgttaatctggttcatccttacactgtcctggtgcgtggttggcgattcatgattagcatgcaatgcgttgtcagcatgcggcgtggtcagttatacatcatgggtttatgcgcaacaatgttctccttgttgtcgtcaatgaaccaccgtgtttccgcccccgggcgacgcacggctcctccccctttttatagaggactgattctcaagagcaaggagctgtaagaaatttcgttttttagccgtcccgaggtgcctttgtggtgtcataggaggacaccaccctctcgcgtagggtgtttgaaggaacacccgccctcgcgggtgttgtttccataaccgcgctcagcccgcctgggcgacatatggggggttgttccattctcttgagcatacacagccggttctgctgtgggggcccctcccattaatcttataatgagggggagtgtacattcttatctcctcggtcttttgctccgcgcgactaaggcaagacacgtggtaggcgatagtgatgacaaaacgccctctctggctgtccgctaggaaaacaaaaagagtccgaacggcgtgaggttagtgcgagcccttcctggcgagcttcttaaaaaaacaacaaccttttttctttcaacaagaca

SEQ ID NO: 705979 - DNA, 478 bp, Homo sapiens
  misc_feature (17)..(17): n is a, c, g, or t
  misc_feature (43)..(44): n is a, c, g, or t
  misc_feature (66)..(66): n is a, c, g, or t
  misc_feature (92)..(92): n is a, c, g, or t
  misc_feature (112)..(112): n is a, c, g, or t
gccaggctcgccaggancccactggaaacgcccaccacggggnntccttgttacacatgttctttntttatccgatcaacctgtgcactttngatattttgatattatattngcttccttaattcctcgcgtagagacggtctcaggtgccgtggtctatgctcgtgggcctgcagctgttcgcctcatctcccaccgtgtttgtatggtgtcagcacgaggcagagctgtgtgctccatatcgtgtagctttagactcggagatgagtgctttgacccagcgaggagctcagcttaatgtattcacgctgtgggttacatgctttagaacattcggctttgcgggtcatgtgtgaaattactgattttaaatgccttgttcatttataaaatccggggatttcaaaatctgggggtttacataatggaactaacagtattcttacggattagtttcatggtaacaaggagaaaacct

SEQ ID NO: 705980 - DNA, 978 bp, Homo sapiens
  misc_feature (777)..(777): n is a, c, g, or t
  misc_feature (978)..(978): n is a, c, g, or t
gcttagtgtgctgtggcatttgatgtcattatagacatctgtcgaagtgatatatctgcatataagacattcaacctggtagtcggatagaagatttatatctcatatttgtcgtcatttggacatcgattcctatcctgggctaagtctccacctacatacgtggacctttacttgattgtcagggtacgtcagagatttgaactctcccttaaaaggaaggactacgaaatcataaggaggaacagtaggcgcggctacagattacctgtaatttggatcccgcactacgcttaaccctcgtggatctgtgccatccaatggattgttcttggaacatttgtaactgtgtgttatttaccggtgtagaatagtcatccttgagggtaattccttgggacgtgtcatagatacgtgaattgtctacttgacagactagggcgcattaggaagtaaaaaggtattctcccaaacatagagggatcccgcgtcaccctaatccaaggtcgacatatgcatctcctcgtctatgtacgcccgctcgtttagttggcgaagaacccagacacgtctagtcatactacgatatcatggtgtgactggacgaccgcagtttgcttccactaatcatgtgctttaactattatggtgccgtttgtttgataaaactaatatctacactcaggatgcggttgctctatatcaaaaagctaggaactttctctaccttgtagagtcctaacgcgccgtacctaagaacctgtctgatagacaagnattactcgcacagagcacacattttgtttgcaatgcgaaagcttctaggacacccttctttgcacttacacgggagtgatactttgtgcattacccaaccacacactcagagcatcgtactcccccttggtgaatgcaccaaaatctagccgttgggtttggtgacacttgagtgaccgcgggctttcttggttgtgccan

SEQ ID NO: 705981 - DNA, 181 bp, Homo sapiens
gataattactttacaagcagcactgatatgactagccatataatctaagttataaaatagcttaccccagagtagccttcatagatcccttatattttaatagcttatttcaaaataccatcactcacttcacattttttaagactgcatcctttgcattacatgaactgaaactgagcca

SEQ ID NO: 705982 - DNA, 339 bp, Homo sapiens
tcatcaggctgagagagatttgaatactcccatgagatggagtgcccgggggaagagagtgggctgcatatttgatgttatataggcaactagggcattccaaccttagggctttaaggagtcccagctgacttagggtggatatagcccaccagcacagcacagatgctgtacaaaagcatagccagactgcttctttgggcgggtcccggattcattcctcctcgctgtttgggacttcccaactggggcctccagccgcccccactggtgttctcctgctgacggtgatttcagttttttcttggctggagctccctgatggaggggcagggcatc

SEQ ID NO: 705983 - DNA, 172 bp, Homo sapiens
  misc_feature (23)..(23): n is a, c, g, or t
  misc_feature (129)..(129): n is a, c, g, or t
  misc_feature (164)..(165): n is a, c, g, or t
ccaaaatgagtgccagcgacccnaactcctccatcttcctcaccgacacggccaagcagatcaaaaccaaggtcaataagcatgcgttttctggagggagagacaccatcgaggagcacaggcagtttnggggcaactgtgatgtggacgtgtctttcatgtanntggcctt

SEQ ID NO: 705984 - DNA, 155 bp, Homo sapiens
  misc_feature (1)..(2): n is a, c, g, or t
nntgctgcaggcaggacctgtggcggctcgaagaccgtgacgggcgagagattgctgtgcgggtgcggggccggatcgaggccaataccggcgaattgctgtcggacgcggcgctgggcggtctcggcatcgcgctgcattcgtactggcatgtc

SEQ ID NO: 705985 - DNA, 303 bp, Homo sapiens
  misc_feature (38)..(38): n is a, c, g, or t
  misc_feature (105)..(105): n is a, c, g, or t
  misc_feature (126)..(126): n is a, c, g, or t
ggggtggaggaggcgggggaggcgggggggtagcgccnggtattgacgtggggggagaactttgggtgttggaaaccaggtgtccgggatcagagatcattgtcntacttacaggactcgacatangagcgacagccctatactccctttacatatttaccacagcacaagggggctcactcacccaccacattaacaacataaaaccctcattcacacgagaaaacaccctcatgttcatacacctatcccccattctcctcctatccctcaaccccgacatcattaccgggttttcctctt

SEQ ID NO: 705986 - DNA, 148 bp, Homo sapiens
  misc_feature (73)..(73): n is a, c, g, or t
  misc_feature (110)..(110): n is a, c, g, or t
ccacaaggcattctctactgctatgtgaaattttctctgcacctctgaacagagaaaacacctgcccctgtanatcctttttcccctcccctccctcccagtggacttcnataaattgtgtcttgttttttatttttaaaaaactgac

SEQ ID NO: 705987 - DNA, 389 bp, Homo sapiens
caactgacatagaggagggggaatcacctgaacccaggagatggaggttgcagtgagccgagatcacaccactgcactccagccaggcgacagtccaagacttgtctcaaaaaaaaaaaaaaaaaaagaagggcaaacccaacttccaaggggaatttcctttttctccccaggaattctaaatttttttgggcccccaacctcttcttctcgggctttctcacaggggggatgtgtccctcttcgtatcaaagcccagtccctctaattggggcttggggcccctctctatgtctctcaaaggctgggcccttggggtggcctctcatggtctctgggcctctaatggtcagtttccgggggttcctctaagagtcgccttggcgggc

SEQ ID NO: 705988 - DNA, 407 bp, Homo sapiens
cgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgttgacccttcccaaaggctttgccctgttgacttgcccctccttttcaccaatgttttttttgggcatgggagggcctttccctaacccagctgtccccagagccacagttcccctatttggaaaggggccggggtttataaaaactagggaatgacccgaagggggaacattattttcccggataatacccatt

SEQ ID NO: 705989 - DNA, 831 bp, Homo sapiens
  misc_feature (259)..(259): n is a, c, g, or t
  misc_feature (595)..(595): n is a, c, g, or t
tccataaaaaattttttggtttttctctttggggaaaaaaaaaatggggggaaacccccttctctttacccccccgagatggattgccacgctcccgtagaagaagtataaaagttctcccaacatataagagaggggatgctccccctcaggtgtgggttataatcatccgtccactattatataaaacacgttttgtgccccttttatcaccgagagaagtctccctctctactctcaaacaaaacacggtgcgccncacgccagcagaaagtctgtgtggagagagagaggagagccactaatagatcacgagagagtgtgtgcagagggggcggagacagctctccacaaaacaccagagactccacacataaattccgcgggggggatatatatctctctctcactctctctcagagagggcggagaccccagtgtgggccgcccagcgcggcgcacccagagaggagaccacccctgttgtggggcggcggacaaggagaaggaaggactcctcccccccagaggcggcggggaagaggcgccgcaaaccacaaaacaccacaggcgcgttgcctcgccgtggcggacnacaccagtcgtggtgcgcgcgcgtatcacacacgaggtgtgcgcccacaaagagccacccccacagagagaccttaccaccacgagcgccccccgcgagaggagtggggagaggaagcgcccttccagcggcgcgctcatcacacacaaaacacactcaacccgagggggggcggccatcccaaagaggagaaaagagaagacgcctctcaccccaggtggggcgtgcttcccact

SEQ ID NO: 705990 - DNA, 204 bp, Homo sapiens
  misc_feature (124)..(124): n is a, c, g, or t
gacccttatgagaactaccgccgcaacaagagctactccttcattgcccgcatgaaagcccgagatgagttttccacatttgggactcgaaaagaagagaaggaagactgaccacaggcttcanttcgcagtgtggagggcttgtcctgcatttgccctagaggaggtgctgcagatactactcgcagtgcccagatagcaaaa

SEQ ID NO: 705991 - DNA, 352 bp, Homo sapiens
aaaaggaattttgtttgtattttttatttacattttatatttttgtacatagtgttatggtcatgctatgtgtaattattctcgtatgtccaaaccagccttctgatcgttttctgtcctacttctgactttacttgttgtgtgaccatgttcattatatatctcatagtgtttaataatccttgtaataaaagcaaaattgtctactgttaaactaatcttattccgagcattctagtaacttttttgtgtatgtacttagctgtactataatgagttggtttgtatgatatggttaaaaaggtcaaagataaaaggtttcttttgtgttccttttttgtctattgagttg

SEQ ID NO: 705992 - DNA, 366 bp, Homo sapiens
agttgtcttaccggtgctagtactataatggtgatggatacctgtggtccaagaggtatggactattggaggggatcaaggcctggagcgcggatacaggaccgtgcgaaagatgagcaccacaatgatgcatgttgacaacacgacttcgcgcagattgtatgacgcactaatctattatagcacagatagggctgcatgctagcctgtgtgtacttatacctgagctaactgtacgacagtcagcttacatcggagtaacctttatcacggacatcggtgtgagaagcgattatcagaatgcatatgcacgactaggacagaatattgtgccatgctaccgtgactcttgatcctataggatcc

SEQ ID NO: 705993 - DNA, 742 bp, Homo sapiens
  misc_feature (12)..(12): n is a, c, g, or t
  misc_feature (69)..(69): n is a, c, g, or t
  misc_feature (76)..(76): n is a, c, g, or t
  misc_feature (115)..(115): n is a, c, g, or t
  misc_feature (132)..(132): n is a, c, g, or t
  misc_feature (141)..(141): n is a, c, g, or t
  misc_feature (150)..(150): n is a, c, g, or t
  misc_feature (192)..(195): n is a, c, g, or t
  misc_feature (207)..(208): n is a, c, g, or t
  misc_feature (294)..(295): n is a, c, g, or t
  misc_feature (309)..(309): n is a, c, g, or t
  misc_feature (317)..(317): n is a, c, g, or t
  misc_feature (328)..(329): n is a, c, g, or t
  misc_feature (379)..(379): n is a, c, g, or t
  misc_feature (401)..(401): n is a, c, g, or t
  misc_feature (412)..(412): n is a, c, g, or t
  misc_feature (426)..(426): n is a, c, g, or t
  misc_feature (441)..(441): n is a, c, g, or t
  misc_feature (456)..(456): n is a, c, g, or t
  misc_feature (463)..(463): n is a, c, g, or t
  misc_feature (466)..(466): n is a, c, g, or t
  misc_feature (474)..(474): n is a, c, g, or t
  misc_feature (482)..(482): n is a, c, g, or t
  misc_feature (498)..(498): n is a, c, g, or t
  misc_feature (502)..(502): n is a, c, g, or t
  misc_feature (510)..(510): n is a, c, g, or t
  misc_feature (519)..(519): n is a, c, g, or t
  misc_feature (534)..(534): n is a, c, g, or t
  misc_feature (561)..(561): n is a, c, g, or t
  misc_feature (587)..(587): n is a, c, g, or t
  misc_feature (652)..(652): n is a, c, g, or t
  misc_feature (659)..(659): n is a, c, g, or t
  misc_feature (676)..(676): n is a, c, g, or t
  misc_feature (694)..(694): n is a, c, g, or t
aaaaaccatcantctggacggatagttacaatccaaaaatagtataaaccttaacaaaccctctctganccaggtnatattcacatctccccccaagtcttgtcagttagaatanaatatactgaactagtnagcccagtntttctttanaataggcttgactttggaacatgaaccttggatagatttttnnnnatgggagggacnnacaggaaaaccattctatctatccacttaattagtactaattaacggaacaaagttattaaatagctctcagtgctaagtcaagcnnttattcagaggccnttttgttnttctgctgggnncggggtgagtactttaacaagcttcttatcctgaggtacattccagtagnttctgccatattctcaaattcnaatggcgtganttcagtagcaaatntgctcatgtgagggntagggctatgaattngaggggncgnggaaggantggggtgngcagggaagagcgtcnggcngcccccantgctgacgntacagtatggtacgncacttccattatcaagaagggcacctncagtgtgtaccggagccaactctgcnttttccttctgacaaagtgatgtcacctcagagtctggactggaggcatgttcagcttctgattnctttgtnaaaatctctggtacctnaggctcatccagcgtctncttttcagatgtctttccctccgggacagggaggtctagctcatttgg

SEQ ID NO: 705994 - DNA, 485 bp, Homo sapiens
acgtcgaacatctgatcgctcaataccgtcagtgacatattcagccggttattaaggcggatggcctacgagaaaaataaaagagtcggtatccaccatccgggtatcgtaggtatagcggtaatagctcttactggttagcgagatgtaataggcgctgtagatgttgaacagataggcgttggtgttattgacctgcgaaagctgcaggttgtcattatccagcagctgttccatcaggctgatcatcgacagcgcggcgattttttgccgaaccccgagctgtctggcgacctcatcgtccagatgttcgcggatgcgggtaattctttcgcgcgccgcccaatcggcgggcaaacattgcgctcgggtgatttgcggatcgatcaggctcatgcgtttgaggcggtgcgcctgcaagtgagcctgcacggcttcggagatatctttggcgcgctcacttttgtccagggggatccctccta

SEQ ID NO: 705995 - DNA, 424 bp, Homo sapiens
  misc_feature (1)..(1): n is a, c, g, or t
  misc_feature (12)..(12): n is a, c, g, or t
  misc_feature (32)..(32): n is a, c, g, or t
  misc_feature (41)..(41): n is a, c, g, or t
  misc_feature (90)..(91): n is a, c, g, or t
  misc_feature (103)..(103): n is a, c, g, or t
  misc_feature (107)..(107): n is a, c, g, or t
  misc_feature (144)..(144): n is a, c, g, or t
  misc_feature (242)..(242): n is a, c, g, or t
  misc_feature (245)..(245): n is a, c, g, or t
  misc_feature (277)..(277): n is a, c, g, or t
  misc_feature (281)..(282): n is a, c, g, or t
  misc_feature (293)..(293): n is a, c, g, or t
  misc_feature (331)..(332): n is a, c, g, or t
  misc_feature (343)..(344): n is a, c, g, or t
  misc_feature (350)..(350): n is a, c, g, or t
  misc_feature (371)..(371): n is a, c, g, or t
ncatgttgggantgagaaatgaccgggccccncagggctgncggtgtgctgtcagcctcccacaggtggtacagccgtgcacacccagtnncgtgtctgctgntgtnggaccgttgttaacacgtgacactgtgggtctgactntctcttctacacgtcctttcctgaagtgtcgagtccagtcctttgttgctgttgctgttgctgttgctgttgctgttggcatcttgctgctaaccctnagnctggtagcagatatgcacattggaagctcccncccnntattgttcttnaaagtggaggtctcccctgatccagagcaagtgggagnncccgtgggggnnaggggncctggagctgccagcaccaancgtgattcctgctgcctgtattctctattccaataaagcagagtttgacaccg

SEQ ID NO: 705996 - DNA, 887 bp, Homo sapiens
gtgggtcggacgcgtgggtcgatccacgcgtacggtatgaagtcttgctctgtcttggcccaggctggaggtacagatagtcggtagagtcgtcagctcgtctgcagagcctcgtacacgtacgcctgagttcaatgatgacttctgcttggtagatcaatggctctcctgtagtgagctacgtgattagcaggctacagtgcacagcaatacctgagcttattgtcgtgtcattgtatgcgttaggatggacgatgggtagctcgacttgtattgtgttgtgccgatgtgccttggcctggtgtcatcgcgcaacctaccatgggccatcggaacgttgtatcacacacaacgcgttagtagcttcaccgaaaagtagcttggtgattcccagggtgtagaagtccacccgttgtcctgagctcttgacgattttctctctattttgattactatagcacttgcgtaccacatcattgcttgctacacttgcgcttagatgattctggtgtttgactacttgatcatcttgatatagtggatcgacgttgggacattttaaagcaggtattttcggcaggtcttcgctggtgtgctgctgctagagtgctgtccctatcccaggacacgcaaatttcacactcgcgttcggcggccctgtcccctaaagcttctttaaactaaggggtggacatcccaactacttcttctgaagcccgggggtcctatttgtgcttgcacaccgtttggaagtcctattgtattggcgaccagcaccggcgtagtaatacatattcaaccttggggggacagcttggctactccttacaactaatttactctaacgtgtggagcatggttaaactaccgtgtacactctggacggc

SEQ ID NO: 705997 - DNA, 377 bp, Homo sapiens
  misc_feature (2)..(2): n is a, c, g, or t
anagcatggtcttgcaagtgtggcctggagaggagagaactgacagcttgttagaaatacagattctcagacttcgtcctgtaactactgaatcaggaattctggtggggaggggcccagatacctgttttgagacagagacttgctctgcactccagcctgagcaatggagtgagaccttatcttaaaaaaaaaaaaaaggccatttgttataacgaacttacaatgtgaggttcattaacaaagagttcagattgtccctcacctcctatgaggccttggcatgtgttctttcctattatatctcaggaactatgcagtattgaaccatgttgctaactcatagtgggttaaatacaaatcgttcttctgttcta

SEQ ID NO: 705998 - DNA, 1066 bp, Homo sapiens
aactccacgtctggttccaggtctctgtatctcgactgcaacgtgggtcaggacagggatcgatgatccgtcgcgtgcaactcattccagaactgccgcatggcgcacatacgaatattcctattctcggtggttgcctgacctcaggtgtaatgcatgttgttcgtcgtggacaatcatacgtgcatttatggtgaccatgagctcacacacagattgctggtgcgagtaagtctctcgtgtctgtagcagagcgaaacaatgtgatgtcttcaccgagtactgggtcgatcgaatgatatcaatacgattgctcgagaaggaacgttcagattgcatgagacacctgttcacccttttgctatgcctaggcatagtacttgccataacattcttcatcgcatgcatacgtgcatgaggactatcatctaagagaaacacagagaggactgttggcgacggttcgtgagtgaagacgacctctaaatggccggccgaaaatatgagcccgaagtgagaaagacctgctggtaggggcatgcagtatgtcgttctctcttgtaggtaatgacgaaaggatgcatgcgagtgggcgtgcacgcagtcattcggtatacccatgggtttagtcccaggagagaagggggtcatgaacagacattgtggttgcgtgcttaagattcacaaggcatggccgctctaggggctatagtttaggcaatcaggactctttgggaaaggagcatccctgcatggaccttcacacagtgcacgatattaggggaatgataccgaagagcacttgagaggaattcctaggacacgcggttactggcactcctgctattttttcctgtttggactggtgccgtggtgtaaacatgcccatatcacctacgtagtctagagaaaggcgcattgcatttttccttttaactgcatttggtgtgacctcttttgactcatgtggttctccaagtggattgagatgggacgggagaggaaatctgaatgggacgtaggtatcatcgactggaaaggggttacatctattggtgtggctata

SEQ ID NO: 705999 - DNA, 113 bp, Homo sapiens
cataccctgaccttctctgagtcctcctccggcttcagcaagagcatggtaataccaagcccgagaagacggagcgaggactcagagaaggtccgggagaaggtccaggtatg

SEQ ID NO: 706000 - DNA, 190 bp, Homo sapiens
tatcgctaggggagctcctgctggggatgggtctgctggagcccagagatgcccatggatgaagcgtgaagagcccaggagggtgagtgcgacatagagcgccacgatttgatcatgctttatccacttccagtgtgtgatgctattcgttcaccgatgtgtgccggttgacgttgtgatgatccgggtc

SEQ ID NO: 706001 - DNA, 227 bp, Homo sapiens
aacgttgtccatgagcacatcttgtatatgcaaaccaagccagtcctggagtatctacacccaacctccgttatcaaactttcacacaccaacccaaaatttcccctgccctaaaatcgtctcagggccaggtaccaggcaactagataccatccctataccctgaagccccctggaattatctaaactagcctccctaagcttgccaagtctgcaaggaacccacg

SEQ ID NO: 706002 - DNA, 248 bp, Homo sapiens
tgatttgaatctggggcagctgagattctgcatatttgtttctttttaatatttttttgtagagtcggggtctcgccatgtagcccaggctggtctcaaacttctgggctcaagcggtcctcctgcctcggcccctcaaagtgctgggattataggcatgagccacagtgcccggccggcatttttttttttttttttttggaaacagagcctcacggtgtcaccgggcggacgttgcaggggtgcat

SEQ ID NO: 706003 - DNA, 940 bp, Homo sapiens
tctcattaaactttttaaaggggtccaaaaatctctgggacaaattttgggtcaagtggtttccattaaaaagtatggattttaaaaaacttaatgggccaatggaaacaaccagtttctgaaaccgttctcccaccactggattaagagtggggtgggaggtataagggataatatccattaaagccttctgagctttttggggcagattggtttgaccttgccagctccagcagccttctggtccacggctttgatgacacccaccgaaactgttctgtctcatatcacgaacagaaagcgacccaagggtggatcagtctgagaagtctctcacacacttgggtttgccaggaacccatatcaacaagggcagcatcaccagactccacaagaattagggcgccatctctccagcttttcaccaagaagggggatacaatcttttccttaagctcacgcaaacttgcatgcacatgtagacgcccgtgtgggacacccaaatacaggcgatacgcgcggcgctaatatgcgctggatggtccagaataatccccttgacgcaggagaagccagctgctcccctggggggcattcttagctggccccgcatgtgtggccggaagaacttctttggacggacacttctctggctttgacgccccttggcccgggaagcgtcatgccgggttcggggcgatttcgcgccgatttactcccgttgtacggtggctgcgctaggtgcccctacgggttgggagcccgctcctcggccaggacgctccccattgactccggacagcgcgcggttctctggcaggtgtgtgtgcacgcccgcgtgcccgccgctccgactctctccgttgtctgcgtcgccccatgtcgtgtcgtggctgtgggtggttcgggagctgcgggggcgtctctctcatgtatttga

SEQ ID NO: 706004 - DNA, 145 bp, Homo sapiens
aggagtgtgcagattttcatggtaagtggactattagaatcaggtttaagttatgattgatcagaggattggaatcacttagcatagttttaagtacaagtgccccttttgtctcttttaatgaacagcttgacaaaaataaagt

SEQ ID NO: 706005 - DNA, 83 bp, Homo sapiens
cgagcggccgcccgggcaggtacaagctggacgagctgtttgagcaggagcgcaatgtgcgcacagccatgacaaaccgcgcg

SEQ ID NO: 706006 - DNA, 439 bp, Homo sapiens
agagaacagactgtccaacatggagaaactccctctttaataaataatctgcattacctccttcaactccagaaataatcgtcataaaatataactgtaatgcctagcagcttatgtccacgcgaacgtgattttataactgcttggctgtctactgacacttgtgcgaatagctccctctatagttgcctaaccaataaaaagcatgacaaacatgctgttgatatcttttactcacaaaactgctaaataaatgtcattagcaagataaaatcagcagtgcttaaaagcatgcaattaagaatacgtaagatcaaacaattcttcttcttcgatgaacacccacaaaaactgcaaggcaaggcagcatattcacaatagcaaaaagtggaagcaatctcaagtaccccacttgacaacacggaccagatcacccaac

SEQ ID NO: 706007 - DNA, 1097 bp, Homo sapiens
  misc_feature (438)..(438): n is a, c, g, or t
  misc_feature (953)..(953): n is a, c, g, or t
tcctcattggaagtgacatcgtctttaaaccctagtcgcgtggcagatccctgaacgcaccgccgtgatgcccagggcaagacagggcgacctggaagtccaacttacttccttaagatcactccaactagttggatgatatatccgaacagtgtattccttgtgtgtgatgcagacgaaattgtggcgacgtccataggcacggatgctagccaggagtcctgcactgtaccctgtcgactggtgacaggcatgtgagtgcctgcatgtgtgcatatgaaacacccaagtgtatcgcgcgaggcccataccggagggccgcacttgggaaaaaactagctccagactactgggagagagagcgtgcgtagccatcattatccggggggcacagtggtggggcctttgttgtctgccacccaaatgacgggaacactnctacatgcacgtactccaggaggcaacaagttggttcgtctggggacccgacattcaatgggtgccccaagtcgttgacattgcacaccggttgtcctcgggttgacccgactttggtctgcacaaatgattgcgaaagggttcaaccattgcttgtcaccaatacacacagaaaaaacaaccctgagtttccttccgagtgacactaccaccaatcaaaaatgtgaaccgtatccgcgtgatctatagtcagccagcgatgaccgtaatatagggcgtgtaaattcctaaccagctgttaaacacaatatcgttaccgcaagacggtgtggactaatcagcaattttatgtaaatacaactttccgttttggaatgcttgcacatggttggccaatggcgattgcacttcaaaacaggtaaccatgaggaataagctacaataacgtggtcgagcacgacccagcacgacggaaacaacaccagatcggacgattggacgttggacagcccaangtagacgttccaataaccaagttcagatactcccgacactattcacatcgcgcatttaggggtgcgcagtggagatcaaactaccgcaaggcacacagtgatggatccctcggaccatgacactttgttccattagtcaagtca

SEQ ID NO: 706008 - DNA, 987 bp, Homo sapiens
  misc_feature (383)..(383): n is a, c, g, or t
  misc_feature (444)..(444): n is a, c, g, or t
  misc_feature (615)..(615): n is a, c, g, or t
  misc_feature (660)..(660): n is a, c, g, or t
  misc_feature (690)..(690): n is a, c, g, or t
  misc_feature (766)..(766): n is a, c, g, or t
  misc_feature (856)..(856): n is a, c, g, or t
  misc_feature (887)..(887): n is a, c, g, or t
tggccgcatagtctcaccgctgtaggccaacgaggccaggtttttatttgtttatatcatgccttttactttaggcggaacgagttactggctctagctcaaggctgtcaccaacaggagctgcatggcatatatcttagtgcctagtgacgttgagtcctgcccatctgggacctgaataaccgtcattgcacggcctgaagcaagtatgtaatagaccctctgagacgctatgcagatacgattccactacgtgatggctcaaggatacttgccgtgagagctatttacgtgggatactcgtttgacctgttaggtagctcttgagtgtcttgcctgtcgtcggactgctgcatctgctgtgggatgcacatgtcgtgctnaagacggatggtaccactcgacattgtgcgagcaaagcgtggtcgggacgactagaactcncggagcgctcttgggcatatgggcgtggggtggttgacctcttggcacggatgctccgagattaaaacagactttctacgttgtttcttttatttattcacactgatcaagagatgcgaggtgtgagttgcagtgaagcctgggtgagaggtgtctaagatctcaccaacncaacctattaaggttatatacgattatcgggttgatgctacttgncagtatggggcttgtacgccgcgactgtcnttgtgcggggcagcgatctcttcagtagcatgctattcgatgacgttttatagtctgatggtagcgttttatatangatgggaggttattgatacaccgtacgtatttggaggcacagacagcgtcggttgggcagttgtcttgttccagttgcggacggttggantgatttgttggatggcgagtgtggttatatntgcaccgtactagcttatgtattgttgcggacgatagccgagtgcaagatgcctgaatgagatgcaagttctctttgtagaatctatactatttgactta

SEQ ID NO: 706009 - DNA, 202 bp, Homo sapiens
ctgaacagaatgcgcttctgttgatgagttcggaattatttgcgatcagcttcaactttcaaaattccgagcagcttgttcctgcttgaacaggagcttgctcctcgtcctgtcctatttgtatatcgagaatgaaacgtttcaacggcaaatttggatatttgcttgggagatttgatgtgggcttggcgcctgctacggg

SEQ ID NO: 706010 - DNA, 1723 bp, Homo sapiens
  misc_feature (589)..(589): n is a, c, g, or t
gtcatctaatggtcaaattaccaatctcacttggcgttaaccacaacttacatacgctcagggacatgacatgacactaggctttgcacagttacgtacatatgtctagagcttatgaaaacactttagtcacaagtgatcacgttctattgacaggcaaccttacctttatgctaatgacagagacgagaggcttcctactctttctctgcttgaatcctaataaattgtgagttgtcatcacttcttactcagtattttatactgactctcgtacacatttgacaactatattccaatacgtgtctgaatcacctacttttaacataaattactactatttagaacatctgtggtcacactgtttgctggtctagcaaatcctttttccacaaatattacagacggtgaagttgacctcaagttgtttctgatcggttacaaattttaaattagtgataatatgaattcaaacttaattatatttcaacgtgtaggtatgaatggtatgatccattcagagttttccccaaaatggttattaacatgccaaagcaagatagcctaaatcacaactattgtgggtccnccttcggggataaaaggtatattacatctgctcttcccagactaggcacttcaaccttaacaactttcacttcatcacgagacggcccaatagatctctcagcaggatgggtgctgggcgtccaccagggacaatggcggcgggcacacatatcaacggggaactgactcgtacggggtgatggcggccttcttctaagaagagccccttactaggccgctgcgcgccgggcagcaagcacagctgaggaagtaaaacaaaatgggccctcttcctgaggcacgtccgaccggtcgtgggcgactccacacacacaccactgcacaccagcaccacaacgacacaacaccacacacgccacaaaaccgaacgcacacaacgacacagccgaaggcggcgtgggagggacgggagagcggacgccagagacgagggaagggaggagggagaggaaggaagcaggaacggggagagcagcaggaggagaagaggacgagggcgcaagagagggcgaagcgggcgcgaggcgccagaggaggcagagggaaggaggagagagcgaggacgcaggcgcaagggggtgagagggacgaagcgagagagcacgacaggaagggaaggagcgcggagcagaggacgcgaaggggggaaggggagggcgggggggaggacaggagaagggcagcgcggagcgagggagaggcgacaagagcaggcgcgagcaggccgggggacggatgagggcgggaggacgaggcaagcggggcgaagaagggcggggagggcggcacgggccagcgggaggacgagggggagagaccggaagaagggagagcggagcggcggacgagcgaggggacaggagcgagacaggagagggccggaaagaaggggaaagagggaggaaagaagagaaggaagagagagagaagagcatacaaaggagggagagggaagaacaaagacggcgaagaggaacaggagagggccacgcgaaaagggagagagggcggacgaagaaacgcgcggacaagcaggagaggcgcggcagggaagagacgaggcgcgcagagggagcgcagaagagcgcacagcaggacagaagcgacgcgagacaccagcagagaccacgag

SEQ ID NO: 706011 - DNA, 112 bp, Homo sapiens
gagaatacgaacagcctggtggtgtcgggtgttggtggttagagttagttctcttgaacactgcactcggaagggtagagaataggtccctgtcccgaatatatttcctacc

SEQ ID NO: 706012 - DNA, 514 bp, Homo sapiens
  misc_feature (485)..(485): n is a, c, g, or t
gagctgatgctggggtgatctagaggatccctatgtggatggggatgataataagtctctataaggtactgtaacttcaatatttaactggtaacctaggttctgaacaatggtcttgcaaataaatggtcttaaggatggataatacacccatttggatcatttaagtaaagaaagcctagtcattcattcagtcaagaaaaaattttggaagtacccagttaccttactttgctagattaaaacaggcttagttactaaaaaggcagtcctcatctgtgaacaggatagtttcgtgagaagtataaaactcctttaggggccccagttaaaacacacataccctctcggcggctttcaaattccctagcaggggggccaatcaacatagtcactatgtggatggggaagaaaaaataccaggcaaatgcgaataacaaagcaggaaagaattactcggtgaatacccagcaaaatgacatgtnaagagcactgaataagatagagttgctat

SEQ ID NO: 706013 - DNA, 107 bp, Homo sapiens
ttattgagatagggtcttcctctattgcacaggctaaagtgcagttagccatggttaggccactgcactttagcctgtgcaatagaggaagacctatctcaataaaa

SEQ ID NO: 706014 - DNA, 235 bp, Homo sapiens
gtccatgatgaagatgcttttggacccaatgggaggcattgtgatgaccaatgatggcaatgcattcttcgagagattcaagtccagcatccagcggccaagtccagttctcgtgctcagccagaacacaaagcgtgaatccggaagaaaagttcattctggaaacatcattgctgccaagactattgcagatatcatccgacatgtttggcacacatcagtattattctcgcag

SEQ ID NO: 706015 - DNA, 124 bp, Homo sapiens
actctagagtgatcccccaggcgctagttggcgaggggcagagttcagcccacatctccgtctcgggcaatctccgcacgttcgtgtgtctccacgaagaagattcctgtagactcgtggcgcc

SEQ ID NO: 706016 - DNA, 858 bp, Homo sapiens
aggaataaccttctttcataagtgtacatcacccagcacctttttttctttctatcaggaaaacatgggttccaaatgatccttcggttgaccccccgtcgacccacataaataggttcctatcaagttactaccctggtaatgaacaccgctcgttttgttcttcaaacacaaacacacagcgatgtgttcgattcttctatacccaatagagaggcaacaacacaagcactcttccgcccgctacccggaagtaaataatcaccccccacacagggatggcggtttcttcctaaaacacataggaatatatctgtaccacaaaataagagtgacccacttcccacgggcaagtgtttttttcttaaacccacaccaaagtctggtatggccggacagatagagaagaaactattaaccccgggtttgccaaacccacgcctctcttatccaggcactcctcttccaccgcttctaaatcgggcgccctcgtgaataggatgtttcatctaccgccccatttagaaaacaagagtccactctttttccactcgtatctaaacaagacaaccccccacacgccttgatagatcacgcctctggcctctattacctccgtggagcaacttacacaagtatgttatcatttctttgttcgaaaaatagacagaccgcgagttcatgttaggccgcgcccacccgcgtggcgtgggcaccccagtcatgttgccacgcaccttcttcgggcggaggccacacagtcggcgtagtgattcactcttaaccgatgacggcgggttgtacggccccacccctcgccgcacctcaggtgtaacccccttcttcgccaacaaaaca

SEQ ID NO: 706017 - DNA, 371 bp, Homo sapiens
cacgttacaagttgaactgccttgatggtgcaagcttgaagtctcaccggagtcattgtagacgatggacacaagtcggtggccaaggtgtggctcttgtcgcagcggtgcttgtccacgtccttggtgtgcatcagggtggcgatgtggaagacggctttgcatgatgtcatcgtgccagcagtaggtgaacatggcgtcctcaacacacacgtccaggcctcccaggtacaccttgtccggctggcagtccttcagctcgatgagccggcccaggcccgtcaggaactccgtgtacctgtaggagccatgctcattggacaggatggcgagctcgctgttgctctggccttctcccgctgggtattccg

SEQ ID NO: 706018 - DNA, 190 bp, Homo sapiens
cgctctcgcggctcccgtgccactagtgctggctggcacttggtccatttgcagcctgttcatacacatgtcactgcttcaaccacccccccaaaaaaaaacaacaaccaacacaaccacaaacacccccccttttttttttttggggggggggggggggggggtggggacccaggggggccccgggggc

SEQ ID NO: 706019 - DNA, 130 bp, Homo sapiens
ctggtgattattaccataaacatgcatgttaaaataatgtaacacacatacaattatgtgctgtgattttaaaatctacttaattgtcatgatattaagatgtgttagtattttttttttttacttggcg

SEQ ID NO: 706020 - DNA, 302 bp, Homo sapiens
  misc_feature (33)..(33): n is a, c, g, or t
atggtgaagtgaccaatgactttgtcatgatgnacttctgtggttcctcctccccttcctcgggaggctcctcagcccatggcatgggatgggctgggatcttctctgtgaatccacccctggctaccccctccctggctaccccatcggcatttcaaggtcaggtgggccctcacatgaaggaaggtacaaccttcctggtggagcctgggacccatggcacaggccaggcagcccgaaggctgggtcgggcctcagttgggcattttgcctggcccccagcacaattataatgcaacgtg

SEQ ID NO: 706021 - DNA, 391 bp, Homo sapiens
  misc_feature (316)..(316): n is a, c, g, or t
  misc_feature (330)..(330): n is a, c, g, or t
  misc_feature (361)..(361): n is a, c, g, or t
cttttcttaaaaaccaagtcctctttgacacatgttcaaaggtcttccttttttttcttctcctgagctgctctttctcacctctggggcacttccctcctacacttggcccgcatgcgtggtttaggcaggcccactgttatttttgtggtaacctgacactgggcccagcgcagcccctggctcttgtgggaggtgaactggctgagagccaggctgcgttctcccaggatgagctgctgctgaagcaggctgggctgagggctgtgggcaggctgcagcaggggctggggatgccacagaccagggcgggctnggggttcaccagtnaagaccttcagactgtgcggctcagcaggtngcaggtcctgccttgaggtttaaagaaagg

SEQ ID NO: 706022 - DNA, 379 bp, Homo sapiens
ttttttttttttgagatggagtctcgctctgtctcttaggctggagtgcagtggcgccatctcagctcactgcaacctccacttcccgggttcaagcgattctcctgcctcagactcctgagtagctggcatcagaggcatgcaccaccgcgcccagctaatttttgtatttttagtagagatggggtttcaccacattgcccaggatgatcttgaacatgtgacctcaggtaatccggccacctcggcctcccaaagtgctgggattacgggcgtgagccaccacacttggcccggaacttggttttataaacagaggggccggcttggagctgctgtagacgcgcccgcgaatttagtagtagtagtaggcggccgc

SEQ ID NO: 706023 - DNA, 2235 bp, Homo sapiens
ggaaatattggaaaaaaaaattgcgtctgtactgaacatgtacagacttttttcttgtccttattccttacacaatatagtacaataactatttgcatgacatttacatcggatattatgagtgatctagagttgatatgaagtatatgggaggatgtgcaaaggtgatgtgcaaatactatgtcattttatatcagggacttgagtatcctttgttaccctcaggagatcctgaaaccagtcccccatggatactgagggctgactgtatagtcctatcctcacggaactttcattctaatgggggaagactgactataaacaaaatatatgtaataggtggtggtaagtaccgtggagaagtaacaaatggggcaaagtgagttatacagctccattcttagaaaccttggagtacttttcttagtttatactcgtggtggtttccttttgtctcctttattacatgggactctgacatgtgcccatagctagggtgacagtaggatctacccgatagtagggtggcagtaggatctacccaaaaagcgtcctgctgatacaggaccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcgtaactctgatggaattgaagtcatgaggcagcagagagcttaaattacagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattactatatagctactgcatgaagaagagttcttagtgaggcctgggtgaacagctcttcttagtattctgtgtgaccccatttgaccttttaacaaatccctaagtaaataaatagcccctcaggtaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatagaatttttcagattattaaaagctgaaggatgcccacgtaagcaaaaaaaaaaaagaaaaaaccaacaaaaataaacccaaacccctcaaacaatttcgaacacgaaacattcttctgatgccggcatccctgcttgcaggtgtgaagggggcaggaatcagcgaggtgtcctgggctgagtccccggagtgggaagaggtggcaggaaggggatctgaggaggagaacaggggtcctggtggtctgtgcttcttcccagacacgggagctgtagaggagacctctgcagcagatgctaggggggccactaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgcggggcctagaggcctgggatctgggggagccacccctgggggcgagtgtctgccctggtgctgtatctgccttcttttcacagcgggtgacccgaagagacagcctgaggtccgtcctcactcactgtgtttgaggaactgtgggccagctggcagtgggatgaggctggccccctcctccgctttagttcctggaggccttccgtagagctgtgggagctggagctggcatttcgtttgaggcaggatctggtccgggaggtctgggatctcgaaaaattcaacatttaggctgggcctcctctggctcacacctgtaatgccagcactttgggaggccaaggcgggcagataacttgaagccaggagttcgagaccagcctggctaacatagcaaaaccttg

SEQ ID NO: 706024 - DNA, 2094 bp, Homo sapiens
ggaaatattggaaaaaaaaattgcgtctgtactgaacatgtacagacttttttcttgtccttattccttacacaatatagtacaataactatttgcatgacatttacatcggatattatgagtgatctagagttgatatgaagtatatgggaggatgtgcaaaggtgatgtgcaaatactatgtcattttatatcagggacttgagtatcctttgttaccctcaggagatcctgaaaccagtcccccatggatactgagggctgactgtatagtcctatcctcacggaactttcattctaatgggggaagactgactataaacaaaatatatgtaataggtggtggtaagtaccgtggagaagtaacaaatggggcaaagtgagttatacagctccattcttagaaaccttggagtacttttcttagtttatactcgtggtggtttccttttgtctcctttattacatgggactctgacatgtgcccatagctagggtgacagtaggatctacccgatagtagggtggcagtaggatctacccaaaaagcgtcctgctgatacaggaccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcgtaactctgatggaattgaagtcatgaggcagcagagagcttaaattacagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattactatatagctactgcatgaagaagagttcttagtgaggcctgggtgaacagctcttcttagtattctgtgtgaccccatttgaccttttaacaaatccctaagtaaataaatagcccctcaggtaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatagaatttttcagattattaaaagctgaaggatgcccacgtaagcaaaaaaaaaaaagaaaaaaccaacaaaaataaacccaaacccctcaaacaatttcgaacacgaaacattcttctgatgccggcatccctgcttgcaggtgtgaagggggcaggaatcagcgaggtgtcctgggctgagtccccggagtgggaagaggtggcaggaaggggatctgaggaggagaacaggggtcctggtggtctgtgcttcttcccagacacgggagctgtagaggagacctctgcagcagatgctaggggggccactaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgcggggcctagaggcctgggatctgggggagccacccctgggggcgagtgtctgccctggtgctgtatctgccttcttttcacagcgggtgacccgaagagacagcctgaggtccgtcctcactcactgtgtttgaggaactgtgggccagctggcagtgggatgaggctggccccctcctccgctttagttcctggaggccttccgtagagctgtgggagctggagctggagctggcatttcgttgagatcaggcataaccgga

SEQ ID NO: 706025 - DNA, 735 bp, Homo sapiens
  misc_feature (475)..(475): n is a, c, g, or t
  misc_feature (497)..(497): n is a, c, g, or t
  misc_feature (505)..(505): n is a, c, g, or t
  misc_feature (515)..(515): n is a, c, g, or t
  misc_feature (520)..(520): n is a, c, g, or t
  misc_feature (538)..(538): n is a, c, g, or t
  misc_feature (552)..(552): n is a, c, g, or t
  misc_feature (568)..(568): n is a, c, g, or t
  misc_feature (572)..(572): n is a, c, g, or t
gagacaggccagatgcaatggacgatctcagctcattgtaacctccgcctcccaggttcaagcgattctcctgcctcagcctcccaagtagttgggattacaggcataccaccatgcccggctaattttgtatttttagtagagacaggctttcaccatgtcggccagactggtctcgaattcctaacctcaggcgattcacccactttggcctcccaaagtgccgggattacaggcatgagccaccatgtccagcccccagtgctgaaatatagaaaatggatggacaagtaaatcccactcagcacccatagtccaggcatggggacctcaacacacctgagccccagacatcacctttcattctggacctaccatgaaagacttctgaatccaggaagagagactgactgggaaacatgttattcagaaacaggaccttgccctgtcactcaggatggagttcagtggtccnattatggctcattgtagcctcnaactcccnggctcaagcngtccnaccatgtcagccttcccngtagctgggacacnggtaagcatcgtgacnctcngtgaattttgtttttatttttttgtagagatggggcctccagtatgttgccccggctgaccttgaactcctgcactcaagggattttcctgcctggcctccccaagtattggtattaccggcctgagcccttgtgcccccgtctctggttaggatgctgtcgg

SEQ ID NO: 706026 - DNA, 446 bp, Homo sapiens
gctctggcctcgcgtgttgctcttcggggactccatcacgcagttttctttccagcagggtggatggggctcgttgctggctgacagactagtcagaaagtgtgatgttctgaatcgtggattttcaggttataacaccagatgggccaagattatcctcccaagacttatcaggaaagggcctgggatggaaaacccagtggccgttacaatcttctttggtgccaatgactcttcactcaaagatgagaaccccaagcagcacgtccccttggatgagtacaagcggcaaacctgagggacatggtgcagtacctgaggtctgtggacgtccccagggagcgggtcatccttatcacgccacccccgctctgcgaaccgcctgggagaaggagtgcgtcctgaagggttgcaaattaaaccgcctgaactcagttgttggtgaa

SEQ ID NO: 706027 - DNA, 1545 bp, Homo sapiens
  misc_feature (1272)..(1272): n is a, c, g, or t
  misc_feature (1276)..(1276): n is a, c, g, or t
  misc_feature (1313)..(1313): n is a, c, g, or t
  misc_feature (1348)..(1348): n is a, c, g, or t
  misc_feature (1350)..(1350): n is a, c, g, or t
  misc_feature (1354)..(1354): n is a, c, g, or t
  misc_feature (1368)..(1368): n is a, c, g, or t
  misc_feature (1372)..(1372): n is a, c, g, or t
  misc_feature (1375)..(1375): n is a, c, g, or t
  misc_feature (1379)..(1379): n is a, c, g, or t
  misc_feature (1385)..(1385): n is a, c, g, or t
tgaggagggtatacaggcagggggatgagagtagggggctccgtccgttataagcagcggaaagcttcaaagggagctgtaggagctggagatggcatttcgtttggtgctcgagctcgtccaggatgtctgggatgtctggttatatctgatttctgagctctgggcatggaggtctgtctgcagaggcccgggcctgggcacaaagggagagaggcctccattgtcccgcaggggccaaaatgcagaccgtgcatccccggtgacctcggggaccgttctctgatcatcaggattttcttggactctggggtccttgtcctgctcaggcatccctgccccgctctccttgagggccctcaacactatcttccctggacacaagtctggggacagccgggtgttgtggaccccaaaggggtgactacctgctcctgggccccacagagtccttgtgctcagtgtagtggctgagctgggggatgccctggaactcggagcacacagcactggcttactgtggtacctgtgcagtgaaattgaagacagaatcaccaggatggaacacaggtcttgcaggatcacggaaaaccttcttagagttgtcttgacaccactgatgtcgagtgtgcgggtgtttgtaggatggcctgccactcagtccaggggcaggagcaacggggagatcccacaagcaaagtgaactgggggatgggctgaaggggctccaggcaactgagccctactcgcaggtcctcggccttggcccaaacaggaatgaggggcacagagtgcccgggtaaccgctcctgggagcagtggggaactgtcggatacttgaactctcaagagctgggctctgagcgtcctcgtccagctgccaacttggccaaaggctaagccagcagattgttctgttgccgggcaacgcgacttctaaacctgagggagtgggcatgtgagcacataatggcaccagtgacagagcgaccataatggatgaataagcgcagccaggtacccgcgcaaggcacctgctggcaatggcaggaggcggacgtggggggtcgtgcagtaggtactggagggagagacgtgggcacaaaggtcgcgggaggaacaggtgcccacaatggctgcatatttgcccgtggatcactgaagattcctgctctcctgctgaggtggagactgcagtgagctgagatcgcaccattgcactccagcctgggcaacgagtgcaaaactcagtctccagataaaaaaaagaanaaanaaaaaaaagaggccgggtgtggtggcttatgcctatnatcctagcactttgggaggtcggggtggacggatnangagntcaggagttggagnccanccnggcnaacatngtgaaaccccgtctctagtaaaaatacaaaatttagtcagacatggtgggcaggagagagcatgtgcaggggaacatccatttataaaaccatcagacctcatgagacttattcactaccatgagaacagcatgggggaaactggctccatgattcagtt

SEQ ID NO: 706028 - DNA, 925 bp, Homo sapiens
  misc_feature (451)..(451): n is a, c, g, or t
  misc_feature (489)..(489): n is a, c, g, or t
  misc_feature (565)..(565): n is a, c, g, or t
  misc_feature (665)..(665): n is a, c, g, or t
  misc_feature (687)..(687): n is a, c, g, or t
  misc_feature (695)..(695): n is a, c, g, or t
  misc_feature (705)..(705): n is a, c, g, or t
  misc_feature (710)..(710): n is a, c, g, or t
  misc_feature (728)..(728): n is a, c, g, or t
  misc_feature (742)..(742): n is a, c, g, or t
  misc_feature (758)..(758): n is a, c, g, or t
  misc_feature (762)..(762): n is a, c, g, or t
gagacaggccagatgcaatggacgatctcagctcattgtaacctccgcctcccaggttcaagcgattctcctgcctcagcctcccaagtagttgggattacaggcataccaccatgcccggctaattttgtatttttagtagagacaggctttcaccatgtcggccagactggtctcgaattcctaacctcaggcgattcacccactttggcctcccaaagtgccgggattacaggcatgagccaccatgtccagcccccagtgctgaaatatagaaaatggatggacaagtaaatcccactcagcacccatagtccaggcatggggacctcaacacacctgagccccagacatcacctttcattctggacctaccatgaaagacttctgaatccaggaagagagactgactgggaaacatgttattcagatggggtcttcttatgttgcncaggttggtctcaaattcctaggctcaagtgattccgnccacctctgcctcccaaagtgctgggattacgggcatgagccagcgcatctggccaccttattttctattactggntcaatgtaatggctccatctcaggaacagccaatgaaagagatgcacaggacaagaaacaggaccttgccctgtcactcaggatggagttcagtggtccnattatggctcattgtagcctcnaactcccnggctcaagcngtccnaccatgtcagccttcccngtagctgggacacnggtaagcatcgtgacnctcngtgaattttgtttttatttttttgtagagatggggcctccagtatgttgccccggctgaccttgaactcctgcactcaagggattttcctgcctggcctccccaagtattggtattaccggcctgagcccttgtgcccccgtctctggttaggatgctgtcgg

SEQ ID NO: 706029 - DNA, 946 bp, Homo sapiens
  misc_feature (48)..(48): n is a, c, g, or t
  misc_feature (78)..(79): n is a, c, g, or t
  misc_feature (85)..(85): n is a, c, g, or t
  misc_feature (92)..(93): n is a, c, g, or t
  misc_feature (96)..(96): n is a, c, g, or t
  misc_feature (105)..(105): n is a, c, g, or t
  misc_feature (108)..(108): n is a, c, g, or t
  misc_feature (110)..(110): n is a, c, g, or t
  misc_feature (131)..(131): n is a, c, g, or t
  misc_feature (146)..(146): n is a, c, g, or t
  misc_feature (191)..(191): n is a, c, g, or t
  misc_feature (252)..(252): n is a, c, g, or t
  misc_feature (276)..(277): n is a, c, g, or t
  misc_feature (279)..(279): n is a, c, g, or t
  misc_feature (339)..(339): n is a, c, g, or t
  misc_feature (725)..(725): n is a, c, g, or t
  misc_feature (729)..(729): n is a, c, g, or t
  misc_feature (746)..(747): n is a, c, g, or t
  misc_feature (752)..(752): n is a, c, g, or t
  misc_feature (755)..(755): n is a, c, g, or t
  misc_feature (758)..(759): n is a, c, g, or t
  misc_feature (764)..(764): n is a, c, g, or t
  misc_feature (768)..(768): n is a, c, g, or t
  misc_feature (773)..(773): n is a, c, g, or t
  misc_feature (775)..(775): n is a, c, g, or t
  misc_feature (788)..(789): n is a, c, g, or t
  misc_feature (794)..(795): n is a, c, g, or t
  misc_feature (799)..(799): n is a, c, g, or t
  misc_feature (805)..(805): n is a, c, g, or t
  misc_feature (831)..(831): n is a, c, g, or t
  misc_feature (834)..(834): n is a, c, g, or t
  misc_feature (851)..(851): n is a, c, g, or t
  misc_feature (866)..(866): n is a, c, g, or t
tgaccctgtcaacttgaaataatcgaaagaattagaacctagcttganagaagttatttaagctttgaaaagctgagnntatccntctgggnnacncagactccngananatgagctctttcctctcagcnggctccggctatggncgtgtgtctgagctccgcgcacagcctgggcgccggcgggaaggnctcagctccccgggtggctggttagaggctgagaagaagggggctccgcagaaagacagcnccgggggagtcctagaagaatccnncnagatagaacgcatgctgcttcatagcctccagaaatttgttcctacagattacgccagcnacactcaggagcattatgcggtttgcaggaacacggacgattgtcactccacggaatccactacgacgacgttacggagcggtggtgtggccaggggctatggctttgtgtcaatacttggaggaacatgccgaggaattgaatttccaagatgcaaaaatacttgaaattggtgccggaccaggccttgtttccattgtggccagtattttaggagctcaagtcacagcaacagatttgcctgatgtcctgggaaaccttcaatacaatcttttaaaaaacacactacaatgtacagcacatctgcctgaagtgaaagaactggtatgggggggaagacctggacaaaaactttcccaagtcagctttttactatgattacgtcntagnctcagatgtgggtctannatcantanttnntgganaagntgctnancaacatggtgtanntttannaganaggganggtgatgatttgggaaaaaaaattanggnttatgaaagaatatganttttagataattaangaagtgtttgaaaaaaaatgttggatgatataagagtataagtaaaatttttaagggatataaatgggataataaaaaaa

SEQ ID NO: 706030 - DNA, 923 bp, Homo sapiens
  misc_feature (285)..(285): n is a, c, g, or t
  misc_feature (418)..(418): n is a, c, g, or t
  misc_feature (486)..(486): n is a, c, g, or t
  misc_feature (890)..(890): n is a, c, g, or t
  misc_feature (907)..(907): n is a, c, g, or t
  misc_feature (915)..(915): n is a, c, g, or t
tacggctaggttgatggctggtcgtttaattcggacgagggaaactgggagcaagatgagaaggaggcccagacatgtgagtggcatggatggtgagagaagatgactgcagaaggatgagctgagcgagagagaaatgggttctggattggagtgggatgagcaatgggatgtggatggaatgtgctgtgtgatgatgagtgcgtgggtgcctctggtgatgtggttgaaagtgagtggatggagaatgggctgtgtggcacggaggtgcccgagcgagggacnagactccgactccagctctgactttttcgcggctctcggcttccactgcagccatgtcactcctcttgctggtggtctcagcccttcacatcctcattcttatactgcgttttcgtggccactttggacaagntcctggtggactctccctgggcaaagagtccctgaatctctggtacgactgcacgtggaaccaacgancaccgaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccacccggcctctgccagctttgcaccaggcgtggcggtgtttactggcgccttgatctatgccattcacgccgaggaggatcctggagaagcacccgcgagggggcagcttcggatactgcttcgccctggcctgggtggccttccccctcgccctggtcagcggcatcatttacatccacctacggaagcgggagtgagcgccccgcctcgctcggctgcccccgcccctttccggcccccctcgccgngcgtcctccaaaaaatnaaactttnacggcgga

SEQ ID NO: 706031 - DNA, 224 bp, Homo sapiens
atagtaaatctgcctgtatcacatatattaagggatatctctagtagctcatagtgttggatttaattctttgttactgagaacatctagtctatttacattttattttttatatttccaggtatatatcaactatattactatttgtatactacttctcagaactattttatgttgcttattttatcttttcttgtcttatttttgattaatcgagtatcaga

SEQ ID NO: 706032 - DNA, 202 bp, Homo sapiens
gttgagggccggctgagcacgctgatcagggggatttgaactacgccgaagagaacaccaggcgccacgaagaggacaatgataaggtgagagctgcgacggaggactgaggactcgaaatcctgcgcgacaggctggatgtagacttggatgggtgagaggacgagcggctgccatccggagaattggtcccggagaagtt

SEQ ID NO: 706033 - DNA, 557 bp, Homo sapiens
ggacggtgctgcgccgcggctcccagtgcccgagtgcccgcgggcccgcgagcggagtgggaccagccctaggcagaaccaggcgccggccggacgcccgggaagagccactcccgccacgtccatttcgcccctcgcgtcggagtccccgtggcagatctaaccatgagctaccctggctatcccccgcccccaggtggctacccaccagctgcaccaggtggtggtccctgtgggaggtgctgcctaccctcctccgaccagatgccaccatcgggctggatacgtgggcacctatgcggggcagttcaaccaggactatctctcgggaatggcggcaacatgtctgggaccatttggaggagccaacatgaccaacctgtaccctggggccccctggggctgaatacccaagacaggtgcccacctggctcgctttgggcaagcccccacatctgcccaacagcctgtccctccctaatggggatgtatcccacaccccaggaaggaaaccacaagcctccagaatgaccttcactatttggcaaataacacca

SEQ ID NO: 706034 - DNA, 640 bp, Homo sapiens
cctagtggctcccgcctgcaatcccagcactttgggaggccgaggcaggcagatcatgaggtcaggagatcaagaccatcctggcaaatacggtgaaactgcgtctccaccaaaaataacaaaaaaattagccgggccctgtggcaggcgcctgtagtcccagctactggggaggctgaggcaggagaatggcgtgaaccagggaggcagagcttgcagtgagccgagatcacgccactgcactccagcctgggcgacagagggagacctccgtctcaaaaaaaaaccaaaacaaaaacaccagctgggcgtgatggctcacgcctgtaatcctagcactttgggaggctgaggcggcagatctcgaggtcaggtgttcgagactagcctgcccaacacggtgaagccccatctctactaaagatacacacacaaaaaaagagcccggcgtggtgatgcatggcctgtaatcccagctactccggaagccgagccagaagaatcacttgaaaccaggaggcagaggccgcactgagccaagatctcgccatggcaatccagcctgggaaacagggcgagactccatctcacacaagaaaagcaacaccaaggaggctaacaaaatctacctgacgaatgc

SEQ ID NO: 706035 - DNA, 290 bp, Homo sapiens
accccaactctgacctcttccgttccagtttttaaatcctgagtcaagccaaaaaaaaaaaaaacccaaaccaaaccaaaaaaaccaattaaggccgggccaatctaattttgttttctgcgcaggttaggttttgtcaaaaaggggtgtaccgcacctaagtcatagcccgcctaaaagcatttgcgggggacaatggagggcccggcctcgccgaactcctgcttggggatccacatttgctgaaaggtggacagcgagcccaggatggacccgccgatccacaccga

SEQ ID NO: 706036 - DNA, 391 bp, Homo sapiens
gacttgcacaatagaaaggctgtatgtccagagaaagcaagcgagtatgtcggcgagttcagatcaaagggaggtgttcttgctgatgagatgggcctgggcaagacggtggaaggtacgtatacgtaccaaattgaactgatctgctgtgctcattgtttggcctttagttatcggacttattgctagcaatcccgcgccaaaagacttgcctgaattgcgcgatgattacgagcctaaattgtacaactcccgtgctactctcgtgacgtgcccgaatcacgtcgcgcaacaatggatcgatgagattgccaagtacagcgacaagaagatgaaaacggtccttctatcaacttccaatgacttacgcagcacatcttatcaagaagta

SEQ ID NO: 706037 - DNA, 113 bp, Homo sapiens
tcaatgagctcctccatttagcggagcatagtacggagcatagtagcgtagtaagcggagcatcagtaagcgagcatcagtaagggagttcagtaagcggagcaacacaaaca

SEQ ID NO: 706038 - DNA, 252 bp, Homo sapiens
atggaaacaaggatttcacgagcacgaatacctgaagagctcacccacttatttttggcactatagaaatgttggctccaagaatgtgactggcagagcttattctatgaacccaggtcacctgtctcatctgatgtcatcttctcaattttggtctataccctagtacagtagttcttaataactgaacccttgaatcccttaataagcccatcagaatcccttgagggtttattaaaacaccccatggtt

SEQ ID NO: 706039 - DNA, 887 bp, Homo sapiens
ttctcttgtctgcggcagagtccgcatccgggtgaggcccatctcagaattagcgctttgatggcatcaccgcgatccggaatccctggtgatggtgttctccaccgtcaagacctttgagccgcctgaactgactaactcctgcgcccctgatggtcacagctagcattggacagtgctgaacgatgtgcacaggacgtacattgatgctcatgcaagttccatctgcactgccagcctgggttacagacgggaaaccttgtctctaaacaaaagaagaaagaatgatagaacatgacaacatagtgacgattatgtacttacatgaaattaacagtcattcagagtttccaacattgtcaggggtgtcactcgggactctgtccaccgtactagtaggcctagcattgtcaccaatggaggccatggagcggagcctcggacccaaagctggggcctcttcattgtcgacacgaaggcctttttgtcgcagaccaggctctgtgtggctgctgtcatggctggtatggcatcctagggctggtggcgagtggtcacgtgatagccctttggcgcccatgatagggtagacagttctgctggaagaactcgatctggatactcagacatgagcgtggagcagaaatgcccattcggcaattgtctacaacggagaaagcctggagtcagttcgcttgacttagcgagggacaaacttccaggcctagtaaatcttctgtattggcccatgccatgtgcccagttcttcggccattataggcacaaagagccaaggaagctgtagaagacgacgctgaaactgcctataaaccgggggtagggccaacacctgtgctctattttggcgggggatctctctcggcccc

SEQ ID NO: 706040 - DNA, 693 bp, Homo sapiens
acaaaagtagaggtagggatgaggttgtcaaagagaatcgaggcgcttaatactatcagctgagacataccaatatgtctgtgcttgagaaatcagaaaagcagccactcacaatacaattaaggaatgggctttgctaacccttctgaggtaactagactgcagctaaccaccaccaacagccatgtcatcatctgatctctgcgtggatctacagagcaccgactgcagaccactgccgactttcatgaccggccctattgcagcctatggaagttaaagtgtcacgactgctctatgcatataggatttaggggaatttgcattgtaacataaatgtgtgaactacgtttcatgctagtgttctttcagtatttactctgcgaagatagcaaaaaagccaaaacctgcgagccagtggtcatttcaataatctttttatgtgcatgatactgagccttcataagggttgactacctcagatttgctggactcatagtggccttcatgtggagtcacaactgtgctggataagaagattacaactgattgaagtgtcgatgtgaaccgttgcaatcagcctctactggattcttatcagaaatcctgcgataacaagtcagccatctgggttctgatctgtgtgaaaagatgaagatttaagtgaccttcaattaacctgtcctgtgccta

SEQ ID NO: 706041 - DNA, 827 bp, Homo sapiens
  misc_feature (70)..(70): n is a, c, g, or t
  misc_feature (86)..(86): n is a, c, g, or t
  misc_feature (158)..(158): n is a, c, g, or t
  misc_feature (165)..(165): n is a, c, g, or t
  misc_feature (172)..(172): n is a, c, g, or t
  misc_feature (239)..(239): n is a, c, g, or t
  misc_feature (334)..(334): n is a, c, g, or t
  misc_feature (404)..(404): n is a, c, g, or t
  misc_feature (446)..(446): n is a, c, g, or t
  misc_feature (479)..(479): n is a, c, g, or t
  misc_feature (543)..(543): n is a, c, g, or t
  misc_feature (545)..(545): n is a, c, g, or t
  misc_feature (548)..(548): n is a, c, g, or t
ggggaccggcggttgtctgtggccggaggctgatcagtgttctagaacagatcagacattttcgtaatgnatgcctgaaataaacnactaaccacctcgacaagcaagcaggttcaactcctggcagagatgtgtatccttattgatgaaaagtgacnaataaanattggangctgagaccaagaagaatggtcacctgaacgagaacattgagaaaggattatggcatcgagcttatnagtgtcttcttattcaacaccgaaaataagcttctgctacagcaaagatcagatgctaagattacctttccaggttgtatttacgaatacgtgtngtagtcatccattaagcaatccagaccgagcttgaaggaacagtgacgcccttggagtgaggcgagcagncacagagacggctgaaagctgagctaggaattcccttggaangaggttccatccagaagaaattaattatttaancacgaattcactacaaagctcagtctgatggtatctggggtgaacatgaaccttgattacactntngtnggtgaggaagaattgtacctttgagatccatgatctcatagtgagattaaaatgctaattgttatgtgtcaaaggaagaactaaaagaacttctgaaaaaagcagcagtggtgaaattaagataaggccatggtttaaaattatttggcagcgacttttcttctttacatggtggggataacttacatcatttgaatcagtttgttgaccatgagaaaattttccgaatgtgatatgttggtaaatgattccgaaaaattaatctggttaaaaatttga

SEQ ID NO: 706042 - DNA, 372 bp, Homo sapiens
tcgcgagagttcagctcccttcttagccgtggctgcctcagcacctcgaggatcgacatggacgctctcgaggactacgtttgccgcgggcaacctcggagcttatactcctcccagtgacgggtctggagtgcgtgggggaccggctgttggcgggtgaggcttggcttgaggcacgcctggtggaaagggggaaagaaacagcgcctcccagggcggtgccacagggacaaaaggggtgccctgaggagaaggacgggcagcaggttgaggccgatcggaggtgggaagggagccccggagatggcggggacgagggccaacctgaagagcggggcccgagagacaaagctgatgtggcccgcggcgctt

SEQ ID NO: 706043 - DNA, 147 bp, Homo sapiens
acatgatggctccacctgccccgggcccacctgactatttttaatggtattttccttttatttgggggggaaacgggtctcatttggttccccaggttggtctcaaaacttcggggagcatttcatttttcagggattgtctttcta

SEQ ID NO: 706044 - DNA, 871 bp, Homo sapiens
gagaacaagggtggagacaaacagttgggaacacccaaccaatggccgccccccccgaaatgggggccctgccccgaaaaccctaagcactggcacgagacagtggtccacaccgaaaagccccacaggcaggagcggcacaaaaaaaagaggcagcaacaggagacgagggaaagcccgccgtacttgtctcgggctattatagcgccgttctgctcaagtactagcaaggcagcctatgaggatccgacaacgaggcgctacttaggttccggtaagaccgacgactatcgtccggtcccacccgagtggggcgccaagggacccgatgaggtcaccggtctgagagtcaaacgctcccgggggcgaaaaaacaaacgctgctgccctcgaacctccccaaaaatcgggggcagatcggggatggccccacgcaccgcggcgcgtaaaacggtcattggggcttagcgatgttacctgttgtttggcctaagaggacagcgcgcgtatttactgcgtggcgccacccagacgggggcaccccaacacctggggcaacacgaagagaggtccggccaccccgcccgcaaccccgggaggtcattgcgacccaccccccaccccgccgcgcgagaaacgcagtgcagaagtcctgattacaccactaaaggcacgagggggagacacaggcaccaatagctgaaaaaaaggggaataataaaacgcacggccatattaggaatagggacaaaagcagacattttgcatagtgaaacaggaagaaatcaaaacatggagcaagagtggagagtggtgttcatcaaaaattatacgaggggtcttacaattatgaaaagcgttaacaaaaaca

SEQ ID NO: 706045 - DNA, 280 bp, Homo sapiens
taccggacaagccatgcttatcctatcaatacctgatcgatgaaatgtcaacaggcgttggacagtgtcggtaccgtcctcaccggctggagaagcacactctctgcggcatatggccaaagccctggagcgatactgggccgggacggatcgtcagcgtctatggcccgacagagagcacaacattcgcgacgtactatccgctctgcgagctgcgcgacgaggatacctgccctccccatcggcttcccgatccagaacacccatccgcaatcttctt

SEQ ID NO: 706046 - DNA, 90 bp, Homo sapiens
gtggacacagccacatatttctgtgcacacagggggaataattactatgataatagtgcttatggggactttgactactggggccaggga

SEQ ID NO: 706047 - DNA, 904 bp, Homo sapiens
  misc_feature (1)..(1): n is a, c, g, or t
  misc_feature (25)..(25): n is a, c, g, or t
  misc_feature (31)..(31): n is a, c, g, or t
  misc_feature (36)..(36): n is a, c, g, or t
  misc_feature (242)..(243): n is a, c, g, or t
ntctgttgtaattcgtgggcaacanctgaanagatntatcaaaggatacagatgtaaagacatgtggaggatgatgcatggagacagctgtgcaaaacttccatgcccttcctgagtgcaccaccctccagagtcttccacatcttcaggcttccagaagctctggaacccattcctcttgagtttttatggaagctttgtgaaatcagcattacttctcccgggggtattgcctgggaccnnggctggagaaggccttacacaaatggacccaaatgtcagcttgaaataaagaaagccattggccttgtcatcctaagatcaggttttgaatccatcttggccatgtagctaccgtaatcctgaacaagttaaactaaaaacttcaattgttcatctgagcatggtggtgggcacctgtagtctcagctactcatgagtctgaggcaggagaatcactttgaccccacgaggtggagatttcattgagccaagatcactccactggactccagcctgtgacacaaagggggatctttgcagggccgtgagcatattatcaggcatactctattcttccctgaagggttggcctctctctgctggggacacctcttaatattaaaaaactgctcgatacggtccaaaccatttccgactccacactccaaataatctttttattgcaagttttttttttatacagcctctgaccttcctctgaagtttcagtagatttgttaagttgcttcccataatggtcttgcccgcctctccctcttaaggactgtctcatgttctgcctagtgtgattttatttccgtgcggtgtgggctatttgtacttggtcctctcctcttacttccttgtaacctctcaagcgtgttcttaactgggactcctt

SEQ ID NO: 706048 - DNA, 188 bp, Homo sapiens
ttgaggatcccggatggcgacatttcaatcaggtatcacgctgaagagaaagcctcctttactagctgcatctgagccctctttgaggtggacggcgaagaagccatcatttagtgagctcattgataccttggtcacatccaccagtggaacctctgacttgatttgtccagacttttggtccgcca

SEQ ID NO: 706049 - DNA, 566 bp, Homo sapiens
gcggcagataaggatatcgcctgagcaagaaaaaggcaggatgcagcgtgtgcatcacacaaagatcgagccaggaaacatggtgcgatgacgatcagtgccgagccgccacggtagccgcgacgggatcacggacatgccagcatcgacggagcacatcgacaacaagcgccgcgaccagcggcgagtcaggcgctcacgccgactcaggactggagaaagggaactggcagtgcacaggtcaactataccgtggcactcaggtgaagcaaagatatcggaaaagatgccagacgatcatgccaaaactgtgagatatccagagcggatatcgctcatcatatatcgtcgctggatctggaaccgggtccgttcgcagtaatcgccggatccggatagtcatgcatatgcgtgacaggtggatcgcatcaggcaggccgcgccgggtgtgagtgctgccgctcgctgtactgcagggccgtcgaataacgtcgacaatggccagtcaaccagcgtgcagcctcagcagcggcgcgagagtttcgaggatccgctagaggcgacct

SEQ ID NO: 706050 - DNA, 186 bp, Homo sapiens
tcagcagacaacacgctagcacggtgtgtttcggggtcctgcctgtgcatcttcccctgcctctacagcctgaccagagagagagcagttagctcggttaggctgcctttagctccaggcctcggttctagtgactatgcccttagcccttaagggccacctactctttatcagtagatagtagat

SEQ ID NO: 706051 - DNA, 93 bp, Homo sapiens
atggctgcctgcgacccccgccatggccgctacctgacggttgccgccgtgttcaaggggccgcatgttcattaaggaggttggttaggaaaa

SEQ ID NO: 706052 - DNA, 334 bp, Homo sapiens
tcgtgctctgtcgactagcacacctgtaccgacagctggtacgaggtccacactagtgcgctgcccctgggccgcgagaagggaggcaagctgactcctgaggaagaagagatctcaacatcgacacacatgacgatctaaaataattcacaagaaatatgatcacaggaaacatatcgccagattcagctctctcctgaagcagcagttccaccagggtcgagctccttgcgtgcatcgccttcagggccgcgacagtgtggccgagcacatcggtatttgctaaagggcaacagagttggagtgctatcttagtacaatcacggcccgctaa

SEQ ID NO: 706053 - DNA, 314 bp, Homo sapiens
tagatatctgacactcctattatgtgtagcactagtctactagtagctatgatttagaagcaaccttagtgtccatcgggatgaatggataagaaaatgtacctatacgcggccaggcacggtggcttgtgcctagcactttggaaagccgaggcgggtggatcacctgaggtcaggagttcgagaccagcctggccaagatagtgaaaccccgtctctagtaaaaatacaaaaattagccgggcttgtggtgtgggcctgtaatctcagccacccgggaggctgaggcaggagaatcgctggaacctgggagg

SEQ ID NO: 706054 - DNA, 222 bp, Homo sapiens
cacgaggcgttaaggcgcaaccgacggcctgggaggcctaaggcccaaatcccccgagagcctcacctcagtttcgtggacgagacgggtccttgtggagttcgagtcgaacccagaagaaacgagggaccccgggtctcctccgagtgtggaacgggctggtctggggtccccccaaaggccgccgaacacaagcccaggatcaccccgtccgcagcaggg

SEQ ID NO: 706055 - DNA, 831 bp, Homo sapiens
gcgtctaggtcgagccagacgtcggccagcgtctggcgcgcctcgtggcaacgggttcgaacggaccgatcaccgagaacatgccatctgcacatggagagcacggccattggacagacggcatgatggtttacgactgtatcgaagagaagtatcgacctgcgagcgaatagaacggcgtacgttaaacgaatacggaatggaaccgtagaatagatagccctcgatgggacaagaaggcaggttcaccatgagtagtttttctagtgaagacaactcgaaaagatacgacgccatcctgtgcccttgctgagaacaacaaataagtcgacaaggacccgtagaggagccaagttggctaagatgactggcgagaggagtggggacgttccaggtaggcgtatcattgtccgctagagttgcagggccatcatccaattgcagtgcgaagggacctaattttgctaggtacaccaatgcaatgcacgaaagggcgacagagaatgtaagggcaagacaaatgacgcaagtgtcggatccctcccgtgagtacagagtctatgtgccccaagacgggggttcgcctataaggcgaaatcatgccccacgaggcattgccccccgataggaaggagtttgcatgaaggcagtagtcaaggagcacgttagacaaatgttaaacaactacgaatctaaactgctcaattttgaccaagggcagaagaaataggaacacagttacaaatacgcagaataaagccttttgtgattctttctgctattgtctgggggagtcccccttgaccctcaattaaatacaagtgcttgttt

SEQ ID NO: 706056 - DNA, 105 bp, Homo sapiens
ggatacaggctaaacactgacccgctcggtttgagactagaagaagaaccatctccaactctgtgacccaattttcagtattcaaacgtgtgcctaaaatgtaga

SEQ ID NO: 706057 - DNA, 250 bp, Homo sapiens
acctcttcagcacaccctgcatgccggctacttcgtaagcgcaagtacccacgtaacagacgtcaggtcacggtgtagcccatgaggtggccagaaatgggctccatattctaccccggaaaactacgatagcccttataaaactaaagggtcgaaaggtggataacagcagtaaactgagagtcgagtgcttagaagaacagggccctgaagcgcgtacacaccgaccgtcaatacctcccctagcgat

SEQ ID NO: 706058 - DNA, 783 bp, Homo sapiens
ggtcacaagggtgcgaggaaagtcagtgagcaaatcgcggaccgccggggctgccagctcgcctgactcccggcctcttgcgctcctaggggcggagaagggtgcgggctcttcgccctttgtgtcctccttcttttcactcaacttgctggactttccagctcttccagaagttctgttcttgctgcaaagcccgaaaggctgggaaaaccggtccaggagagggaccaagctttggattcagagcctctggaggggaggggataaagggccatgaccaagggttcgcaaattttggagagaggtagtgggaaagattactcttgtctctgctgctcctgggaaagtgaatttgtgacaattggaaggttcgaaaggaagaagcattacacaatgcaaataggaacatctccacgggggtttgacagccacgttagatagaataaacatatcaacaaatgactctgctatgcacggaaaggggagcacccggagtcagtgtcgatatgacacataacgtacgatgtcaccgtggcaacattagtgagaagatataagtgatacagggagatgttctgaaggaaaggaaaaaagctttgtcatttagctctggtggagtctgaccaacaacggccatgaggaacacatttatagcacaggggaaggaaaaaaaaagactggggaaaattgagagcacagtagaatgacctaaagagaacaaccaatgaatatgcaggactagattgagtaaagcccttggtcttgtgagataatagcatgaga

SEQ ID NO: 706059 - DNA, 352 bp, Homo sapiens
ggcccacacggcgttccccgcgaacgccgctggagttttgcgccccacaatggcgccacttattcgcgagagaattcacccacaaaaccccactatgccctcatgtcattccccacccacttcaatagcgcacccactcacccctctcttaaccttctaactttctaacctatcgcctaaatttaactccaccctcacatcaccacctatctccccactattttaaccacaccgtataaaaataaaatgaccacgtttgaaccacaaccaaacccccccccttcctccccacactcatcgcccttacccccctactcctacctatttccccttttatactaataatcttata

SEQ ID NO: 706060 - DNA, 238 bp, Homo sapiens
cgagggcccttaaaatcccgcccaggaagcatctctaccctggagacaagaggcttggaaaggggccgggactccttagtagctgactcttaaggtcctttccctgacagagtggaccagaatcagagatagccctttaccctttgccagtggcagacgggcagagaggagcatccagaggccagactgccaacagaccagcgggagtgttcctaaaccaaggaaaatgcccggactt

SEQ ID NO: 706061 - DNA, 151 bp, Homo sapiens
ttatcaccctaattagttatgcaccgtgcatttcattaactattatgcttttaaatgtgttggccaccaatttcttagtgcttctgaattgtatatggtcctcaagcagcagttgtcaccttggtctttgaattaatgctgtgacgcttgc

SEQ ID NO: 706062 - DNA, 282 bp, Homo sapiens
  misc_feature (265)..(265): n is a, c, g, or t
  misc_feature (268)..(268): n is a, c, g, or t
taggtgcggaagtagctgtactgctgctccagtgagctggcaaaggaatctcagttattaaggcggtactaattacaagtgcctcccacagatagtccggttcaggggaatccttccccccgccgccccgccccaatttctacattttttactgataggaagcagaagactggtctcagatccaaaaagataagctctcctcccaacttcaaataccctcctttcatctggagcatggaaccccccccccaaagcaccaccctcnagnaacagtttaccttg

SEQ ID NO: 706063 - DNA, 267 bp, Homo sapiens
  misc_feature (212)..(212): n is a, c, g, or t
  misc_feature (247)..(247): n is a, c, g, or t
  misc_feature (266)..(266): n is a, c, g, or t
acagaggctgatgggaatgtaagttagttcagccactgtggaaagcagtttggagatttctcaaagaactccagccaatcccatcagggagtgtatatcaaaaagaaataaattattctaccaaaaagacacatgcactcatatgttcattgcagcactattcacaatagcaaagacttagaatcaacctaggtgtccatcaatggggtacntggatagaagtaaatatggtacatatacaccatgngaataccattgcagccggnt

SEQ ID NO: 706064 - DNA, 425 bp, Homo sapiens
agctcggtcccccccggtgttgcgctcagtgaacagtgttgtgtgagttgaggctggccggctgtggaaggttgtaggctcttcaccaccaactgaagttgtggtgctgcgagggaacactgtggtttcagttgagcctgggctgctgctgtaaacgggggtagattcctcactgaagcctggcgtggtggtgctggcaggtgacactgttgagtgagtagaacctggttggctacgggaggtggtggattcttcaccgacgcctaggcttgtcatgctggcaggtgaaagtgaagaggttggtgatctggcgctgctgtagaaggtggtagatgcctcactgaggcctggtgttgtggtactgccacgtaacgttgttatttcatttgagcctggactgatgtgtgaggttgtagattctccac

SEQ ID NO: 706065 - DNA, 815 bp, Homo sapiens
  misc_feature (148)..(148): n is a, c, g, or t
  misc_feature (176)..(176): n is a, c, g, or t
  misc_feature (259)..(259): n is a, c, g, or t
  misc_feature (334)..(334): n is a, c, g, or t
  misc_feature (381)..(381): n is a, c, g, or t
  misc_feature (390)..(391): n is a, c, g, or t
  misc_feature (462)..(462): n is a, c, g, or t
  misc_feature (472)..(472): n is a, c, g, or t
  misc_feature (508)..(508): n is a, c, g, or t
  misc_feature (510)..(511): n is a, c, g, or t
  misc_feature (593)..(593): n is a, c, g, or t
  misc_feature (623)..(623): n is a, c, g, or t
  misc_feature (698)..(698): n is a, c, g, or t
  misc_feature (765)..(765): n is a, c, g, or t
  misc_feature (793)..(793): n is a, c, g, or t
actttatcccacaggcatggggcgaccataaacctacaccaaactgttatcccggctgacaactctgtcctccactgattgaatgcacgccatctatacttattccacccacctggatcgcaaataaatctgcaactgactcacttgngaaatgtatacaaagcttatttctaggngggcgagggttaataaccacaaccacattatattcaccagcaagcttcaatgagggtgtagaggtgtttacaatctctcacgngccataacctttctgccttcatagacttcatttacagtttctgtctcaaagagtacccaacttaccccatcttcntatatacttagctggtccaatgtacgttattgatggagtcctcctancgatagggnntgccctctaagaacagccatttgacccatttacttgatttatacaaatagtacttcatcgttgctcggaantactggcggnctcctccacgcacgatctttgccaaaaacgaacttntnntaaaaactcctcttatcttggaaatacgcggccttaaccgctagcttctgtattaacaaaaggatatttgcctaaagccttntaataatcgttaaacatgcttcaggccttnaaaaatataaacactcttctgcaagctgatatttaaataattgcgcctttgtgcaagtggttaacaacccttctntattatttttgaaaaaaaggatagaaccttgaccggtgtggcctttcctactattccaggcgaattnccctgctttataaactgggaaaatctcnaaatagaaacacctgctctctc

SEQ ID NO: 706066 - DNA, 263 bp, Homo sapiens
ctggctgcaagatgactcccaccatgttggctttgctgctgtccaatggcagtaaccgaaggctgagagtatggagtatgtgggtgcagggtagcgtaagggtgcgcatactgctgagcaagggagcccgtggaaatggcaaagtagaaagaagggcttgtctccttgttgtatggaaatttgggacatgcatacatcacatggccactcaataccttctcataatactccttttattgaagtcctttttatgttaatatatc

SEQ ID NO: 706067 - DNA, 334 bp, Homo sapiens
  misc_feature (188)..(188): n is a, c, g, or t
taaggctacctaggatcctcgtacgagcgcggtggtgtgggaagaaaggcacaaggacaagacccaaaccatgcagatgaaaacatgctgtgcagcacagcaaagcggatgggcccagcaggaggcagggtcacctggggacaacagcacttggatcctgcaggagacatgggctggattccatcccncagctggtagctcctgggcagacatctctaccttacagatagggaaaggagcaacctacgaggtcggggcagggaggtcatattggaaaactcgcctggtgagcatagtgacattatacttccccagggtctacgcttttagaaac

SEQ ID NO: 706068 - DNA, 466 bp, Homo sapiens
gggggagggaagggagtgagtgatgctcaggggctgtccaagtgactgcgttcatcagttttacactggggctgctacctaatattttcctttgaacgaaggacttccaaaagcaccgggctagatgatctctgttccttttggctctaatatgctaccactgtaggcccattatcccttttcccatttagagttaggcccgattagtgaaattttactttagggccccccgctaataagtaataggccttaactgggtttccttattcccaatcctgtcttttcccccctattcccttagaccccccaaatggtagttttgtggggggggggggggtgtgtttttaatccccggaaccggatgcctttttttaaggcaaaatttttcccttatttactgtgatgacttcaaaaaaaaccatggtccccggggccaagtaaaaagcatttttaaaaattaatttta

SEQ ID NO: 706069 - DNA, 547 bp, Homo sapiens
  misc_feature (44)..(44): n is a, c, g, or t
  misc_feature (129)..(130): n is a, c, g, or t
  misc_feature (134)..(135): n is a, c, g, or t
  misc_feature (139)..(139): n is a, c, g, or t
  misc_feature (148)..(148): n is a, c, g, or t
  misc_feature (153)..(154): n is a, c, g, or t
  misc_feature (203)..(203): n is a, c, g, or t
  misc_feature (301)..(301): n is a, c, g, or t
  misc_feature (359)..(359): n is a, c, g, or t
  misc_feature (361)..(361): n is a, c, g, or t
  misc_feature (368)..(368): n is a, c, g, or t
  misc_feature (371)..(371): n is a, c, g, or t
  misc_feature (379)..(379): n is a, c, g, or t
  misc_feature (381)..(381): n is a, c, g, or t
  misc_feature (391)..(392): n is a, c, g, or t
  misc_feature (397)..(397): n is a, c, g, or t
  misc_feature (399)..(399): n is a, c, g, or t
  misc_feature (406)..(406): n is a, c, g, or t
  misc_feature (408)..(408): n is a, c, g, or t
  misc_feature (411)..(411): n is a, c, g, or t
  misc_feature (487)..(487): n is a, c, g, or t
  misc_feature (528)..(528): n is a, c, g, or t
ctactgtcattcataggcattctgttccacagcgggccagctancgtggtatttacaaagctccctcctcttatacaacaatccgagtgtttcttttgtgagtggtctgtgccccgggggatccctctnngccnntgcnttgccctcngcgtnngggggccagcacctcatagtcagtgagggcctggggtgcttaagagggntttcttccagctctcttgccctggtcttcagtgtattagatgtattacctccatgctctcagtagaggccccataggaagagtaggtaggttatgccngctcacacgcatcctttaaaaatgcgtttagaagtttagctggtttcttattactccngnctatggntgnttccttcngncactctaccnnggggngnaacagcnantcntgttcaatagttacatttagattggtttttaaaaactatgattgtattagttcgtttccatgctgctgataaaganatatctgagactggaaacaaaaagggtttaattggacttanagttccacatggctgggga

SEQ ID NO: 706070 - DNA, 116 bp, Homo sapiens
cgatccccacgaaacgtgctgtatccaagttgtcagcatccattactcttgtgcttctgaggccattattaattacaaataagcggctaactttgacacatgaacacatgtggata

SEQ ID NO: 706071 - DNA, 356 bp, Homo sapiens
  misc_feature (8)..(8): n is a, c, g, or t
  misc_feature (17)..(17): n is a, c, g, or t
  misc_feature (36)..(37): n is a, c, g, or t
  misc_feature (46)..(46): n is a, c, g, or t
  misc_feature (61)..(61): n is a, c, g, or t
  misc_feature (71)..(71): n is a, c, g, or t
  misc_feature (82)..(82): n is a, c, g, or t
  misc_feature (96)..(96): n is a, c, g, or t
  misc_feature (108)..(108): n is a, c, g, or t
  misc_feature (157)..(158): n is a, c, g, or t
  misc_feature (187)..(188): n is a, c, g, or t
  misc_feature (217)..(217): n is a, c, g, or t
  misc_feature (235)..(235): n is a, c, g, or t
  misc_feature (237)..(237): n is a, c, g, or t
  misc_feature (251)..(251): n is a, c, g, or t
  misc_feature (266)..(266): n is a, c, g, or t
  misc_feature (292)..(292): n is a, c, g, or t
  misc_feature (332)..(333): n is a, c, g, or t
  misc_feature (339)..(339): n is a, c, g, or t
  misc_feature (352)..(352): n is a, c, g, or t
  misc_feature (354)..(356): n is a, c, g, or t
tcaaggcnatctgtacngaagctggtctgatggccnnaagagacgnagaatgaaagtaacnaatgaagacntcgaaaaatcnaaagaaaatgttcnttataagaaacnggaaggcacccctgaggggctgtatctctaatgaaccatggctgtcatnnggaaaatggttgggagatttctcaatccnngaaagggatgaggttgggggagttgcccngaggaatccctgttcccncngatttttattagcnaaacatcctgtgtcntttggagtacgatgtgtaagtgcccnttgggtggcctgttggtcactgtgcagcagtctgcttccnnataaancgtgctcttcacnannn

SEQ ID NO: 706072 - DNA, 934 bp, Homo sapiens
  misc_feature (253)..(253): n is a, c, g, or t
  misc_feature (269)..(269): n is a, c, g, or t
  misc_feature (275)..(275): n is a, c, g, or t
  misc_feature (277)..(277): n is a, c, g, or t
  misc_feature (292)..(292): n is a, c, g, or t
  misc_feature (305)..(305): n is a, c, g, or t
  misc_feature (309)..(309): n is a, c, g, or t
  misc_feature (320)..(321): n is a, c, g, or t
  misc_feature (324)..(324): n is a, c, g, or t
  misc_feature (327)..(327): n is a, c, g, or t
  misc_feature (337)..(337): n is a, c, g, or t
  misc_feature (347)..(348): n is a, c, g, or t
  misc_feature (396)..(396): n is a, c, g, or t
  misc_feature (400)..(400): n is a, c, g, or t
  misc_feature (403)..(404): n is a, c, g, or t
  misc_feature (406)..(407): n is a, c, g, or t
  misc_feature (409)..(409): n is a, c, g, or t
  misc_feature (421)..(421): n is a, c, g, or t
  misc_feature (436)..(436): n is a, c, g, or t
  misc_feature (438)..(438): n is a, c, g, or t
ggtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgtttgcgggggcagggtctcttgtttcttttttttttttttttttttnagcctctaactagtcncatttncntcttaaaaaaggaanggtttcccagganaaancggtgtccaanntanggntgacgggaantgtgacctgnntggtgtcacgaggcccttcggggcggaaggcgcaatcgggggcgtggncctntgnncnngncccatgggcctngccttcacagttccngnggcacggttcccgggtcttggggccagtgtgtacctgggagtgacttcctttctcaacttccacggcaggggggtgtgccttcggctctgagaagctgccttgtgacccgtgtgatcgaacgccgggattgagggtccccgggacctggcctttccctccttccctcccccagaaagaggggttaggagccgggggtgcaagaagccgttcgagtgggggttggtctttgaaccacccataaggttgcttggttaggacggggaaggaggaaggaggacgactacaggaaccgggaagttcaaagtccccctagggggttaaatgagctctttttccaaaaacaaagaaaacaaccggggtctcatcggtggcgaacagggtagaatcgcattggcacgttccgaacacattttgaagggacatgggcccaaagggaatcgaccgtgcgtgtagcagacaaaagagcagtggagggcaattgaagacacatctaaa

SEQ ID NO: 706073 - DNA, 638 bp, Homo sapiens
gaatgccaatccgaaggcttcccaaatccgcccgcacatccactcggcctcttaaaaccccatagtaaaagaagagaaacgtaatacaaaagaactctaaccttccttaataccccaccctttatttacgctgttaagcttgaagataccagaaataaaagagtaagactacccatctcgatatatagatatatatatacatacgtatatatatatatatatatatatatatatatctatctacctatctctctcctcctaagcccgaaacgaccggaaacgaaagtgaacacgataatcgagtaggacgacaccgagagaaaagcctcccgactcttgtttacgccctccccgcctcgccggctttaatccctctctaaaaacgtaggtaattggcgggcgccgagacgatgctccggtgttaagagatcactaaaaacgcgaaactttaggtcgaaatgatgtcctaccttccctcccctagccccgcgtaatctcgaaacccccttaaaaccccctgccccgctagtgacttcctccttctctaacgcggaaaagaccccgaaacttaaaaagaaacatggaataaaaaagggtaccgctacttttgacgggggacctccctcccggggttgacc

SEQ ID NO: 706074 - DNA, 209 bp, Homo sapiens
tcgcgctgtctccatcgcgacgagtacaagccactggatctgtcctgattccacactgtcttacaccttgaaacggaggctaccaactccctcatcactgctccgggtgaattctcagacgccagcatgtctccggacgccaccaagccgagccactggtgcagcgtggcgtactgggagcaccggacgcgcgtgggccgcctctatgc

SEQ ID NO: 706075 - DNA, 115 bp, Homo sapiens
tcttccgctgagtagatgggtctctatgtggatcaggaaaacgtttatagttcagacagtttttagttcaggcggtttgcagttctggtatctcctcgtgcaaaacacagaggta

SEQ ID NO: 706076 - DNA, 405 bp, Homo sapiens
cacagccattgccatccattggatcccaccgacaggatgttggtcctaatgatttggactcacctcggagggatttgggctggccccagtccctggacaatgattcaaacaactgggcgcccccccaagggtttgttccctttaacgaggcctattttctcccccccccccaaaaccttttggggttttgcctagggcccgggggttctggcaacccaaaagagtttttcctttttttttgggggccaggtagttttggcccaaaccccggattttgaggttgccaccgtttttttgaagggggccctttgttcaaccccggaacccccgccttttggtttggttttaaaccccacctggagaaagttttttcccttttttccataaaagtccggccctttttga

SEQ ID NO: 706077 - DNA, 100 bp, Homo sapiens
taaaacagatgaaatgcacactgctctgatggaggcttgcatggatggccatgttgaagtagctaggttacttcttgacagcggtgcccaagtgaacatg

SEQ ID NO: 706078 - DNA, 226 bp, Homo sapiens
cgggaagtgggtggcggcacttgacgagcgggggccccctctgtacgtcccggcggcgcgggtgtgaggctgtgggcctcagcttggctgctgattcctgttgtctggtgccacgttgctggagtagccggagacgtggactgcgcgaggagtcctaggggctcgggatgcgaggctgcgccgcttgcctggtgggattggcagtgtcagcaagctccggatgacc

SEQ ID NO: 706079 - DNA, 252 bp, Homo sapiens
  misc_feature (27)..(27): n is a, c, g, or t
tccttcgtccctaattacaaaaaacanaccaccttcagatagagctcattccaagtttctctgttttatttctgtctttagcaatcgttggcctagctttgctgccataaatgagggaattgcggctaatagagcaatcgtgctcggaagcatcctcctcatccatctggtggacactaaccacagctataaccgggacaactagagacactgtccaagtcctctgtcaaattcacaacttagcttgccctt

SEQ ID NO: 706080 - DNA, 608 bp, Homo sapiens
tgtatctagtgtaaaacgcctggcagctaccggtctctgacttgaaaaccccttccgcgtccatgtcctattactagctataacaaattactacaaatatagtggcttaaaactgaaaacagatactgatcgagctcattaattattaaaaataaagggtaactaggtggaaatggggagtaggtataagtttaatgggtacagagtaacagtttgggaagacgacaacattctggagacggatggtggtgatggcagcacaacaatgaatgtacttaatgccactaaactatatatattttaaattgttaaaattgtatttctaatgctgcttattttaccacaatttaactatgattttatattatatatatatatttttttcagagagggttatgctctgtcatccaggctaaagtacagtgcagccttgacttcctgggctctagtgatcctacttgcctcagcctcttgagtagctcgtgtccatttttcaatatggtttcctttcctttctttgctagtgaggttcctcgtatattttctatattatcccctatactgatgtatagtttgcaaatagattttccattctgtaggtagtttct

SEQ ID NO: 706081 - DNA, 425 bp, Homo sapiens
gtggagacggggtctcaggtagatgactctggaagatcttctcttttggaactgcagcatcccttcgtcttccccaatgggactttagtccaggaaataccagatcctcacctctctaattctcttctcaaatcccaaggcaaaacaatggagacttaatgtggttctggtaattgggctctttgttcttctggagcttccgactgcataagcagtgaatcggtgattttgttctcagcatggagaaggcagaaaccagcagtagggctccacagcgcgggcctaggaaagacgctgttcaagaggctggacattggggcttgatgctggtcatcacagcattttgggaggccgaggggggcagatcgctagaggccagaagttcgagatcggactggccaacattgtgagaccccgtctccaca

SEQ ID NO: 706082 - DNA, 343 bp, Homo sapiens
  misc_feature (93)..(93): n is a, c, g, or t
  misc_feature (148)..(148): n is a, c, g, or t
  misc_feature (256)..(256): n is a, c, g, or t
  misc_feature (276)..(276): n is a, c, g, or t
  misc_feature (311)..(311): n is a, c, g, or t
  misc_feature (339)..(339): n is a, c, g, or t
caacctctgcctcctgggtttaagcggttctcctgcctcagcctcccgagtagctgggattacaggtgtgcaccatcatgccgagccaatttntgtatttttagtagagacaggatttccccatgttggccagactggtttcaaactnctgacctcaggtgatctacctgccttggcctcccaaagtgctgggattacaggtatgagccactgtgcccagcctcaagtcacccttgttagtttggcttaccaactntaaagtctttggatttgctnttgtcaagccactgggtttgcaagttcagatttgnctttcttggtttttcttagctaaattgntaag

SEQ ID NO: 706083 - DNA, 172 bp, Homo sapiens
  misc_feature (27)..(27): n is a, c, g, or t
  misc_feature (51)..(51): n is a, c, g, or t
  misc_feature (116)..(116): n is a, c, g, or t
  misc_feature (137)..(137): n is a, c, g, or t
ctgctagggagtcactgtacacacaanctctactggaattcctgccaacanctgtcaccctgcagctcctttacagttcaatccaatgagagaaaccatcccttccctttctcccntggctgttcacccagccattncctgaagggctgaccaacaggaatatccaaggaag

SEQ ID NO: 706084 - DNA, 566 bp, Homo sapiens
  misc_feature (8)..(8): n is a, c, g, or t
  misc_feature (12)..(12): n is a, c, g, or t
  misc_feature (37)..(37): n is a, c, g, or t
  misc_feature (146)..(146): n is a, c, g, or t
  misc_feature (169)..(170): n is a, c, g, or t
  misc_feature (172)..(172): n is a, c, g, or t
  misc_feature (176)..(176): n is a, c, g, or t
  misc_feature (181)..(181): n is a, c, g, or t
  misc_feature (214)..(214): n is a, c, g, or t
  misc_feature (217)..(218): n is a, c, g, or t
  misc_feature (258)..(258): n is a, c, g, or t
  misc_feature (325)..(325): n is a, c, g, or t
  misc_feature (353)..(353): n is a, c, g, or t
  misc_feature (385)..(386): n is a, c, g, or t
atcccagnagancagcctgcacatcgcgactcacgcncaccttcatgcagctgaaagtgatgaatcttaccttctggaaatcagacttttacacctgcatgtgtgactagtgccgacgtgtttcttgtccctctgtatactgagtntttactcatcagctgccggtgtnntngtcngtcanttataccatgagtgtgccactttcattgcaccntgnntccccacacaatccaagccagtgcaatatttagctgctancaagactggctcttttaccagtatcaatgacaatttatggggggtaggcgtgggcaactttcttttntgtttttcttcaatctgcaccctcttgncccaccatcacgaaaggcagacgttacgcttnntcttgaaggaaccattagatatggaaaatagtcatgaaccagagttttttggttgctttttcaaaaatttgtttttatttggttctgttcctgataaacagagtaactgaccttcatttctaggttcttcaagaatggtgtttgcaagtgccagatggaacaataaaagacgttgcctat

SEQ ID NO: 706085 - DNA, 924 bp, Homo sapiens
  misc_feature (485)..(485): n is a, c, g, or t
ggacaagaatatataaacaatattcatttaactcattcacctgaggcaggagaatcgcttgaacccaggaggcggaggttgtggtgagcgaagatcgtgccattgcactccagcctgggcaacaagagcaaaactctgtctcaaaaaaaaaaaaggatataattcacaataaattaattgggtcaattacaattgttagccaggcgttgggggcacattgcccgtagtcgcagctactctggaggcagaggcaaggaggatcacttggagcccattgaatttggaggcagcagtgagctatgattggtgccacttgtactccagttctggggtgacagagtgagaccccaattctctaaataaattgggtcaaaacccttaaaaattattaactttcttaaaaattggaaaggatatattctctctcaaatttaagtggagctttctaggagaagcaatgggttttttcccacttcaataatcantttcccagtgggactcatacaggttaacacagtgtgaattttcttcctcagccataacagagtattagaatgccagggctgaagtgaccttagagagtaccccagtccttcattttacgcgtggaggcactgagactcaagggtggtgtacttggtgccaaagattatacgctaattaagtaagcagaagacctgatggacatagtgtgaaggtgaaacttcacaagctaccttcttggaggtccaatgtttgtttccactaactcttacatgtcctacttcctactttaatggctgtactatataatgggacatccaggttttgccgcccatgtgggtgggctgttcccaggatggaccggaaaaacacgaaaaaaaaaaagggggcgaaaaatgggggaaggttcgcttgtcaccgctggctccgaccttcccggca

SEQ ID NO: 706086 - DNA, 353 bp, Homo sapiens
tgtgtagcccggcataccagaaacaaagaaatttaagccccctgtccggtagggataggacctgtgcgccacccacttagaatttgatcaataatagattctattgagactagtgagatctatatatctgtgatggaaagagctctctcaagtgctgttcagtagagctttattcataaggcatgagcggtggtgttccttgggacacgccccatccatagggcatcgccaatgtaggttggtatggccggccaaggccatatccagagattctggcggtattccctcagccctgtgtcttctaaaggtggcctcaagaatcccctttgtgtgccccgcccctaagacattcc

SEQ ID NO: 706087 - DNA, 777 bp, Homo sapiens
tgagacggagtctcgctctgatacgcccaggctgggagtgcacgtgggcgcgatctcggctcactgcaagctccgcctctcgggttacacgccattctccgtgacctccagcctcccaagtagctcggactacaggcgtccaccaccaggccgggctaatatttggttatcgtgaagtaaaagacgggggtttacaccggtgtaagccaggagggtctcgatctcctaaccgggggatccgcccgccatcggcactcccaaagaataggggataacccgcgtagagccaccagagcccggagagcaaataagaaatatcataatagaacacatcttactacacgtgcagaacagaagatactcgagtccgagaaggccacacggacgagaaaaaagaagggagggagacagaaactacgagacaaaacagagaaagaagcacgcacgccacaccgcgaataaatcggaccagaaactaccgagacaaccaaataccccgacaataccagggaaaaccatcacaacgagggggcgcccagcgcaggcacaacgaccaccgagaatacacagaacacggaatggcatcacaacaagagcaaaaaaaaaaaacgagggcaagaacaaacccagaaggcataagaccaaaggaatggggataccacgaaaaaacgacagttgcaacaaggagcgtagacatcaggccacgacacaacggaacacaccccaaaagcaggcggggggactaacaagggatggagaacgcacaccagacacccg

SEQ ID NO: 706088 - DNA, 825 bp, Homo sapiens
tataactggaaacacaaacgcttatattataagggagcatctcagttacgtgggggggacaaaaaaaaggagcagacgggtgacagaccattcccatcggccaaggggtcgaacccgacttccaagacccagggagcagccaagctcagcgcaacctcggggcttctcgctctgactccaaaggggtgagcacgtcgccctcgcgcagggggcctttaacatggcggatgatggatcggctcgtgtcgtccatgaattccagcgcgcacctgggtgcactggtccctgaaaaccgggtcctgcccaggacctgtggtgaccctggccagtttgataggctgcacacggctggtgtccatgatggggggcggcggcggccgggctgagaggagcgtggtgtctcctctctccgccaggggggtgtgctcgcccattgatatcggtgtactccgaaaggggggagtcatctgggcaaaaatgtcacttggcctggcggtattcaaggtcctattcgaccagatgtggtgacctttgggtcacacccatattgcgcaaaaacaacagaccagccctatgctggtcgagtgaattaggcagcgtcatcagacatagtggccggagtcttggggggaactggcagaagctgggggtcgaaattcccagagttcgaaggggggggggccccaccgtcttgggccagggtggtgttctggcaaccatgtggtcgtggggggccgattgttgtgcgccaacccaaaacttggtgccggtggctttcgtgagtggtaaaccaacacaaacaagaatagccctctgttttggccg

SEQ ID NO: 706089 - DNA, 174 bp, Homo sapiens
atttgattaaacactacaatacagtatatatccattagttttattttgattaaacactacaatacagtatatatccattaaaaaagaaaactctataatgtatataaattattgtagtgtttaatcaaaataaaactatttgaccttatggaggaaggtcatgtttttaccacc

SEQ ID NO: 706090 - DNA, 169 bp, Homo sapiens
agtgtggtcgcggcgaggctacatgatccaagcgtagtcttatgtttcttttatccaacaatatctaggcatctgagcactttgaaccaaaatctcaattgtatactgtgatttttatcttgttgcaatatgttaaatttcataggtacctgcccgggcggacgctcga

SEQ ID NO: 706091 - DNA, 329 bp, Homo sapiens
  misc_feature (1)..(1): n is a, c, g, or t
  misc_feature (63)..(63): n is a, c, g, or t
naaatgaggcaaggtttccctcagtccccccgggtggggggcagggttatgttttcaggttantgcaccctttgcctcctggggtcgggcaatttttaatgcctcagtttccccaggagggggaattacagggggccaccccccctccccggtaatttggatattttttctaaaaacgatttccctgggttgtcccggggggttttgaactcccacccccaagtgatcccccccccttggccccccaaaggggtaggattacaggcatgggcccccccccccccccctggatggctattttttaaaaaaatttcctttgggggccctga

SEQ ID NO: 706092 - DNA, 173 bp, Homo sapiens
  misc_feature (85)..(86): n is a, c, g, or t
  misc_feature (94)..(94): n is a, c, g, or t
  misc_feature (96)..(96): n is a, c, g, or t
  misc_feature (145)..(145): n is a, c, g, or t
ttaggatagcaatgtgtgatcatcacttggaggcatggggtggtcccctatggtgatgtgaacgtgagtacaatccagtcacctnngcctacanangtttggggtgtgtacctggaagtggcatcgccatgttaatatggtaatnctgttttaaactttccccgggaacccgc

SEQ ID NO: 706093 - DNA, 381 bp, Homo sapiens
  misc_feature (145)..(145): n is a, c, g, or t
ctaaaaaatttggtggtgtcccaaaattctttcccggggtgggcaggggggcgggcccccaggccccttggccctttttttaccccaaaaaaagcaaaacctggggccgggccggccccgaaattcttttgggaccccaaggggnttccccccccccccccccccggggtttttttggggggggggccgttttttcctggcttccccctggccccctcctggcctttgggaaagggaaactccccccgtttttatcccccccgggggtccccccccccccccccccgaaaggaaaatttggggccctttttttttaatttgggcccccggggggtttttttacccggggggtttttttggggaaaaaaaatttctttttta

SEQ ID NO: 706094 - DNA, 1074 bp, Homo sapiens
gcgggaatgcgtgtatctacttaatcactggttcttctcgccaccgtgattctgtctgactattcgcctactacagtaacccctagaggctgcttctcctttgcatcctcctactgcacacaaggctcctcacaacgtatcatatcacacatctcatctgctcgtgtcagagccacttgtagaataaacgtggattacggttatacacaggttcgcctgtggtttcgatcatgaatatattccaggggatattcatgtcgtctatcgagtgcttcgacattccactatcgccattaaataggcaactagagtcgcgtctggttcctactcgtagtcgcaggaccacatagttctgtagatcacttgaagaatcctttctttcacttactggcagtctcgtgttgctcgtgggcctacttttgctccactgttgggaccactggcttggaactcaatgtagctagattgggttacgccagtgttttccccattgcttgccactttgcgcaacctaatttgcacggttgagtttgtgcactgatccagacaccattggttgtggtgtttcttgccgaccagacagcttggaacatggcacaggaggcaataggacatcactttggtgcggaactggtcccactgaagaacgtcgtcttgtaatgcgaagcgtcctccccagcaatagtgggtccacacgggaacccccatcccaaggggaccatgagtgctacccctaattgtggcacttgtcaccttgttgtgactcaaacgcgtcggaatttaaaaggcttctcgccccttgcgtccggaatttacaattcgctttaagaccctaagctcaacgaatacattcccccatatccttgcgttaggacagttccagcagatcggaaaggcgaggtctcctctgtcaccattccccgagtataatagccctacagctataagataaattctcgttagcgcacaattcgttagttggtgtggcctgcctcgcgatcctatagcaaaggatctcccccccgttgtgatggggtgcataacccactttggttttctccggcgcatttggtg

SEQ ID NO: 706095 - DNA, 478 bp, Homo sapiens
  misc_feature (268)..(268): n is a, c, g, or t
  misc_feature (273)..(273): n is a, c, g, or t
  misc_feature (315)..(315): n is a, c, g, or t
  misc_feature (368)..(368): n is a, c, g, or t
  misc_feature (436)..(436): n is a, c, g, or t
  misc_feature (441)..(441): n is a, c, g, or t
  misc_feature (475)..(475): n is a, c, g, or t
acagagtcttgctctgtcgtccaggctggagtgcagtggcagaatcttggctcactgcaaccttcacctcctaggttcaagcgattctcctgcctcagcctcctgagcagctgggattgcaggtgcccgccaccacgtgcagctaatttttatatttttagtagagacaggatttcaccatgttggccaggctggtcttgaactcctgaactcaagcaatccacctgcctcagcctcccaaaatgctgggattacacggcgtgacacntcgtngcccggccttcatctttattgctcaaaagcaaagaatgcccntttatacccgagtgactgtgcagaaacccaaaatgcatcttgaaaatcaaagnagcaaaagctgttggcttgggcagggaggacgggaggccaaaagccccagccccaggtctgggggctnccagngtcgggtccagggagggccagcccagcttgtccnaga

SEQ ID NO: 706096 - DNA, 524 bp, Homo sapiens
aaaaaaaaaaaaaaaaactatgtgtgcgggcgcggcctgcgggcccccggaaaaagctttctaaaacacaatccgtgttggggcgcgcggcgggcgcccaagtagggtaagtgggacactggggccaaaacgcgtggtgtccctaagagagaacccggggcgcaagagagaccaaggtggcgcggggattctctctccacacaaatataaaaaaccgccggggcgggaacaccgagaggcggtctcgtgagacaaaattctcccagagagtgggagtgtctcaagagagcggtccatacacgggggagctctatatctacaaagagcggaggctcacacagcgagagagcgccctcgagagatatcataaacataatatcgcgccccgcggcgccgtgggggggcagcaaagagagagaagcgaagaagcaaaagacagaagaaaacaaaaagaagaaaaaaaaggagaaaaaaaacagaacagaacgaaacaaaaaaaaagaggcagaaagagaaggggggct

SEQ ID NO: 706097 - DNA, 940 bp, Homo sapiens
  misc_feature (22)..(22): n is a, c, g, or t
  misc_feature (70)..(70): n is a, c, g, or t
  misc_feature (125)..(125): n is a, c, g, or t
  misc_feature (132)..(133): n is a, c, g, or t
  misc_feature (142)..(142): n is a, c, g, or t
  misc_feature (145)..(145): n is a, c, g, or t
  misc_feature (150)..(151): n is a, c, g, or t
  misc_feature (180)..(180): n is a, c, g, or t
  misc_feature (182)..(182): n is a, c, g, or t
  misc_feature (185)..(185): n is a, c, g, or t
  misc_feature (207)..(207): n is a, c, g, or t
  misc_feature (228)..(228): n is a, c, g, or t
  misc_feature (236)..(236): n is a, c, g, or t
  misc_feature (255)..(255): n is a, c, g, or t
  misc_feature (286)..(286): n is a, c, g, or t
  misc_feature (289)..(289): n is a, c, g, or t
  misc_feature (313)..(313): n is a, c, g, or t
  misc_feature (369)..(369): n is a, c, g, or t
  misc_feature (384)..(384): n is a, c, g, or t
  misc_feature (402)..(402): n is a, c, g, or t
  misc_feature (426)..(426): n is a, c, g, or t
  misc_feature (440)..(440): n is a, c, g, or t
  misc_feature (484)..(484): n is a, c, g, or t
  misc_feature (516)..(516): n is a, c, g, or t
  misc_feature (532)..(532): n is a, c, g, or t
  misc_feature (537)..(537): n is a, c, g, or t
  misc_feature (569)..(569): n is a, c, g, or t
  misc_feature (599)..(599): n is a, c, g, or t
  misc_feature (697)..(697): n is a, c, g, or t
  misc_feature (854)..(854): n is a, c, g, or t
  misc_feature (871)..(871): n is a, c, g, or t
  misc_feature (903)..(903): n is a, c, g, or t
gggtgctcctgtgcaccatggngttattttgaagggcctgctaacgtctgcgggcagtttataggatgcnattattttctccacaacttaggtacatgagaataaaactgatatttatgaataangtatttnnctcgaaagnggnggggnngcttttgtggggtgcgatcggggtgggtncnctngcgacgccttgggctgtactgngagagggacggacggcgagangcccatgntcatgctgagacctgcaanatccctccatacgtgttgaggagttccaagncanaggggagggtaaaacactatacanaactgttcatcgtcttacattaacagaacacaccgggtaactttacataacaaggnagcaaatccccttcnctgcttttagtctaggtncgttgtatctgtggtgggggatgngagtggggcgagcntggttggggtaaagcttaagtctacatctcatgcagagttggcnttggtctgtcctctaatatttctcagacatcngagttagaactgaggntcgtnaatctggggtccgcattgatttcatatctgtnatgatacccttcgatgtgatccctgcaggnatctctgatgttatgcatccacttttttatccccttgcggttcaaatacaaaaccaggaggaaaatagcgcctatcagggctaaaacaatacccaggnagacataagaggtttgcagggatgggggaagaatcgggtcacagtccaggtcagcactgttgagttccaagaggacccgattcctcattttttccggatatgcacaggtgagccggtctttgccctgcactacctctgtttccttgagccaggtcancatgtctgccatgtggnagtcgcagaccagggattgttgtccaggaaancctaatgtggggtagacttgcaactcagccagggtgc

SEQ ID NO: 706098 - DNA, 1373 bp, Homo sapiens
ggtttgggaacaaaaggtgcgtcccttattgttaaacacaatgggtgggccctggttaatattgaaagacccccaacagagggttttcaagagcaccctggacacataccaccgcacacccctcccttgaggggagaaattttacctctcaggcaactttttgtgccgctgggaaattttgcgcccgacaagagaaggttttctcaggcagtctcttctgccgcccccacttgccggatatacttggagagagtgtgcgccctttttgggtggttgtggggaggaaacaacccacaagtctgttgtgccgcgaagtgtagtgcaccacacaccgggagcccaattgtgacccccaccagaacatctctttgtgtttgaattgcccgcgcgaagtttgtttttggttgcgcccgcaacgtttattaaggaaacgtgggtccccaggacacaaaattgcccaggagaaattgtggacgtccccttccttcccgaggtgttttcgtgcgcgcatgtgggtgtcgacgaggacgcctggttggttggtagtgcaaagagggaaaggaggttttacaacccctggtggctcacccaaaggcgcccatgtctcttggaaagagtatcacagcaaaatgtggctgaagaaaagattggttgtcctctttccacgcccagtttggtttccccacgaacacaaagtatcgccagaagagagcgttatctccacacaggcgtggacaccagagcgtttttgagacacccctgggccggggatagaatagcttctttctcccgagaatttcccgcgccccgctttatgcacacatagggcgctccagacatttctcggttttataaaaaagagtgcacaggaggtgctttattctgggaaaatatttctacactggagaagagtgtatgggacaccccgaaagattttacattctttgtccacacaccagagagagaacatggacacaccggttttctcacccacatgtctgtgacctgtggaaaaggattctcagaaacacctggggtgggatctccccccactgtccaggtgtaacccgagagaaaacccaacatgcaccatgtacccggtttggattccaggtgccaaatacgtgcagaacccccttttgtccagcacccagctggagaggccaccttgcgttcgccaacacggatgcaagccccattgtggtttcccgggcgtttttttaaacaaaaaaattgtagccactgggcgtggtgacagccctgtatatccccgcccctcaggaggctgtaggcggggaggatcccttgagccccccagtcccacctgggccaaatagtgagagaccccgttattttgaaagtaataatataaa

SEQ ID NO: 706099 - DNA, 105 bp, Homo sapiens
aagccagttcaataggatcctcccgaatcaaccctgacccctctccttcataaattattcagcatcctacctccatcgctaaccccactaaaacactcaccaaga

SEQ ID NO: 706100 - DNA, 409 bp, Homo sapiens
tcggagggcacctcttttaaataaaggtctgtcgctgccaccaccaagcccgggggggggccctatttattgggtggtaaaagggacaccccccctctcccccttttaaaaaaaagggggccccctgggggggtttttttcccccagggaaaaaaaaaaaaggggggccgggccctcccccccccggggggttttttttttttttcgggggttttttttttttttcccccccacgggggggcgtggggggttttttttccccccccttccccccggaaaaaaaatcccgggttttttttgttttttaggggggaccccaaaaaaggggggcaccccggtttggggggggggggggggtaaccaaaaaggacccccccaaaaatgggcgggggggtttggggtttcccca

SEQ ID NO: 706101 - DNA, 143 bp, Homo sapiens
gtgagtatacggattcactgtgcaatactcaatgattgttactgagtgctgagaacaacctgcttagatatatttacaggatagtacagtactcaaaaacaaaaattgaggtgtttgccaagttaaatcccgacgttccaata

SEQ ID NO: 706102 - DNA, 544 bp, Homo sapiens
  misc_feature (517)..(517): n is a, c, g, or t
  misc_feature (524)..(524): n is a, c, g, or t
cctgcagaatcaccgcaagcccagccgccacgatgaagtggggccgcgctctgagtccctggaccagcggcagacccatcacccatgacgcctgctccctgcagctgggctctcagttcataggaacgccctgcagaggggccgccacgcagctttccagggagcaccgtccaaaaggggctgtgctgtgtacctgggggggccagtgctcgagctgggacactgctctccacccagtcctatcagccccaacgaggcccttctggaaaacctgccctctgatacctctaatcacgttatgtctggagtccccttctggggctcttccagcaaaaggccatcctctggggcgtctgagagcagaacctcagccaagggggccacagtaccctcaaaaaccactaaaccactgatacaggctctctggagcagggacactgtgcccccaggtgccagaggacagagacaggatccaccctgggccagccataaacatgcccaactcaacggtggcgcntgactcnccaggccacacagactggca

SEQ ID NO: 706103 - DNA, 193 bp, Homo sapiens
taatatcaccaaagtaccccagactaacacagtaattattttggtctctgggtttcctttcagtctgtcaaatgcattgtttcttggttggtaggtttttctgtgagatggagtctcactccgtcgcccaggctggggtgcggtggcataatctcggctcactgtaacctccttctgcctcccagtgcttcag

SEQ ID NO: 706104 - DNA, 807 bp, Homo sapiens
cggggaggcgaggcctcgggaagctgaattattccttgacgtccaagagtttgagagacgaaagtgcttcggcccaggcggggtgtcgtgagcgctcgattccctcgacacctccgtcctgactctcgccgtcttcgccctttccgcgcgcccttggcttccgcaccctcctctccagtccttatccgagatgacggtgagacaagggtccaatcttcttccgtggacttacgcgctcgcgcatgcggactgtgagcgttccactagtcggctgcagagacgcgagcaaccgtctatctcatacggcatacttatgcaagttgtgggcctaggatagggtgaggcgtgtgctcctcaagaggaagaaacctgagaggcccgtgcgcccaccgaggaagccccgccccggtgccttcgctggggagcaggcgtctcgtccgtcagtcggcttgtgcggctgtctcgcccgtgtcccgagtggatcctcgtccagagactgctgcttgtggagctggccgggcgccccgcgtccaccgtgaggttcctcgcgctgggacagggtgccggagcgagcgggagccgaactctagtgcacttaggcggacggcacccgaactgcagagggccccaatatccctggccgggtgtatggggccgcgtcgcccccggttaccgcagtctggggctgctctcaccggtgctccggcttgtgctggaggccatggccgccttacctgccgtgttcctggacggcctagcgcgctcgctggctttccgcagggtgttgtcttagcttcgctgttctcg

SEQ ID NO: 706105 - DNA, 279 bp, Homo sapiens
attgattactgatttgaagaggaagaaaaaccatgaatggtctgaagcaaaagcttagtgtctgaagaagtcagtagggtgaaaacaagagctggccagaatatccacagatggtgacaagttggcaaagctttactagactactcgtgaggctaactagaggccaaggagccaacactgctcctgtccttacagagagaccctacacaggattcctagatatacatggagggacaacatcttatcaggtctctctgtgcagatgtggttatcattcca

SEQ ID NO: 706106 - DNA, 1322 bp, Homo sapiens
cgtgagaccgtcaggtggcggcgagcatgtgagcgaggaaccagagatcggaccagagtatcccccgggaccggcagcgatcgctggagctgtggctcaacaaagccacagaaccaagcatgtcggaacaggattggtcagcatatccagaatttctgtgagcaggtgcaacactgagcccaatggcccctacacatgcgccctggcatactggcctcacaaagatccagtcatccgcgacagagaaggaagctctttatgccttaacggtgctggagatgtgcaatgaaccacgtgtggggagaagttccacagcgcaggtggccaacatttcgtaatcctgaacgaactgatcaaagtgtagtccccaacagtacctggagagtcctgggccacaggaacaagttacacggcacagcgtcataagacatactctatcagtaggacagtctggtattccggaagacatcacagatacgagacgcttatcagatgctgaagaaaccaaggaattatacaacacggaccctacattaccaggtggatacaagtctataccccagcatcgtccctggcccaagagctccatcatattgatgctgatgaagaacagtccaaggcttctgacaagggcttctaaagagcaagcaccccgaggaccttcaggcctgcaaaccgggttacatccacagaaattcgagcacggaggcacacacacacacactcggagcagggtgatccacgacgggacacgagcgagggcaggaagcagcgaaagaccatgatacacggacaccgcaacgaccagagcagaagcatgcacccgcaggaccacagacagcgacccagacccaaccaaaaaacccgacagagcgagatagacacacagcgcaaacgagagaccacgccagacacgcacggcacacgaacacccccggacggcccacgccagcaccgccgcaactccgacgggtagggtcgacaatacaacaggcgcagggagggagaacgagcgcgaccgccagcacacaaccgcgaacagagggaggggcagagggaagacacgagacacaaagaacaaacggcgcaagaggcggctcccaccgccaaagcacgaaggcaacagaaagaaaggagggcaggcagaacaaaagcagcagacaggagaagacagagagaacacggccaacacggcgaaggcgagacagggcgcgtgcagtagctcgacgaggcgacaagagaacagcaacgcgcgcacagcagcacgcggaaccgcaaccaggccagggcgcacagggccgaagagcgggcagacgacacag

SEQ ID NO: 706107 - DNA, 852 bp, Homo sapiens
gggctttggcatggcgactttttctggcccggctggcaaatcctgtcgcttaatccgcaggaagatgtcgagttccacaaaggaggtggcgcaggttcgcaagcgcataacccatggaaaaaaaaagaacaagttattcgtggagtagtctatgtgcgccacccaaattaacctattttgaggaaaacccaagatcttttcatatttctcccagttgtgccatctgtgacacggtttcagtgctgtccaggatgtaacagtggacttgggaaaataggcaaagggttatgcatttgggtggaggttgtgagtctgaggatgttgccaaaaatagttgctgaaacattgaacaattaacttgtttgttgaaagaatcttggagtgtcatttaatgccactgaaaaaagtaccataaagaattctttaaagagtgaaatattccatttaagcaggcatcatatccatcagtgaaagggtatatcggaatcggacattaacaaaaaagctagggatgggaggagccgatttaaaacagaaagaagattactcaggaggaattagtaaaaaaggattggtattgaatttccttctttgatttacagaacagggaagttttcaaaaaataattgctaacgttaaaaaaaggccggtttacgtaggagaaggacaagttcgggtctcttacctcttaagatatgtggttttggcccaacagtttgctaccaatttgggaggaaatactgggtgtgatgtggaagggtgagttaagcattttgtaagataaggataatttggaaaaaggagatagtattggaaatagggatagagagaagtggtggttaatgtgcatat

SEQ ID NO: 706108 - DNA, 723 bp, Homo sapiens
  misc_feature (50)..(50): n is a, c, g, or t
cttttaaaaaaaaaaaaaaaaaaaagcacttcaaatagaatattccccanacgtgattttactgtgatcatatctctttcccctcataactggtcttcttccaatgtgccgtatgttagtgattgcgataaaagacctataggtgtcatctctgacattcctcatccaggtgtacacattgaatctactaacagttaccttctcaactggttttgaatctatccacttcactcagtgaaattcatcaccgtcatactaccactatagcctaaactggggctgctggaataacctcctgactggtcttgcattaaccattttgtaccttttccaaaccctctatctttcctcgctttagccagtgtgatcttttaaaatacaaatgaaattgtctttcccttgcgtaaaacattttaatgggtttatttggctcttggaataaagacagcattccttctatatagcctataaggcccacatgacccacctttatttctagccttctattaaactctgctttccttaatttttatactccactcacaatgccttcctttagtttcctctgtttccactgctcttttctaggggtctttgtgtggcctgttccttttgcttggaagtgtttttcttctgttccagcataggctcccataacatcatgtatacctccttcataaaacttgttatgattgcagtttagcatttgtgtatgtgtgatta

SEQ ID NO: 706109 - DNA, 312 bp, Homo sapiens
tagctgcatcgaggtgctggtggacagcgcggaggaggggtcctcgctgcggcggcggactggccgctcagaaggccgaacagagacttcgcaaattccgggagctgcaccttatgcggaatgaagctcgtaaattaaatcaccaggaagtgttggaagaagataaaagactaaaattacctgcaaattgggaaggccaaaaaagctcgtttggggttgggacttaaggaggggggaaggaaaaggattgcggcaagaggagaagactattgaaagtgaaggttccgggatcagtgcagaagatgcagaaag

SEQ ID NO: 706110 - DNA, 255 bp, Homo sapiens
  misc_feature (135)..(135): n is a, c, g, or t
  misc_feature (162)..(162): n is a, c, g, or t
ctccttggcagcttaatggccttcccctcggcctcgtaaagcatccctgtgacgctctcaacttcattctgcagcttgtggactttgtcattgagctccgcccgggccccgctcccctatcgctgcacttggacntgcagctcctgcaccctgcgcctccanggcttcttcttcttatgttccaccctcctgcttggccttagccctaggaggtggaacatacagaagaagaagcaagggaggctcacagtggct

SEQ ID NO: 706111 - DNA, 315 bp, Homo sapiens
  misc_feature (245)..(245): n is a, c, g, or t
tctgtgagcctggcttcagaggggtgattctctttactcagcctgggggtctggttcgctgtagagggtggcattcggaagtcttcgcatggccttgctgcctggctgtaagcagcgcgtatgtcgtagtcggtctcaacactgacaggagtatgtgctgcccaggtgggactccggtagctgtaggagccgagggacccctggggtctgcagcaggcatggttcggggtctcacacgtggtttnttcgtgagggaaggtggaagtcagtgttgaggccaccatccgtggcagggggcaccaacagtcttcgcct

SEQ ID NO: 706112 - DNA, 581 bp, Homo sapiens
aattccaatttaatgatattcaaatctattaatatttgttgcatcctcagggttgtagatgtgtgctgaaaaaatgatatggtgcaatctcttcagttttagaagaacctgggtatacagaacagagctaaaaatattagaaccacctgtcctttagtgtgacagaataaactagcctttttggtttacttaattacaggcttaccatcaaaaatatattctctaacttaaaaaagtactttgttggtaatatctgatgacatttctggtgtgagcacacttaagtgacacattacttaaagatgtggatgtaagatgctcaaggaaccatcatttgaaacagacggttccctcattgtatctgtacatgtcaaaaagcaaggttgtttttttacacgtgtctgaagcttctggagttgcacttatccggcagctattggactgagggctgaggcactctgcttttggagtgctgcggcaacttcctcaaaagactttcttttgttccttgaactttagaaaatgtgaacagggtcaaggccatgtgcactccattaaagagtgaaagcacattaggtccc

SEQ ID NO: 706113 - DNA, 1303 bp, Homo sapiens
  misc_feature (201)..(201): n is a, c, g, or t
ggacaggcgtctgtgaaaacctacccctaaaagccagaacagtgggaaacggaaaatgatctcatatcaacatgtgtcgtcatcggacaacgtagatgctgtgcaacgtccacgcatcttactggccagtctgactcatactaatagtgcggggtggcagtcgatcaataaaagaagccagtcgaaaatacttcgacgaanggaggacatgctgagactgggacataagggcgtccttcagaggtatgctctggtgtctttggattataagcctgggagagagctcgaggtcggctgaaaaacgttgggtctaatcagcgctacttttgaattaatcctaccttgtgttggcgcataacaattttggcacgtagctcgaggaccaaatgttgaaccctaagtggatcgcaccgtaaatttccacctatggaaattcgactcgccggaagaagtaagcaatctaggaatggagcgtatattactccgagaaaaataaccaataggaatatcagcgacggggtgagcaactgcttccaatggtcctcgaaacatggtttggcttggctgccgtaggagtatgggtgtcgtcctcgtcttcgaggtcgctttggtggtggaaacctgtggtcgtatacgactaagaggtaataccttacactagacggcaagtggggtggggaatgcacacccggaaagaaaacgctattgcgtcccgcatcatctctgcgatcttgtttagctatcgaactgaggggcgaatcgaattggcaaatcacaaaagagcctccattagtatcggtagccgcgagtgatttctataccccatacaaagtgtgtgggattttgcccaaaggtcgggagaaccccgaggcgcatgtacccagcaaacttagccggacagctaggcactagcttggaaacgggtaaataagttcccgaatacaaaagggggggaccaacgttacgaaaggcagaggctctttagccgtagtttttacgatagaacattagaccctctccgtggggtaaaccaccacttcccccttccagttaagctaaactaatagttgtcacggccttatttcacctaagcttagggcacggataggttggttttccgttcggtgtttctccgtgccatagttcggggggttgacagacacaggggcaatctttgttcggtggttggccttgggctctagcatgtgaatcggccctgcaccgtttgagttttgcccccattgtcgctgtttggtgccccacccgggggcgtactccggtggacccctttggcatatctccc

SEQ ID NO: 706114 - DNA, 219 bp, Homo sapiens
attgagattgttgtgatgacattgatggcccctaagatacgaggcgacacctgctaggtgtaaaggagaagctggttaggtctacggaggctccaggatgggagtagttccctgctaagggagggtagactgtccacacctgttcctgctccggcctccactcatagccaaatgcgagcaggagtaggacagcagggaggtaagagtccagaagcttat

SEQ ID NO: 706115 - DNA, 328 bp, Homo sapiens
cctgattgttcggatcacctgtggactgctaaaagcccacagtcctagccccatctgcagagttcgttggcttctgaaggctgggagcacgcgctagaacctgcatttctaaagctgctcaaatccaggcctttggaggcttaagactaagcctgcaccatttcaaactaagtatagtcagagagaaagatcccagcacgccccctcgttcgcacacttctggtacctcagcactctcacagcaggttcccaaaggtgatggttctggaagagttctggcctcatccttttgttaaaacctgctttcagaggtggcttagacaatggc

SEQ ID NO: 706116 - DNA, 362 bp, Homo sapiens
ttgggaatgaaacccccccccctcggagctatactcgagaccataaaaaggggaaatgaagccccaaaaagggtaagggggaaagaaaatgtaccgtttgcccaacgttgaaagactggggggcccaaatcatgttgaaccccccaacccatgggggattaagccaataaagatatttttttccccttgggccgaaaggggtggcccctgggccaaattttgtaagtaaaaaccttagggcttgaaaataattttttaaaaattccaatttgggttccagaaattgattggtttgccccttaacccttctcccccacccctgttttggccggtgaataaagggatttttgtttggcccaata

SEQ ID NO: 706117 - DNA, 161 bp, Homo sapiens
gagtatctgcacaccatcatgccgcaggtgcgcttgccgaacctgcagactggctatctcactttcctcgatgacgaatcttcctgatccagcagccaattcaacctcgcgcagaaaggggatcgacacctcgtcaatcattaacggggggtgtcgtacgt

SEQ ID NO: 706118 - DNA, 299 bp, Homo sapiens
  misc_feature (175)..(175): n is a, c, g, or t
  misc_feature (279)..(279): n is a, c, g, or t
  misc_feature (288)..(288): n is a, c, g, or t
gttccatcaccctgattgaaatgcagtggcacaaacatggctcactgcagcctcgactttctgggctgaagtgatcctcctgcctccgcctctcatgtagctgggaccacaggtgcacaccactgtgaccagttaatttttgatttttttttttttgggggggtagagatggggnctcactttgttgcccaggctggtctcgaactccaggctcaagcaatcctttcacctcgggctcctaaagtcctggaagtacaggcctgagccactgtgcctggnatggcacgnacttcatgatg

SEQ ID NO: 706119 - DNA, 211 bp, Homo sapiens
ctttcgtgatagctgattcctagaggtatcccctcctcagtcgcaacatgcttaggggtcggggcctgggctgctgctgctggccgtccagtgcctggggacagctggtgccctccacgggagcctcgcaagagcaagcaggcaggctcagctaaatggttcagccccatgtccccggatggcgtgtcgagtcaaaggtacctgagactct

SEQ ID NO: 706120 - DNA, 240 bp, Homo sapiens
ctgaggagggttgctccggccaggcgctcctccaccagcaggctctggagctcccgctggcagtcctgcatgcgctggctggtctgcgctgtccactacccaggatgaggccatcgtgtgctctcaacagtagttcacgccagctattgaccgcagggcacttctgtgccacccatcatcccacgatgttcatgcttgaactcctctggatctcctccgggtaccgagtctcgcaattcg

SEQ ID NO: 706121 - DNA, 111 bp, Homo sapiens
acatatgccttttgcagttagattcggggatccagcatggaactctcaaggtggctcttggaccccagagatgttgtctaattccactaaccggcatcctaacccttccac

SEQ ID NO: 706122 - DNA, 206 bp, Homo sapiens
gtggctgttctcgaggataccctgataggtgcgcaggccaggtagtgcagatacctcgggtggctcgaacagcgggacaactctcagaatggtcaaactgaacccttaggggagtgtcacccagaaaagcccacataggaagtcgacacccacaaacataaatattgcaaacaaaagttctcacatacactcctgcgaacctatga

SEQ ID NO: 706123 - DNA, 614 bp, Homo sapiens
ccattgaggccccgtaaagaaaaaaataaacgagcccaagggcggaagtccacatgtcccacacagtaattaacatctattagcgaaaacttgtgacataatagacattgtgctttatataaagctgttagagcacatgtgcataggacatattatcaagattcataagtgcgcaaatatgaaaggcattacatgtcttatcacatgttacacagctgtcataactctcaaagaagtgttgctagtattttataagctgctaactgtctaggattgtcaagtgtttagctaatccatataaccttaccgacagcgaatcttcaatgtcgtaggtctgggtcagtatatactccagcttccagatggactctcacctttagattcgcctctgtcagattcaagtaatcttgcgacatatcctgcagttaacaacagtaacaaaccctggttctctttatggcacataaggcattgtacaacaatgagcgttcatgtctccatttctgtgacattttagtcttggcgctgtggctcacgtctgtgagagcaccgatttgacaggccaatgtggcaggatcacatcagcacaagagttcaagcccagtgtgggcaac

SEQ ID NO: 706124 - DNA, 155 bp, Homo sapiens
tggaccatcgaacatcgatacgcatcagacattgtctcatgaggaaccatgatactctgagctatactgcataccatcactggcgcgactatgagccagtggaattagacgttactcgatgcgatgaacccttccggcactgggaagtggaggac

SEQ ID NO: 706125 - DNA, 103 bp, Homo sapiens
gagcttaagtttattatgcaaacagtacctaacaaacccacaggtcctaaactaccaaacctgcattaaacaattcaagctccatctcgtctcttctcttgga

SEQ ID NO: 706126 - DNA, 120 bp, Homo sapiens
gaggacattttcttcacctctaacactgggtctgctgttggcttccaggccatctgagaatcgcgctgagatcttccaggtccctggtctctgagatgtctgggatcaccatagtcatcc

SEQ ID NO: 706127 - DNA, 130 bp, Homo sapiens
gaggctacattcctttattgataacacagatccagagcagacggaggaaggggcgcggcaggcaggcagttgccgtgcgcaggttctggtcctgtgcccttcctgctcctgaggccccttcctataggtg

SEQ ID NO: 706128 - DNA, 206 bp, Homo sapiens
ggtcatatattacactaggcctagatctgcactggctgcggggcagtgcagggacacacacctgttgggtgcctgttggttccacccaggaggacagcagcagcctcatgcctcctgcccctggcagtcgggtgacgtgggcaggtggccttgcttggcagggttccagggtccccttggaggccccaatggacctttgcctttgg

SEQ ID NO: 706129 - DNA, 317 bp, Homo sapiens
agtctgcctgtgcaagtaatgcggtgggtgatcttggtcacataactcaacttccaggtcagccatcttctattttaagctcgaaatatcttgggactacaggcaacaacaacacgcccggtaatttttggattttcagtagagatggggtttaccatgttggtcatgctgctcttgaaatactgaactcaggtgatgcatctggcttgggctcccaaagtgctaggattacaggtatgagccaacatgtccgggccactctggatttaaggacagttcttccttcaatcagcaggcaaagagtactgattcctgat

SEQ ID NO: 706130 - DNA, 2641 bp, Homo sapiens
gaaaatgtatacctggcagcaggcactgtgtatggactggagacccagctgactgagctagaagatgccgcccgctgcatccacagcggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgctaaaagcttagcctaccacactaccagtcattcccatcgctttgcaatcacaagccacaggatgagaagttctgactcactcatgccatgcccagggctatctgaaacaatgtctcattaagaatttagggttcttccatgggcttactgacagttgcccagatctgaaggggaaagggtcttgagaaagaccatcactggctcaactttagggcactgtccagagtcaacatgatgtggtttagcagtgatcacatctaaacaaagtttaggtaaatgaattatcgcagagaaaaaccacatgagaaaatttttgtactccaaatttacttcccaataaatattcagcaaagtagtaaaatgaccttaaagataaaaatgattagggaatagccttagaaaatttataggtataaaaaattcaaggacaaactgtgcatttaatggacacaagaattgactctaactccatgtctgtggtttctttgaacccatatcaaatgtatgactatttagagtgtttataagagataatggaactgaactttcactcaattaattgggcattaacaaccttcttttatgtttgttcctgatatagtctgaatcttaggaagaaggtaaaagaaaggaggcaagagaatagttatgatgaatatgtgttaagtgcctgctctgaaggaggcaatgttcttctcatttgaatccttatggcaaccttattcaataggttttcccatatttcagatttaataactgaaggccagagagattaatttgccaaagccacacctttatgctaattatgattggaatgcatcacaaaagcctaactctgttgttttcaacctctacgttattttgctgctatgtgcatttccagatctgattttctgctaacttgtgtgctatgatccactcctgatgggggtctacattaatcttccagtactccttgctgatgctgtgttatgtgtcatctaacagaaatgactcctttgaaataagtaaatctttggctttttgttctgttggtgtgattcaaagcaaaacaaacaaacaaaaacaaattttaagaacacaacaaaaaagatttgacttccgaatagaatgttttctttaagaggcatgaaaagcaactattgttgtgttacagtgttaaaaatattcagttttctttgacaaaaatgtgtactgtgtaagccttgcaaacaaaaaacaacaaaaaagaagcagcagcagcagcctgctgtgtggcatctgaacttttataaaggtttccttgtgccaaataagtgcaaagatttaatttactattaaaaaccataagcatatgttatagttccagaagaattattttgtcatcaagtgattttgatctttagtgtcaatatttatatttagattaatttttataaatgaaaatattttaatggtttaagaaaatgaggacaacaggataatatctttgatgacttctgaaagttatgcttcccttcatgttatatgcacattgccaagaattactgtcaagagaaatgataagtaaaagtcatttatgaaaataaa

SEQ ID NO: 706131 - DNA, 652 bp, Homo sapiens
  misc_feature (54)..(54): n is a, c, g, or t
  misc_feature (73)..(73): n is a, c, g, or t
  misc_feature (77)..(77): n is a, c, g, or t
  misc_feature (120)..(120): n is a, c, g, or t
  misc_feature (126)..(126): n is a, c, g, or t
  misc_feature (133)..(133): n is a, c, g, or t
  misc_feature (137)..(137): n is a, c, g, or t
  misc_feature (140)..(140): n is a, c, g, or t
  misc_feature (152)..(152): n is a, c, g, or t
  misc_feature (154)..(154): n is a, c, g, or t
  misc_feature (163)..(163): n is a, c, g, or t
  misc_feature (185)..(185): n is a, c, g, or t
  misc_feature (210)..(210): n is a, c, g, or t
  misc_feature (217)..(217): n is a, c, g, or t
  misc_feature (221)..(221): n is a, c, g, or t
  misc_feature (229)..(229): n is a, c, g, or t
  misc_feature (296)..(296): n is a, c, g, or t
  misc_feature (301)..(301): n is a, c, g, or t
  misc_feature (305)..(305): n is a, c, g, or t
  misc_feature (330)..(330): n is a, c, g, or t
  misc_feature (355)..(355): n is a, c, g, or t
  misc_feature (372)..(372): n is a, c, g, or t
  misc_feature (403)..(403): n is a, c, g, or t
  misc_feature (652)..(652): n is a, c, g, or t
tttgctagatcagaagcagccacacacacacctcatctatgcaaactaaaaatntatataaacagcacaatantgtnatactggatcatgatacattacctgtacacataactactactnttattnataaacntttngtncattcagttttntncccaataanatatcattaagtttttaaaatnattctcttcctctttaaagggagantatttcnaganactaattnacccatctaatattcaaatacaggaaacacattccacaaggcgctttacctgacgagacctcaagtnctgtnttcnctcttgaacttttggggagtaaacngtccatagggaccacacacaatgcnatgacagaagagttgtnacattaagtcttttcatgggacttgattggngaagctttatgacatgcttgagcaacgcactgaaggggatcccatctgagttaatactttgtccaaccactgtagaggtccattcagatgaagttcaatccagcaaggagtacttgttaccgtctgccttcggtattctgctccccaccctttcacaaaactcattcttatggtgcacattctagttagctgatagacggcttcaaaaccctgattaacagactgagccagaagagcagcaaattcctn

SEQ ID NO: 706132 - DNA, 280 bp, Homo sapiens
  misc_feature (13)..(13): n is a, c, g, or t
  misc_feature (229)..(229): n is a, c, g, or t
  misc_feature (237)..(237): n is a, c, g, or t
ctcaaagtgagtntcattgtttgctgatgtctgctccacaaagccctgctccaggggccttcaccaagtcccagccttggtttgctcacctataaataaggataattgaccctggtctatgcacattacaggacagttgtatgaatcagaggatacagcggaagaaaaaatgtttggaaatttaggtctctgcaaactaagggccaatgtactggtatttgtgacagtnaccggatngggtgggatgggggtgataataagagtgcaaggaaggggggat

SEQ ID NO: 706133 - DNA, 503 bp, Homo sapiens
gcggccgcctactactactaaattcgcggccgcgtcgacatcttaacaaagtaaaagtatgattctatcatatgttaggatctctacaccagttctctgccttgaattagtatccagtcacgaacattggcttcatcctctagcattctccagagactaaacaaaccaaaacatctcagacagtagccaagcacgattttgaacatcagaagttggcatacaaccaaagcacagcaaaacacataaagagaagaacactgtcagtcgtgttccttcataaacccaccatctataagattccctacctttccgttggtacacgggtgtagcacaagggcatttagcaaaataacaaaacggtaaacattacaggcatccagttttctaaggcctaaacagtgaggcatggttgatttcgcaaaagtttccagcagcattctcgtacttcctttcgagacgtcgacgcggccgcgaatttagtagtagtaggcggccgctctaga

SEQ ID NO: 706134 - DNA, 239 bp, Homo sapiens
ataaactgtactgaactatcctactctattcttaaccaaatactagttagagaccccctgtacagattgcatagactcctcctatggatacgtcaacaccacagttaaacgctctgctcataatagccttcacaactggcctgtgaggcacgtactagtccctaggaccactgctgggcataagcgacgtggcgtgactcgccctaacgcctcccagctaggtacaaggtacagccagc

SEQ ID NO: 706135 - DNA, 992 bp, Homo sapiens
ggcgacacgcagggagagtcaggccagaaagataaagatggacctccagaaggcggctagccatcccagtgagccaaatctctaccattgcaaggctcaaatctgacaggagatctttgacacagtatccatctaggccatgtctcctctgggaacagaccgtgtcacaaatactggatgggcgctctgttagttctgtctacactatagacctcacatggaggctggcactttgttctacactaacaaatcgggcggagaaatttgtgaagcgaggcgaggaggacgtggcctctcagcatgaaagcaggattccccgattgcgatgccgttggcatccgggtatctgggtagctccgatcgccgatgagtgggggacctcattacttgctcatctacataagacagtgtccttactactgttcctttctatcccactttcaaggagggaatggctttggaagactatcagaggatgcttggttaccaagtaaaggattccaaagtggagcagcaagacaactttctaaaacgcatgtcagggatgatccgtctctacgctgctatcatccagctccggtggccatatggaaaccgacaggagattcaccctcatggcttaaatcatggatggcgctggtatggcacagatcttaaacatggagcccttgtcagatgtgacaggcaccctcctctttgacgttcctggaggtgtgtgggaatgcctcatgaagcaataccaggttcagttctggcaagatgctaattctcatcaaagaggactacttttcccagaattgaagctatcacaagctcaggacagatggggctccttccatacgcctcaagcagttcttggagaaatgtttggcacacaaggacatcctgtgcccaagggctttctgaatttcctccttcttgggctcctgaatgtatccatcaccaacaattcacgctgttgcaagagggcacataattaagggaacgaagac

SEQ ID NO: 706136 - DNA, 369 bp, Homo sapiens
tttttttgtaaattgcccagtcttgggtatgtctctatcagcagcttgaaaatgaattaatacacaacgatgctcaatgacagtgatgcgttctcagaaacacatcattaggggattttgtcattgtgtgaacatcatagagtgtacttacacaaacctaaatggtacagcccattacatacctgggctctatggcatagcctgttgctcctaggctaccaatctgtgcagcatgtgactgtactgaatactgcaggcaactgtaacatggtaatatttgtatatccaaacatagctaaacataggaagggtagagtgaaaatacagcatagaagacaaaaagtagtgcacctctgtggggcatctacc

SEQ ID NO: 706137 - DNA, 156 bp, Homo sapiens
accagtcatgttttatttggaggttaattcctattaggatatgaaaggatccagcgtcgacttagattgtgttcctctcgtaggggctcgggccaaggttgtggggtgggggggtgcagagtgtgtccccttttgtcgtcttctagcagcagaata

SEQ ID NO: 706138 - DNA, 204 bp, Homo sapiens
gtggacaattaaagttacccaaaatatagtaccttatcattaaaaagataccagttattagaccaggtgcagtggctcacgcgtaatctcagcacttcgaggaggcagaagggaggcggattacttgaggtcaaggagtttggcagaccagcctggccaacatggtgaaaccctgtctgtacttggacaaaatacaaaaaatta

SEQ ID NO: 706139 - DNA, 305 bp, Homo sapiens
cccccgcccaaaaggggccccccccgggggggggaaaaaaaaaaccccccgggggcgcccttcccccccccccccttgggttttggggcccccccctttttggttcccccaaaccaaaccccgttttcccccgggggggggggcccccccccccccccttttttttccggttttttggggccccccccccccggacccctttagaaaatccctttttttaaacccccttttcccctttttttccctttttttttttttttttttttttgggtttttttttttaaggggcttttttttccttttta

SEQ ID NO: 706140 - DNA, 402 bp, Homo sapiens
tcttcccctgacaggattaagagattaaagcaaagacaggcataggaaatcacaaggatattgattggggaagtgataagtgtccatgaaatctttacaatttatgtttagagattgcagtaaaggcaggcataagaaattacaaaagtattaatttggggaactaataaatgtccataaaatcttcacaatccacgttcttctgccatggcttcagccggtccctccgtttggggtccctgacttcccgcaagaaatgggctgtaccttgtagcattccaaagacaggccggaattctgagaagggaaagtggtaaaagtattgtccagtcctttttaagttggtggctgagcttggtaaggtgtgtttttaaaagagcatcagtctgttctacctttcct

SEQ ID NO: 706141 - DNA, 145 bp, Homo sapiens
aaaatgctggtttacattactctgagcaggttgttttacacggcagagtggatgtggatgcttctgagaaatgaagttgggcttacccacccatcttgagagttcttcactgtgtgtgccaatatgcataggaatccccggtcga

SEQ ID NO: 706142 - DNA, 250 bp, Homo sapiens
  misc_feature (103)..(103): n is a, c, g, or t
  misc_feature (161)..(161): n is a, c, g, or t
  misc_feature (173)..(173): n is a, c, g, or t
  misc_feature (185)..(185): n is a, c, g, or t
ccgcctggggtttggtcctcgcccatcctgcagggattgcccaccgttttccagacacccccactgaggggggcaccaggtttagtgctgctgctttcaatgntgcacccgggccctgggccggccccccgagcagcctttgtattttgcttggggagggntgggagaccctncaggacattccncaccctcccccatggtgccaagttgtagctatagctacaaataaaaaaaacccttgttttccaga

SEQ ID NO: 706143 - DNA, 129 bp, Homo sapiens
aggacttatacaccctatacaccaggctataccctaggctataccaccaggtagtgcttttcttatactgtataatggcacaggggagagtgttagtgatcagaattccgtggtatagggtggtatcag

SEQ ID NO: 706144 - DNA, 309 bp, Homo sapiens
cacgtctggaacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaatt

SEQ ID NO: 706145 - DNA, 176 bp, Homo sapiens
  misc_feature (83)..(83): n is a, c, g, or t
  misc_feature (116)..(116): n is a, c, g, or t
  misc_feature (138)..(138): n is a, c, g, or t
cacagaacatacgcctcagcttaggcccacacagtacgtcgggatcattcactatcactagtcgtccacctccacatcatctnccactggaagatctttggggacaatatcatgcntggagctgtcatttcatataanaatgtcttcttctggaatacctcttgaaggacctatct

SEQ ID NO: 706146 - DNA, 830 bp, Homo sapiens
  misc_feature (36)..(36): n is a, c, g, or t
  misc_feature (62)..(62): n is a, c, g, or t
  misc_feature (64)..(64): n is a, c, g, or t
  misc_feature (68)..(68): n is a, c, g, or t
  misc_feature (77)..(77): n is a, c, g, or t
  misc_feature (82)..(85): n is a, c, g, or t
  misc_feature (87)..(87): n is a, c, g, or t
  misc_feature (89)..(89): n is a, c, g, or t
  misc_feature (91)..(91): n is a, c, g, or t
  misc_feature (132)..(132): n is a, c, g, or t
  misc_feature (139)..(139): n is a, c, g, or t
  misc_feature (151)..(151): n is a, c, g, or t
  misc_feature (171)..(171): n is a, c, g, or t
  misc_feature (174)..(174): n is a, c, g, or t
  misc_feature (189)..(189): n is a, c, g, or t
  misc_feature (213)..(213): n is a, c, g, or t
  misc_feature (220)..(220): n is a, c, g, or t
  misc_feature (237)..(237): n is a, c, g, or t
  misc_feature (240)..(241): n is a, c, g, or t
  misc_feature (245)..(245): n is a, c, g, or t
  misc_feature (250)..(250): n is a, c, g, or t
  misc_feature (275)..(275): n is a, c, g, or t
  misc_feature (280)..(280): n is a, c, g, or t
  misc_feature (285)..(285): n is a, c, g, or t
  misc_feature (299)..(299): n is a, c, g, or t
  misc_feature (314)..(314): n is a, c, g, or t
  misc_feature (349)..(349): n is a, c, g, or t
  misc_feature (417)..(417): n is a, c, g, or t
  misc_feature (423)..(423): n is a, c, g, or t
  misc_feature (429)..(429): n is a, c, g, or t
  misc_feature (431)..(431): n is a, c, g, or t
  misc_feature (434)..(434): n is a, c, g, or t
  misc_feature (441)..(441): n is a, c, g, or t
  misc_feature (443)..(443): n is a, c, g, or t
  misc_feature (494)..(494): n is a, c, g, or t
  misc_feature (498)..(499): n is a, c, g, or t
  misc_feature (503)..(503): n is a, c, g, or t
  misc_feature (508)..(508): n is a, c, g, or t
  misc_feature (516)..(516): n is a, c, g, or t
  misc_feature (554)..(554): n is a, c, g, or t
  misc_feature (556)..(556): n is a, c, g, or t
  misc_feature (566)..(567): n is a, c, g, or t
  misc_feature (569)..(569): n is a, c, g, or t
  misc_feature (571)..(575): n is a, c, g, or t
  misc_feature (580)..(580): n is a, c, g, or t
  misc_feature (593)..(596): n is a, c, g, or t
  misc_feature (599)..(599): n is a, c, g, or t
gctgttgcgatgcgcgagacattgagagattttttntttttttttgaatttgcctttttgancncctnctgcctttnacatnnnngngngncattttttattgaatttttttctttttttgagccttttttncttttgncttttctgctgngcgcctggctgctctttctnctnccccctccccccatntgttccccctgctttcacctatcnactcctnagcttccccaacaggancanntttnagggnccaggcctcttggaggcccctcctncttcnttggnttctgcttccttcncttcttagctggctnaggggcttctatgggatcctggaagttccttaggnacttgcccagggtcccagggccacccacacttcatctgctccctcataggccccacctccacgtcccngctggnccccananccnagcttcntnccctccaccgggagtctgcatggttgggagtcctgggtggaggggcctttntgannctgnacccngctcaggncaggtggaggagctgggcctcccacagggtgcccgggnantgccatcctnntngnnnnnggcanccttcaaacgttnnnntcnacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtcttacccccaggctgtgagctccttggggcaggccctcaataaatgtgaacgtcgctgccgcaa

SEQ ID NO: 706147 - DNA, 164 bp, Homo sapiens
tctcgaggatcgcggcatacaggctcttttaaacaatcagcttccaggggggaaaaatagagcaagaactcattactgcaagacaacgcctagacactcataagagagatccgctccatgctcaaaacacctccagcaatgggtgatcaaagtttcaatcatga

SEQ ID NO: 706148 - DNA, 246 bp, Homo sapiens
gtgagtctacttgccagttgacaccaaatagactacgaaagtgtgtttaacatacctgaacacacaatagctaagacccaaactgtgattagataccccactatgcttagccttaaaactcaacagtttaatcaacaaaaattggtcgccagaaaacttacggagcccaaaggtttaaaattcaaagggacctgggcgggtgcttccataattccccctaagagggaagccctgttccttgtaatc

SEQ ID NO: 706149 - DNA, 978 bp, Homo sapiens
ggaatttttataggcgtaggataaattttcacagactaagtttatttcagacaaagtagagaattcttttagaaagtttcttgttttctctcccttttgtggattgtaatggtaaaacacatggtgcgaaaatggacatggccgggggcatatgggcgaatctggcgagagtatagtaagcccgtacccgggctcgttaaatcaggcggtgattcaggagaacgccgtataaaagaggtgggttcgcaaggtttcggtctatctaaagccaaggcgctatatgtcttagcagggtaaggccaggtgttgggcctttagcattagttgtcgcaagtggtgtgcctttgtccagagacaggaaatctccctgtcttgatccacagaagtaccttgctacatgtcgaagcttcaaagttttgtcagggacggggggtggcatgtggggacttgtgggaagccctcatatggcccacgcataccgggggaggacgagaggcagacaaatcgctctgaccccccagtgagagtcgcgtgctgacgttgagcttcagatagtggtgccatggagtaccatgctgtaactaggaggaaatgcccgggcaagacagaattgaacctctcacaacgtagctgatttgtggatgaagcgaacgtgtatgcgtgtgacgcaggtgggatctatggagagtgatgtcctcataggagcataggtgttgtggtataacgctacgttgtgtctgtgtgactacggacagttgctatgggaacctgcaatggccagacttggtgttgagaattaggggcagtgggtacgtgtcctgtccaggaagagtttttgcgcccctatcggttcagaacaaacacatgtaggggggtgttcgccagaaaaacacacaggagagggtgacacatagcacatagcatcttactacatttatgccaacaaaagataacattttattattgtcggaagacggt

SEQ ID NO: 706150 - DNA, 861 bp, Homo sapiens
  misc_feature (8)..(8): n is a, c, g, or t
  misc_feature (80)..(80): n is a, c, g, or t
  misc_feature (108)..(108): n is a, c, g, or t
  misc_feature (127)..(128): n is a, c, g, or t
  misc_feature (132)..(133): n is a, c, g, or t
  misc_feature (153)..(153): n is a, c, g, or t
  misc_feature (178)..(178): n is a, c, g, or t
  misc_feature (202)..(202): n is a, c, g, or t
  misc_feature (205)..(205): n is a, c, g, or t
  misc_feature (220)..(220): n is a, c, g, or t
  misc_feature (244)..(244): n is a, c, g, or t
  misc_feature (251)..(251): n is a, c, g, or t
  misc_feature (268)..(268): n is a, c, g, or t
  misc_feature (271)..(272): n is a, c, g, or t
  misc_feature (276)..(276): n is a, c, g, or t
  misc_feature (281)..(281): n is a, c, g, or t
  misc_feature (306)..(306): n is a, c, g, or t
  misc_feature (311)..(311): n is a, c, g, or t
  misc_feature (316)..(316): n is a, c, g, or t
  misc_feature (330)..(330): n is a, c, g, or t
  misc_feature (345)..(345): n is a, c, g, or t
  misc_feature (380)..(380): n is a, c, g, or t
  misc_feature (448)..(448): n is a, c, g, or t
  misc_feature (454)..(454): n is a, c, g, or t
  misc_feature (460)..(460): n is a, c, g, or t
  misc_feature (462)..(462): n is a, c, g, or t
  misc_feature (465)..(465): n is a, c, g, or t
  misc_feature (472)..(472): n is a, c, g, or t
  misc_feature (474)..(474): n is a, c, g, or t
  misc_feature (525)..(525): n is a, c, g, or t
  misc_feature (529)..(530): n is a, c, g, or t
  misc_feature (534)..(534): n is a, c, g, or t
  misc_feature (539)..(539): n is a, c, g, or t
  misc_feature (547)..(547): n is a, c, g, or t
  misc_feature (585)..(585): n is a, c, g, or t
  misc_feature (587)..(587): n is a, c, g, or t
  misc_feature (597)..(598): n is a, c, g, or t
  misc_feature (600)..(600): n is a, c, g, or t
  misc_feature (602)..(606): n is a, c, g, or t
  misc_feature (611)..(611): n is a, c, g, or t
  misc_feature (624)..(627): n is a, c, g, or t
  misc_feature (630)..(630): n is a, c, g, or t
tggctccngcccgctgctgccctgctgcccccctctgccaggcgctagacatgtacagaggtttttctgtggttgtaaanggtcctatttcacccccttcttcctgtnacatgacccccacccatgnnttannaaagggggtgctggtggtgngccgtgtgtgcgtgtccctcctctnctccccccctggctgctctttctnctnccccctccccccatntgttccccctgctttcacctatcnactcctnagcttccccaacaggancanntttnagggnccaggcctcttggaggcccctcctncttcnttggnttctgcttccttcncttcttagctggctnaggggcttctatgggatcctggaagttccttaggnacttgcccagggtcccagggccacccacacttcatctgctccctcataggccccacctccacgtcccngctggnccccananccnagcttcntnccctccaccgggagtctgcatggttgggagtcctgggtggaggggcctttntgannctgnacccngctcaggncaggtggaggagctgggcctcccacagggtgcccgggnantgccatcctnntngnnnnnggcanccttcaaacgttnnnntcnacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtcttacccccaggctgtgagctccttggggcaggccctcaataaatgtgaacgtcgctgccgcaa

SEQ ID NO: 706151 - DNA, 304 bp, Homo sapiens
cggtgacctggagggagccgagggcttcggatgctgcaggtgacatgagctctccagatgggcgcagcttcccgtaccgggccgctctcaggaggcacctctaccagtggtgacgaggggctacttcccctttgtgctggagcgtgggggactcatacctgggagggggcccagggcctgaggagcccgagggaccatagcctgtgcaggctgcagcgaggaagcgagcaagagagctgcatggtagagacgcgcgcagcgtcggtccaagatgcattcgggagcggaccaatgagacgagcgt

SEQ ID NO: 706152 - DNA, 116 bp, Homo sapiens
ggactacattgtgctggccttgcgccatgaatggggtgaaaaggacacgtgcagtgccgggtgtggtgtctcactgcctgtaatcccagcactttgggaggcctgaggtggacagg

SEQ ID NO: 706153 - DNA, 193 bp, Homo sapiens
ggcactggtgcggaagcactgcctttctatatgcgcaatcagaccccagtcagaagatacttgtgtcctgaagtgatgcctggagcattttaaaggagcatactctgtcagagaactatagagcgtctctgaagtattcctcttttttaaggaaacgcaaaagcggaatactccaatactatggcctaaaatg

SEQ ID NO: 706154 - DNA, 296 bp, Homo sapiens
aatttgttcctatgagaaaagtttagtctacttgtgcacatctcatcaaaacagaaaacaagtcacagaaacaaaaccctgttcattccttcacagttctttagtgagaatcaaatacactgtatggatgtagaattattgtaaaaaagttaattttttacatggtggtcttaaggacgataatagttctattaggtgtacttcaagggtaagatcagtaattatagagcacagaatttagtgtgtaagaactgttcatcgcacttgctgggtccgagtcggtaccgggctaccga

SEQ ID NO: 706155 - DNA, 305 bp, Homo sapiens
  misc_feature (54)..(54): n is a, c, g, or t
  misc_feature (56)..(56): n is a, c, g, or t
gctcgacacaaaatcgtgggcttgctcaattactgtgggagctggcttgccggntngaggccagcaaaagcaccgcacatctgtcatgaacgccacttgtctgcgacatgatgtcgtttcatatgccatccaaaacccgttgggttagaatgcccccttttctgcccccgatccttgaggaccgccatgttcagccgtgatttgactattgccaagtacgacgccgatctttttgccgccatggagcaagaagcccagcgccaggaagaacacatcgagctgatcgcttcggagaactgtcgacg

SEQ ID NO: 706156 - DNA, 111 bp, Homo sapiens
tgcatgtaatacattccatgggatacattaaaactgagacgaacccattctgtgttagctaccatctggaatatccactataattcagtggtgaatcctaacaaggccacc

SEQ ID NO: 706157 - DNA, 255 bp, Homo sapiens
agcactttgggaggccgtgatgagcagatcgcctggggtcaggggttcaagaccagcctggccaacatggtgaaacccggtctctactaaaaatacaaaaattagctgggcatggtgacgggcacctataatcctagctactcaggaagctgaggcaggagaatcacttgacccaggaggtggaggttgcagtagccaggtttagttgaactagctaagaggcagcggcaataaatgtattcagtaccctcttat

SEQ ID NO: 706158 - DNA, 112 bp, Homo sapiens
tctagaggatcccttgaattgtgccaggaaggtcttcgtgggcatttcagtcaagccggtgaccccaagattcagaaggacttgaaaatcaaagcccatgtcactgtctcca

SEQ ID NO: 706159 - DNA, 121 bp, Homo sapiens
cgtgatatggcatctgcggctatgagaggtggcccgattgtctgaacagagctcgctggctggataagtggatcgccgctggttgatcatgccgctgcgagaagcggtggtcgaagtatac

SEQ ID NO: 706160 - DNA, 108 bp, Homo sapiens
tgtgctgtgttggtgttgggcgcatccccttcttcacactttggtgttcttctcctcttgacggtggtggctaaagccgccgctttcctccttccctctctttagtgt

SEQ ID NO: 706161 - DNA, 527 bp, Homo sapiens
cgtctacattgaatatacttggtcttattcgccctggatgcaacttattgttgcggaaagggaaagggagcttcaactgcacccaaggtttgttggggggcattaattggccatttcaagcataactggctggggaaaaacaaacccccccacctaaaaccctgggggcattgggactcccaaagaaggccaccaacccccattttttgtttttgttgaggagaaacagtttctacaaagaaacacaccgggatttgaatttatggcctaaagaaaaacacatgacttggcctaaaaatacaccgggggaaaccgccccaaaatagggcgcaaccagccccaaaatggtaaacgggacgaaacaagtttttaagatcatggggaaccagacccacaatttaaaaaatttttttattagaccccttgggccccaagggatggttgtgtgttcaccccacaaaaaccccccgttaaaaaacgctttccagggccattaaaaaaaaaaggggtttatttgtcaaacttta

SEQ ID NO: 706162 - DNA, 456 bp, Homo sapiens
  misc_feature (80)..(80): n is a, c, g, or t
cagtgagtcgctgcaggcgcaccttagaggatggagcttaaaacacacacccattccatcctggctaacacggtgaaacnccgtctctactaaaaatacaaaaaattagccgggcgtggtggtgggcgcctgtagtcccagctactcgggagcctgaggcaggagaatggcgtgaccccggcaggtggagctcacagtgagccgagatcgcgacactgcactccagcctgggcaacagagtaagactccatctcaaaacaaacaaacaaacaaaaaaacaaaaaaaacctaaggaaaaaaatagcaaaaagtagccaggcgtggtggcacatgcctgtagtcacagctactcagaaggctgaggtgggaggttcacttgaggccaggtgatgatgctgcagacggctatgattatgccactgccctcaagcctggggaacagagtgagactgtttc

SEQ ID NO: 706163 - DNA, 117 bp, Homo sapiens
ggaactgaagccgtctacttggcacaaacaggtgtggtacatggtccctgggataagaagggttgccagctgggagacctatttatgggagcagaggtgggacaggagcttgctcag

SEQ ID NO: 706164 - DNA, 403 bp, Homo sapiens
ctagatagcaccccgtggcattacataacacgtcatgagtggcatgtgtcttgtaattttggggacaggtatctctcgttggtcgcctctcgtttttataagatacaaaatcaacaagaagaacataacaaggccgggcgtggtggcatcacgcctgtaatcccagcactttgggaggccgacggcgggtggatcacgagctcaggagatcgagaccatcctggcgtaacacggtgaaaccccgtcgtctactgaaaatactaaagaattagccgggcgtggtggcgggcgctctgtagtcccagctatcttgggaggctgaggcacggagaatggcgtgaacccgggagacggagctgcagtgtgccgagtggccaatcacctccagctggcgacagacatc

SEQ ID NO: 706165 - DNA, 731 bp, Homo sapiens
gggtcccttcccccttgcggcgcgcggtcccaaattgaccctgggtctcttgaaaaaatttctgcttgccagctcccacttcaccgacttttagactaaataatcaagtatttacagtgtatggagtatttgtctattagcacctatattagtttcacagggctatttagacaaatgtgaatgcataaaaagcataaaactacaaagcaaaacccaagtttagaaggaaaattagctactaaagtatatgcaaaagattattttaggaaagaatttccccaatgaagtgagaaacaagacaataagaaatagaaagttgaagaagatggcataaataggcaatcacagtagagtagaaaagatggatgagaaacgtgaacacaatggaagtaagtcaagaaaacgctattttcagcacatcaagtagccaaaatgttaagataaggtcttgctattcggatggaatgtgtaactatgtagattggcatgggtaattttgcacataaactttgatcatcatgtgtacttctaggaatctatttcagagaaattgtgcacaagcaccccgaaatatatatgggtacatagtagtgtagcgtgtagttcattcatgcgaataaatatttgtgtgaacagtcctatatgtcaggtattatactaattctagggtataacacaattgtgcttgacaattgttattgcgtagaagttgttataaacagcaaatatgg

SEQ ID NO: 706166 - DNA, 670 bp, Homo sapiens
  misc_feature (528)..(528): n is a, c, g, or t
  misc_feature (619)..(619): n is a, c, g, or t
gccatgacccccgtgcccaggggcccctgtgaaatactgtaaaggtgggaatgtaaaaaaggaggtcctagaatttgtagaatgtaaggaagggaggaaaaattcaatctgataagtgttcattgatcttctaatgggttagaagcactcagccacataacaacaacaacattgataactaactgagtagttaatatggtcaggcgctattctgagggtttacattcattaactcactttattctcacaaatatgtcttgaggtaggtactatcatgttcaccatttcacatgagagatacttacatctttttacatacacagagatcttaagcactttgatccagttcccacagctatgaagtagtagggctaccttccaatccagaaagtctggatccaagactgtttattcactgtcctattcaccctattttgtgaaggaaaagaccaagttgaaattcttcaagagttcggtgtctaataacggagccagatctatatttctatacattattacaacacaagngtggtgggagcccggaactacttactgtctctacttggactcaatcgatggcaatgcttacacaatgcccccttctgagaaccttataggnttctatattaatgtcacatacacacgctttatatttttatttggtttgggg

SEQ ID NO: 706167 - DNA, 713 bp, Homo sapiens
atggctttgtccacccagacccactctggatcccattcaaagaggtggcagtgaccctcatttaccaactggcagagtggcccctgaagtgatcttgtgcccagatattgcagtggctgtgcaaaacatgtgccctggagaatgctagaagagaagagaaccatgtcatggatgtgaccctgaagtgagtcccccgcaatgctccccactttcctgttgatgaacctgctgtcccttggctggtgtgatgtgtgctctgcaagcatgctggtccacttgtgagcatgtgcatgtgatgtgtgatgatgctcttgcctgtgctgcctgatgttctcctgtgtgaatgaacatgtgatgcacaatgaccaaatgatcccaatggtgatgaagaatactgtgctctgagacacaccatgtgatgtgagtgatgctcggtgttgcttggtttgtgtgtgcaagcatgcaagattgacacatgatgtgcatgaactaatcctgtggcatacttgctgatgatggaacttgtttggattggcaaacatgacactggctgcctttgttccactcttgcttaagagtcttgtaacaacccagtgcctctatagcaacccatgacctctctgcagctgcttcacttgcccttggcaagtactgcatgatcagttgcacctttcttgcgactcccagcttcggctactgttcaccatgctgga

SEQ ID NO: 706168 - DNA, 1615 bp, Homo sapiens
  misc_feature (1602)..(1602): n is a, c, g, or t
  misc_feature (1605)..(1605): n is a, c, g, or t
cagtagtccttggggcggaactggccccccgtggcccggcccggctcggccccacctccgcccgcaggcggtcccggcccacgcgggaaggtccttaagcccgggcggccggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgatcaactggctgtcactggtctacctcgtggtatccaccccatttggcgtggcggccatctggatcctggactccgtcgggctccgtgcggcgctcggtgtctataccatccctgctggcgtcgtctgcctgctgtccaccatctgcctgtgggagagtgtgccccccaccccgccctctgccggggctgccagctccacctcagagaagttcctggatgggctcaagccgctgctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgcgggcgggggcgaaagggctccttgcgggctccgggagcgaattacaagcgcgcacctgcancgncaaaaaaaaa

SEQ ID NO: 706169 - DNA, 2773 bp, Homo sapiens
  misc_feature (715)..(715): n is a, c, g, or t
cagtagtccttggggcggaactggccccccgtggcccggcccggctcggccccacctccgcccgcaggcggtcccggcccacgcgggaaggtccttaagcccgggcggccggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgaccatcctgggtgcgtggctgaactttgccgggagtgtgctacgcatggtgccctgcatggttgttgggacccaaaacccatttgccttcctcatgggtggccagagcctctgtgcccttgcccagagcctggtcatcttctctccagccaagctggctgccttgtggttcccagagcaccagcgagccacggcaacatgctcgccaccatgtcgaaccctctgggcgtccttgtggccaatgtgctgtcccctgtgctggtcaagaagggtgangacattccgttaatgctcggtgtctataccatccctgctggcgtcgtctgcctgctgtccaccatctgcctgtgggagagtgtgccccccaccccgccctctgccggggctgccagctccacctcagagaagttcctggatgggctcaagccgctgctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccaccccttctgtcgtcttcttgtcagcctgggacatcagcagacgcttgatgtactccttgttgattttccctttcccgtccgggtccagcatcttgaaggcgttaagaatggtctcctcggcgtcggtaccgctcagcttctccccaaacaggttcagaaacatggtgaagttgatgggccccgaggcctctttgagcatggcgtccagctcgtcgtccttgacgttggtcttgcccagggaggcataggtgtccttcaggtcctccttgtcaatgaagccatctcggttctgatccatgagtgtgaatgcctccttgaactcctggatctgagtctgctcaaagttggagaagacattggatgaggctctctgggcccggagggcacccccttccttcttcttggtcttcctgctggccatgcctgcttctgcctgctttgatgcgtctgcccagggccccaggtcttgcccatcttaagctcctgcttggtcccccaggacagttcagactccggctgccactccctacaaggacaggcttggggctaccccaggggactggacagctgcagagtgagctttggcagcctggcagtgactcacacccttgccctgcctcaccccgcaaggcccccagcctccccagatacctctggccaggactacctcccatccacctgtccccgaaccccggggaggctttgttctcccaaggattctgtgtgtcagcagggccacctgtacacgctcttggctgggggcctgggcaccctggaactgcaggagccagaggaaggggcactttttctagatttgcacaacgctgctgtgggtgactgcagctggtcaccgggcttctgccaagcacactctgtctgtc

SEQ ID NO: 706170 - DNA, 2433 bp, Homo sapiens
  misc_feature (2)..(2): n is a, c, g, or t
gngacacaaaagaacaagatgaaaaaaagaggcaggaaccggaccggaaaacccgggaacggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgctcggtgtctataccatccctgctggcgtcgtctgcctgctgtccaccatctgcctgtgggagagtgtgccccccaccccgccctctgccggggctgccagctccacctcagagaagttcctggatgggctcaagccgctgctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccaccccttctgtcgtcttcttgtcagcctgggacatcagcagacgcttgatgtactccttgttgattttccctttcccgtccgggtccagcatcttgaaggcgttaagaatggtctcctcggcgtcggtaccgctcagcttctccccaaacaggttcagaaacatggtgaagttgatgggccccgaggcctctttgagcatggcgtccagctcgtcgtccttgacgttggtcttgcccagggaggcataggtgtccttcaggtcctccttgtcaatgaagccatctcggttctgatccatgagtgtgaatgcctccttgaactcctggatctgagtctgctcaaagttggagaagacattggatgaggctctctgggcccggagggcacccccttccttcttcttggtcttcctgctggccatgcctgcttctgcctgctttgatgcgtctgcccagggccccaggtcttgcccatcttaagctcctgcttggtcccccaggacagttcagactccggctgccactccctacaaggacaggcttggggctaccccaggggactggacagctgcagagtgagctttggcagcctggcagtgactcacacccttgccctgcctcaccccgcaaggcccccagcctccccagatacctctggccaggactacctcccatccacctgtccccgaaccccggggaggctttgttctcccaaggattctgtgtgtcagcagggccacctgtacacgctcttggctgggggcctgggcaccctggaactgcaggagccagaggaaggggcactttttctagatttgcacaacgctgctgtgggtgactgcagctggtcaccgggcttctgccaagcacactctgtctgtc

SEQ ID NO: 706171 - DNA, 353 bp, Homo sapiens
ggttaacccaaaacctcccgcattggggaggcaccccctgaagtacttccttcagggtttcccctttgtgagggggtggagaaacccccccggcctgtttggaggaacaactggctttgcttttaaaaaatttggcaagggggccccatttttttgcccttaggattccccgctctttcctacaacccccagggctggggtcctaaaaagaccttgggtggtaaaactgtacttggtgggagtgagggggtggggaggaaccatgcaaatccccttccatggtttttaaaagcagtaaaaaacatttttggatgagacttgtttccaaaaaaaaccagctaaatttgttttta

SEQ ID NO: 706172 - DNA, 2483 bp, Homo sapiens
cagtagtccttggggcggaactggccccccgtggcccggcccggctcggccccacctccgcccgcaggcggtcccggcccacgcgggaaggtccttaagcccgggcggccggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgctcggtgtctataccatccctgctggcgtcgtctgcctgctgtccaccatctgcctgtgggagagtgtgccccccaccccgccctctgccggggctgccagctccacctcagagaagttcctggatgggctcaagccgctgctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccaccccttctgtcgtcttcttgtcagcctgggacatcagcagacgcttgatgtactccttgttgattttccctttcccgtccgggtccagcatcttgaaggcgttaagaatggtctcctcggcgtcggtaccgctcagcttctccccaaacaggttcagaaacatggtgaagttgatgggccccgaggcctctttgagcatggcgtccagctcgtcgtccttgacgttggtcttgcccagggaggcataggtgtccttcaggtcctccttgtcaatgaagccatctcggttctgatccatgagtgtgaatgcctccttgaactcctggatctgagtctgctcaaagttggagaagacattggatgaggctctctgggcccggagggcacccccttccttcttcttggtcttcctgctggccatgcctgcttctgcctgctttgatgcgtctgcccagggccccaggtcttgcccatcttaagctcctgcttggtcccccaggacagttcagactccggctgccactccctacaaggacaggcttggggctaccccaggggactggacagctgcagagtgagctttggcagcctggcagtgactcacacccttgccctgcctcaccccgcaaggcccccagcctccccagatacctctggccaggactacctcccatccacctgtccccgaaccccggggaggctttgttctcccaaggattctgtgtgtcagcagggccacctgtacacgctcttggctgggggcctgggcaccctggaactgcaggagccagaggaaggggcactttttctagatttgcacaacgctgctgtgggtgactgcagctggtcaccgggcttctgccaagcacactctgtctgtc

SEQ ID NO: 706173 - DNA, 170 bp, Homo sapiens
ccctatagtatactgccttcaacacagacaggagagggaaaaaaacactagacaccagcaggggagcaggtgagacaggggcactcgaggctgcagtgggagccatgggaacactatacaagggcacaagttttccaactaatgaactcctaaacctaaatcgacttctt

SEQ ID NO: 706174 - DNA, 2275 bp, Homo sapiens
cggggacaggtggctccgggaccctcagtccctcggaccagccgggtttgttttcctgtggccacagcccgagctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgctcggtgtctataccatccctgctggcgtcgtctgcctgctgtccaccatctgcctgtgggagagtgtgccccccaccccgccctctgccggggctgccagctccacctcagagaagttcctggatgggctcaagccgctgctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccaccccttctgtcgtcttcttgtcagcctgggacatcagcagacgcttgatgtactccttgttgattttccctttcccgtccgggtccagcatcttgaaggcgttaagaatggtctcctcggcgtcggtaccgctcagcttctccccaaacaggttcagaaacatggtgaagttgatgggccccgaggcctctttgagcatggcgtccagctcgtcgtccttgacgttggtcttgcccagggaggcataggtgtccttcaggtcctccttgtcaatgaagccatctcggttctgatccatgagtgtgaatgcctccttgaactcctggatctgagtctgctcaaagttggagaagacattggatgaggctctctgggcccggagggcacccccttccttcttcttggtcttcctgctggccatgcctgcttctgcctgctttgatgcgtctgcccagggccccaggtcttgcccatcttaagctcctgcttggtcccccaggacagttcagactccggctgccactccctacaaggacaggcttggggctaccccaggggactggacagctgcagagtgagctttggcagcctggcagtgactcacacccttgccctgcctcaccccgcaaggcccccagcctccccagatacctctggccaggactacctcccatccacctgtccccgaaccccggggaggctttgttctcccaaggattctgtgtgtcagcagggccacctgtacacgctcttggctgggggcctgggcaccctggaactgcaggagccagaggaaggggcactttttctagatttgcacaacgctgctgtgggtgactgcagctggtcaccgggcttctgccaagcacactctgtctgtc

SEQ ID NO: 706175 - DNA, 80 bp, Homo sapiens
ctcagggagccttatcaagctggaccatgtccatgtcgtgtgagtgacatgtcacaacctggtctgggcacaaaaggcag

SEQ ID NO: 706176 - DNA, 1940 bp, Homo sapiens
  misc_feature (715)..(715): n is a, c, g, or t
cagtagtccttggggcggaactggccccccgtggcccggcccggctcggccccacctccgcccgcaggcggtcccggcccacgcgggaaggtccttaagcccgggcggccggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgaccatcctgggtgcgtggctgaactttgccgggagtgtgctacgcatggtgccctgcatggttgttgggacccaaaacccatttgccttcctcatgggtggccagagcctctgtgcccttgcccagagcctggtcatcttctctccagccaagctggctgccttgtggttcccagagcaccagcgagccacggcaacatgctcgccaccatgtcgaaccctctgggcgtccttgtggccaatgtgctgtcccctgtgctggtcaagaagggtgangacattccgttaatgctcggtgtctataccatccctgctggcgtcgtctgcctgctgtccaccatctgcctgtgggagagtgtgccccccaccccgccctctgccggggctgccagctccacctcagagaagttcctggatgggctcaagccgctgctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccaccccttctgtcgtcttctaacagccgtatagtagtagtaggcggccgc

SEQ ID NO: 706177 - DNA, 2288 bp, Homo sapiens
  misc_feature (715)..(715): n is a, c, g, or t
cagtagtccttggggcggaactggccccccgtggcccggcccggctcggccccacctccgcccgcaggcggtcccggcccacgcgggaaggtccttaagcccgggcggccggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgaccatcctgggtgcgtggctgaactttgccgggagtgtgctacgcatggtgccctgcatggttgttgggacccaaaacccatttgccttcctcatgggtggccagagcctctgtgcccttgcccagagcctggtcatcttctctccagccaagctggctgccttgtggttcccagagcaccagcgagccacggcaacatgctcgccaccatgtcgaaccctctgggcgtccttgtggccaatgtgctgtcccctgtgctggtcaagaagggtgangacattccgttaatgctcggtgtctataccatccctgctggcgtcgtctgcctgctgtccaccatctgcctgtgggagagtgtgccccccaccccgccctctgccggggctgccagctccacctcagagaagttcctggatgggctcaagccgctgctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccaccccttctgtcgtcttcttgtcagcctgggacatcagcagacgcttgatgctgaggacgaggaaaggggtcagcgcgggctgatgcgggggtgcaggagccttctcggtggggctcaggtgctccaggggccccaggttgtactcgctcactgcactcccgcccttcccgctggagtgtggccctggggcaggtcccttcccaacacacactcaggggccatcacttctgggggagccgctgatggggacagagccggaaggaggttacaggccagcgcctggtactttccccggcgcctagcaggagctgaagatggaggagtgggctgaggggaagccgccccacccccaccgggcacaggcgctggtccctgtgtgagcagggctggcctccc

SEQ ID NO: 706178 - DNA, 112 bp, Homo sapiens
tttacctagatcccataacaaagcccgctactgatgtgagaccaacatcaaagaggccccgcttggagggtgttggtatgggatctaggtattaaccacctgtggaaaagta

SEQ ID NO: 706179 - DNA, 2757 bp, Homo sapiens
  misc_feature (715)..(715): n is a, c, g, or t
cagtagtccttggggcggaactggccccccgtggcccggcccggctcggccccacctccgcccgcaggcggtcccggcccacgcgggaaggtccttaagcccgggcggccggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgaccatcctgggtgcgtggctgaactttgccgggagtgtgctacgcatggtgccctgcatggttgttgggacccaaaacccatttgccttcctcatgggtggccagagcctctgtgcccttgcccagagcctggtcatcttctctccagccaagctggctgccttgtggttcccagagcaccagcgagccacggcaacatgctcgccaccatgtcgaaccctctgggcgtccttgtggccaatgtgctgtcccctgtgctggtcaagaagggtgangacattccgttaatgctcggtgtctataccatccctgctggcgtcgtctgcctgctgtccaccatctgcctgtgggagagtgtgccccccaccccgccctctgccggggctgccagctccacctcagagaagttcctggatgggctcaagccgctgctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgtcagcctgggacatcagcagacgcttgatgtactccttgttgattttccctttcccgtccgggtccagcatcttgaaggcgttaagaatggtctcctcggcgtcggtaccgctcagcttctccccaaacaggttcagaaacatggtgaagttgatgggccccgaggcctctttgagcatggcgtccagctcgtcgtccttgacgttggtcttgcccagggaggcataggtgtccttcaggtcctccttgtcaatgaagccatctcggttctgatccatgagtgtgaatgcctccttgaactcctggatctgagtctgctcaaagttggagaagacattggatgaggctctctgggcccggagggcacccccttccttcttcttggtcttcctgctggccatgcctgcttctgcctgctttgatgcgtctgcccagggccccaggtcttgcccatcttaagctcctgcttggtcccccaggacagttcagactccggctgccactccctacaaggacaggcttggggctaccccaggggactggacagctgcagagtgagctttggcagcctggcagtgactcacacccttgccctgcctcaccccgcaaggcccccagcctccccagatacctctggccaggactacctcccatccacctgtccccgaaccccggggaggctttgttctcccaaggattctgtgtgtcagcagggccacctgtacacgctcttggctgggggcctgggcaccctggaactgcaggagccagaggaaggggcactttttctagatttgcacaacgctgctgtgggtgactgcagctggtcaccgggcttctgccaagcacactctgtctgtc

SEQ ID NO: 706180 - DNA, 983 bp, Homo sapiens
tcaccttgcagcttcagggccgttggtgggcctctgaggcgcgggccctggctccattcgaggaggggccgcggcgtctggagctggaggacctctgtgttcgcctcctccaagggctctgaggcgttctgcctgggtacctacccagggaggcataggtgtccttcaggtcctccttgtcaatgaagccatctcggttctgatccatgagtgtgaatgcctggggaccaaggtcagggctgctgtgctgccaacccggctgggctctgccccgccccctgctcccggttcctcagcacccctgactgaggataggcttccactcctgctggccctggagccagcccacatggggtcttcccagcacaggctcctgggggtgggggctcccagtgaagcaggaaagtctcacctccttgaactcctggatctgagtctgctcaaagttggagaagacattggatgaggctctctgggcccggagggcacccccttccttcttcttggtcttcctgctggccatgcctgcttctgcctgctttgatgcgtctgcccagggccccaggtcttgcccatcttaagctcctgcttggtcccccaggacagttcagactccggctgccactccctacaaggacaggcttggggctaccccaggggactggacagctgcagagtgagctttggcagcctggcagtgactcacacccttgccctgcctcaccccgcaaggcccccagcctccccagatacctctggccaggactacctcccatccacctgtccccgaaccccggggaggctttgttctcccaaggattctgtgtgtcagcagggccacctgtacacgctcttggctgggggcctgggcaccctggaactgcaggagccagaggaaggggcactttttctagatttgcacaacgctgctgtgggtgactgcagctggtcaccgggcttctgccaagcacactctgtctgtc

SEQ ID NO: 706181 - DNA, 135 bp, Homo sapiens
ccaaaaccagacaactatgtgactgagcggctgatcagcatggcctatgggcagatcggaatgatccaggccctgggaggcttcttatactataacttatgtagatatctggctagagaacaggcttcctaccca

SEQ ID NO: 706182 - DNA, 107 bp, Homo sapiens
ctccagtttatacccgaaatacgtggaactcatcaaccaggcgtgcccggctcaatggctatgtaggatagcaggcgactcgttggcggtctatgtacgagacacca

SEQ ID NO: 706183 - DNA, 110 bp, Homo sapiens
aaataaatgttacgtaatcgcaaattaggaggggtaccatttctgttggtgtatttgccaaggctgttcaggcgtccctatcgtagcgatcttcagtgactactgagcaa

SEQ ID NO: 706184 - DNA, 118 bp, Homo sapiens
caagttcataaaagttcttgagccctaaatttcttcccaaaaaaagaaaagttcttaagtcatccattttaattgtgtagaggttgttcacctgaaggaataaatgtctattaaccta

SEQ ID NO: 706185 - DNA, 296 bp, Homo sapiens
gtgcctgtagaggccctaacaatcacaaactatgctcaactcactctctacatttctcataacttccaaaatctattttcttcctcatacctgatgcatatactttctgctccctgcctccttcagctgtactcactctttaagtcctacaattaccattgctcctgacccgtacttcaataagtgctcttgcaaagccagatctcaggagatccacaatcatgccacctctacgaggcccaaaagggtctaagtcttctcccccgacaacaaacggtcccaggtatatcacacca

SEQ ID NO: 706186 - DNA, 440 bp, Homo sapiens
  misc_feature (2)..(2): n is a, c, g, or t
  misc_feature (13)..(13): n is a, c, g, or t
gncaaaaccgggnaaataactacttattattttttattgagacgggtctcactttgtcacccaggctggagtgcagtggtacatctcagctcactccaacttccgcttcctgggctcagtgttaatttttgtatttttactacagacagggtttcactatgttggccggcaggtctccaactcctaacctcagtgatccgcccattcgcctctcaaagtcagggattacaggtgtgagccactgtgcccggcctcctcagtccatttttaatactgaaggtataaattgtataaagatgtttagaaagttctaattcattttatgcatttttgcaaatttgactccatgaaagtgcattatcacgaagctgaatttgtgtaagcattgtgcatgtatgtaaaaacattgcaacttcctcaataaaatatcttctttttat

SEQ ID NO: 706187 - DNA, 384 bp, Homo sapiens
atctctagacggatccccccctcgaaacccagtctcttacatttcatctgttaaatagtgacggtgtattagtctgttcttgcactactacaaatgattagtttagactgggttatccattatcgataagaggtttatttcactcttgattccgctggctgcacagtgaagcactgcagcatctactctgcttctgaggccgttctctggaaacctacaatcaacgtggaaggcgacagggtgaagcagacatgttttatgtggctggaggaatagtaagagaagtggggggaggtgccacacactttaacaaccaggtctctttataactccatcacaacagccccacgaggatggtgctaatccattcatgaaggatccaac

SEQ ID NO: 706188 - DNA, 710 bp, Homo sapiens
ggaattgatgatcaggattagcagaattccgtgacgcacaccgaccctggctgtcactgtagatgggggtcgctgtgcgtcgttgacattcctggctatatccgtgcatcagtcatagcgagtgaccctagcgcagggtcggtgtggcgacgcgttccttcgaccacctacggaccgggcttggtcatcaggactgtgtccagcgaggacgtgtgggagatgcgcaatcatcttaacagaaatagcacccagtttgatagctggtaggtgtcagtggacaacagcgtcgtttctgtccatcagattacctggtgcagtgtagcccgccgcgtgacccgtggtatggttgtgtgagagagcgctacactgtgctgtgtatagctcacgtgcacacggtgcttcaagcacaatcggggctcaactagtgcatcggctagagtcatgatcctcacacgtgggtgtctactcgcggtatgccgagattagaagcgacgcagagaacggcataccgtgccagagtcaccttgtgccaactgttctctagaccttctgacatttcgctcgaattgagagggagcacatggcgtgcagttggtcggtcaagacggcatgagtccatggcagagtgtcacgagcctcaaccaggtatcgtgccgagtctggcagaggtggtaagggtgaagagtcatgggagtactccctgggtggat

SEQ ID NO: 706189 - DNA, 298 bp, Homo sapiens
cccacagcaagagtacaaggggccttgccccaacccagagcgggggcaatcattaagccagccaagcaagtgtggcgtatgagacccacagaaggaacagggaatattctgggggttcaagtcccggcgtggtaacccatgtgcctctgggcaagtttattccaatgggaattctgaggcacagaaagtttaattgacttgccacaggtatatgaacatagacagtgtcaggtctggtatttgaacacagacagtgtgggtagtaactgtatatagtgtccacacttgattgcttgtt

SEQ ID NO: 706190 - DNA, 128 bp, Homo sapiens
gtctacatagtgttcatatctgaggggacacagtaattacaaacttactatggccccggaaaaactctcccctaccctctccccagctcttccaagctcttccttctctccttaatgacattaacact

SEQ ID NO: 706191 - DNA, 1108 bp, Homo sapiens
acaaagagacttgcaacgctaatatcgcatattagtcctgtggatgatctggagtcctatgcagcaactctcaggattctcttttccatcctgctctgggtcactctagcgaactactaagtaataacgatatgtctgcagacgtccttctcaccgcctagtgctttccgtaactagagtgtcccgttcataggctatatgtactgcattcatagattctgtcaggcatcttgtgtgaactgacttagctctgcccataaataatcgaggagcgcaccacagggtatgacacgttgtaacccagcaaatatcacaaacaataaggatatcatggacatcatgtaccatccccctcgtgttccatcactcctggcctcgtgatcatggtaatcaagtgggcagagccggagcttcgcgaggcaagagtttgagataaggactaccactcaccataagttcaaggggtagagctattcgcgcacgcttggagaaacagtttgcgtgagcatcctaagccattgttgcatacggtataactgggctcagaacaggttgctactgcgtacgaatactatagctggcgccatacaagtttgcatgcgatgaatgaatgtatgctaatcataagggaaacccctgaactaatctatccccaagcaatcaaaaggaccccacttcttttccgtacatgaatccgcctactaaattcccaagtgcaggtggcttactgtcatcagaaatttaacctcctctaggtcactagggatgtattagctagtacaactgatatggtacatagagctagacacggtaaacccatacgaaacaggtgagtgtatacgtggagaaagcccggtcgtgcagggaggggacggatcacccaattcatataccaaatcagcgttgtgcctgagtttggcaggaaacaatcgctggaagttgtgatcattcttgaatctgaagaaagggcttccggacaatagaatctacccatgagaaattactcggagtcccgaacccgagaaaggtgctattggtaacctagaggaagtgggaaaaatattggaagaggcacggaggagaaaaacattataaaaagaccacagag

SEQ ID NO: 706192 - DNA, 120 bp, Homo sapiens
  misc_feature (25)..(25): n is a, c, g, or t
  misc_feature (31)..(31): n is a, c, g, or t
ggtttcatggtttggtctaactttnaacgcntactaaatccgcgattggtttcgctgaatcaggttattaaagagattatttgtctccagccacctaaaggaggtgatttatgtttggtg

SEQ ID NO: 706193 - DNA, 1020 bp, Homo sapiens
agcggctctcttgttgctcaagccccttagtgtgatctcctcatctccatcatcccagatggcaaaaatgcagggaaggagaagctcaccatgttaaaacgggaacttgtgaggtggtggcactccacagatgctgtaataagaacaagatagaagaacggtcacaaacagtcaagtgctcctgcttccctgggcaggtggcaggcaccacgcgagctgctccatcatgtgtggatgcttcaatagtggaacagaaatggtggtgccatatgcagccatgtctagagggagaagaatgtaaagttcttccggatcggaaaggatggagctgttcctctgggaataaagtcaaaacaactagggtaacccattaacccaggagaaatcaagtgatcctcaaggctgatgacattgaacatgcgcatagaaacttaactcaactcctgaggtgatcttgaagatttttataccacttgaaagaggcgctcaatagtctatttccaagggatttcatggcctcttcttgaaatcaagactttttaaaagtcagacatgaacttgcatgtcatgaagatttcagcagatttgaactgtgttcaacttgtaaatgttaaaagaatttgaagtcactgtctgaggagctggtgaagagttgttttttcagggtgatgttagagacagtcaccttttgagttattggctccagatgtgactacttttcttgtttctgcagctgtatcccaagtgcactgtccttctgtcctggatgtgttcctgggtcctatgttcatttgctagtgggactacacatggctttaatgacatttcctttgagaacttttcctctggcatggtgtagactgagacaattttatttatatcctaatcttggagctcagaaagcctacatgttttaacatcttaaagttgcttttgttaaaggaatggaaatatatatccattggtaataatgttggcaagtaatagttatctgaataaatcaatcatataagaatgaaa

SEQ ID NO: 706194 - DNA, 137 bp, Homo sapiens
gtgaagagtcacttttcagccccaggaagggcaaaagaagagagaaaatcagcctgtctgctctctccttgagctcaacaaggcctctaacagtcttactgtcctctattctgcacacggcatatttgggcacgaga

SEQ ID NO: 706195 - DNA, 447 bp, Homo sapiens
aacctattattttgagagggagaacctcttggtagtttctacgagcactgtatagttatttcagtgcgctgaacagccggggcaggtctacataccacaccacttacatcatgtccatggaaaaagtgcggggatccaggtcacctaccaagcaattccaacgtgcagccaagtaagagaaccagtaagttagaggagcaatcctcagcccaggtcacctatttaaatcatactgcgtgcttgggagaaataccagtagccaaaaaacagcaaaacaatgccagggccccactcccagacgttctcatttaattggcttggagtaaggcctgagcattgggatttttgaaagtcccccaggtaggattttaataagcagccagggtcgagaagctctgagctggaaggcaatgactgatcatagccaggtggtggtcacatttgcca

SEQ ID NO: 706196 - DNA, 401 bp, Homo sapiens
  misc_feature (1)..(1): n is a, c, g, or t
ngcattctttccatttttttcttctttctggatgttaaatctgagtaaatatatatcatttttaaagtggaattatgacccaggcatggtgcctcttgcctataatcctagcacttttggcaagccaaggcaggaagattgcttgagcccaggagttcaacaccagcctgggcaacatggcaaaactccatctctacaaaaagtacaaaaatgagccaggtgttgtggggtgcgcctgtagtcccagctaaggaggctgagattgggaggatcacttgaacccaaaaggtggaggctgcagtgagctgagatcgtaccactacactccagcctgagtgacacagtgacagcctgtctcaaaaatataaaaataaataaataaataaagtggaattatgttg

SEQ ID NO: 706197 - DNA, 241 bp, Homo sapiens
aagactgtacgctaagacagtgctgtaggcggcaccaacatgtaccctggcatagccgacaggatgcaaaaggagatcactgccctggcacccagcacaatgaagatcaagatcatatgctcctccatgagcgcaagtactccgcagtggatacggcggctccatccgaggcctcgactgtccacctatccagacagatgtggatcagccaagcagtgagtatgcacgagtcctggcccct

SEQ ID NO: 706198 - DNA, 152 bp, Homo sapiens
agatgtgtcatccagatgaccccgtctaggagacagactcaccgtcacttgccaggcgactatttgaattcttaccagtgagaaccggggacagccccttacctcctcatctgcgctgcatccaattacagaacaggggtcccttctacctt

SEQ ID NO: 706199 - DNA, 317 bp, Homo sapiens
  misc_feature (51)..(51): n is a, c, g, or t
  misc_feature (96)..(96): n is a, c, g, or t
gcccatgatcctacagacagcccatttataaaggtggatcagggcccgganacggtggctcaacgtctgtaatcccggcactgtgggaggccaaancgggaggatcgcttgagccccaggagttcgagaccaacctggccaacatggtgagaccccatctttacaaaaaaatatatatatcccaggcatagtggtgtgcacctgtggtcctgtggtcccagctactcaggaagctgaggcagttgaggctgcagtgagccacgttctggccactacactccagcctgggcatacaaagtgacaagtaccaaaaaaaa

SEQ ID NO: 706200 - DNA, 874 bp, Homo sapiens
gatagcattaggaaaaatacctaatgtaaatgacgagtgatgggtgcagcaaactaacacggcacatgtatacctatgtaacaaacctgcacgtgtgcacatgtaccctagaacttaaagtataataataaaaaatatgtatatataaaagaaatgtggctagcataaatttagatatgctataagtataaattacacaccacatttcgaagactcagtatgagaaaatatatacaatatctcatcaataatttttacatcaattatagggtgaaataatatttcacatacatggggttaaatgaaatatatgacaattaaatttacttttttttctttttacttttttaatatggctaccataaaatcttaaattacatatgtggctcacatcatatttatactggagagagtgtgtactagagcatgttgtatgctaatataatgatctagtagagaatcaggaatggatgatgtcgaacagagaagagtagggaaaaagagaaaagacctttagagcttaagcagataaggggtgatggcattcattacattagatcaacaaaacaagttagagaaagggcatgtacatagataatattggggtttcctttataccagaaagactcactcttttaaacaggcatgaagcagtattaaacctttatcaggctagtccgaataaattcaatttctaagtacgatcaatggtatcaacaaggaattgttgaaagaggataatctatatggttaaacggttcaacatctgttaaggggtcgttgacagggtggtcagggaacctcagttggaagagtaaggaaaggcggtcaataggaggggaccgagaaaaaaaagggcgatagggaaaaaata

SEQ ID NO: 706201 - DNA, 855 bp, Homo sapiens
catacccatggccaactcctactcctcatggtacccattctaatcgcaatggatcctaatgcttaccgaacgaaaaattctaggctatatacaatacgcaaaggccccaacgttgtaggcccctacggctactacaacccttcgtgacgcataaaattcttcacaaagagcccctaaaacggcaatctaccatcaccctctaatcaccgccgaccttagctctcaccatcgctcttctactatgaacctcccctcccataccaacccctgttcaacctcaaacctaggcctcctatttattctagccaactctagcctagcgtgtttactcaatcctctgatcagggtgagcatcaaatcaaataacgccgtgatcggcgcactggagcaggtagcccaaacaatctcatatgaggtcaccctagccatcattctactatcagcatactaataagggtccttaaactctcaacccttatcaagaagagaaaactctggtaatctgcataatgaccttgcataataatgtttatctccacatttagaagagaccaacggaaccccttcgaacctgggcgagggggagtccgacctagtctaaggttgcagaatcgatacgcgaggccttcgctatttaaagggatacaaacttttataatagcctcacataatctctaggacacttgggtctcctgattacaatatttgccagccattaccccgttgagtgaagaccggtggagcaacacccttagagtcaccaccagatttaggccagattcgccaaaaaaaaagggggaatgggggattcgcggcacccccgcccgcaacgaaacaaccacaggagagggaacg

SEQ ID NO: 706202 - DNA, 160 bp, Homo sapiens
taaaaaaaaaaaaaaaaaaaaaaaaaaaaaaaaaaaattttttttttccaaacccggggggctgttttcccccgaaaaccccaaaattaaattcaaaaggggttcccatttggaaagctttaaaaattcccaagggaggtgggatccttttgggccccca

SEQ ID NO: 706203 - DNA, 327 bp, Homo sapiens
  misc_feature (264)..(264): n is a, c, g, or t
  misc_feature (304)..(304): n is a, c, g, or t
  misc_feature (320)..(320): n is a, c, g, or t
taattaaaaattcctatgtcaaaaaacgtggttaaagcaaatgttaaaccttcccccacaaattgaaaaaattggcttggaaagttcccaaattggcggggggggcaacgaaaaacaatttcccaaatttcaaaattgctaattttttgtaaaaaaaaaattgggaaaaatttaaaaaaaaaaaaaaaaaaaaagggcggccccctttttttttttttttttttttttaatatttttttttttttttttttttttttttaagtnaccagcttcagacccttgtaaagtctccctcagcccttcnaaaaaataataaattncctgtga

SEQ ID NO: 706204 - DNA, 141 bp, Homo sapiens
gaccgaccaatcataatacgtatcggtatagaatggggtctcctcctccggcggtgtcgaacaatgtggtgttgaggttgcagtctgttagtaatatagtgatgcctgcagctcggactgttagagatcggagaagtaaga

SEQ ID NO: 706205 - DNA, 357 bp, Homo sapiens
actagttctagatcgcgagcggctgcccttttttttttgttgtttcagtctggatgtagctttaatggagtaaaggaaaaagggaattcagccgcatgatacagaggtcccaggtggactcagagggggcaaacacccttccgggtcgtgcggtgaggggaaccgcaccagcacagggggcacgcggaagccacgtgccgcagggagagtggttcccactctcacgcacagtgagcagcctccgggctcagttcccaagaaggccaagggcagagggcagtgggtggcctctcacagagctactttacaaattaaagcgggggtgtctctcctcgaggagtctcttacaacactttt

SEQ ID NO: 706206 - DNA, 233 bp, Homo sapiens
gcaggagaattgcttgaactcgggagggggaggttgcagtgagctgagatcatgccactgcactccagcctgggtgacagggcaagactctgtctcaaaaaaaaaaaaaaaaattttctggcccggccccagataacctttgaaaacatgtggctagtttaaagccggcaataaaaaaccccgattgatcccttccatataaaatttccaggggggctcacatttgaaacccc

SEQ ID NO: 706207 - DNA, 577 bp, Homo sapiens
  misc_feature (18)..(18): n is a, c, g, or t
  misc_feature (73)..(73): n is a, c, g, or t
  misc_feature (82)..(82): n is a, c, g, or t
  misc_feature (108)..(108): n is a, c, g, or t
  misc_feature (132)..(132): n is a, c, g, or t
  misc_feature (141)..(141): n is a, c, g, or t
  misc_feature (169)..(170): n is a, c, g, or t
  misc_feature (179)..(179): n is a, c, g, or t
  misc_feature (241)..(241): n is a, c, g, or t
  misc_feature (257)..(257): n is a, c, g, or t
  misc_feature (285)..(285): n is a, c, g, or t
  misc_feature (292)..(292): n is a, c, g, or t
  misc_feature (348)..(348): n is a, c, g, or t
  misc_feature (364)..(364): n is a, c, g, or t
  misc_feature (370)..(370): n is a, c, g, or t
  misc_feature (389)..(389): n is a, c, g, or t
  misc_feature (392)..(392): n is a, c, g, or t
  misc_feature (456)..(456): n is a, c, g, or t
  misc_feature (539)..(539): n is a, c, g, or t
gggggggttcctaaacantcatgttcattacttcctcacattctaacttgttagaattagaaaaatggttttnatgtaaacngtgttgttctaatcactgacaacatnttaattttaaacacttttgatccnaaccccccnccttgccgggcgggggggactggggggnnggggggggncgggggtccttgccgccacagtcagctgtttatcctcctcatgtcccctccccacccaagtnccagcttgcctggggnttgttctgggaccctaagaaccccaggntgcccanacgggcaggccagcagggccaatggtcatgcagggactgcgggagaggttcccatnatctcctgtgttaggncattcnacctgggaaaccaagggantgnggtggctggcttatttctccctctgccaacccccatctacaatgttctggggaaaacaatgagnggtggaaaaggtaacatacaaccaccttccacccacatcacttccagtgaggcagctaagtccaccaacagagcgtgggagantctttcatccaaaaatcccaacgggtcgcatgcagcga

SEQ ID NO: 706208 - DNA, 613 bp, Homo sapiens
  misc_feature (353)..(353): n is a, c, g, or t
  misc_feature (434)..(434): n is a, c, g, or t
  misc_feature (436)..(436): n is a, c, g, or t
aagttcagtgtcccctgtccaagagtaattatacctgtcacacttcttggggatgttctcctcctctgaattatatatgtataataacatgacatgtaattacctataaatgacatgacataacataacataatatctatatgttatgttatattaatgcctacctgtggtatagtggtcacaggtcaaagcagcctgtctttaaaccccacttcttctgcttaattactctggtctgaaaagtgcaattactgcatagctttgggcaagttcccaaacctctattgtgaaaacccccgtgtgctgtaacacatatgcacacacacacacacacacacacatacacaaaaacncacacacactttttggaagaacattaaagtcatctagcgtaaatattgttcttggctttcttcttctactagagtggaacncnatgttaaaagaaaggaatttgaaaaaaagaaaaaaagcaagctgggcacagtggcacaagcctgtagtcccagcaaatcaggaagctgagatggaaggatctcttgagcccaggagtttgagtttgagcctaacctgggcaacatagcaaccccttgcctctaaaaagcaaaacaaa

SEQ ID NO: 706209 - DNA, 756 bp, Homo sapiens
  misc_feature (99)..(99): n is a, c, g, or t
  misc_feature (135)..(135): n is a, c, g, or t
gctgatggccatggagaagagcaaggccacgcctggcctgcgcgcgccagcaagaagatactgctgccctgagcccagcatcctgcagtgtcatgcagnaagtacctgtgaggaccggggctgaggtgacctttngagaagatcttttcccagaagctgggtgtacctgctttactgagtcgggcagcctgaaccacctggagcgaggccacggcccttggtggaattctatgaggagatcaagaagtacgagaagctggagacggagagaggagcgtgtggcccgcagccgggagatcttctgactcatacatcatgaccgtgagctgctggcctgctcgcatcccttctcgaagagtgccactgaggcatgtccaaggccacctgtggggaacgaagcaggtgcctccggatctcttccagccatacatcgaagagactttgtcaaaacctccgaggggcacgtgttccagacaattcatcgcagagcgcataagttccacacggcttttgccagtgcgaagaaatgtggagctcaaccatccacctgaccatgaatgacttcagcgctgcatcgcaatccattgacgcgcgtcggtgcttttggccgagggtctattgagggtgcccgggacacggcttgatccacagtgacaagcgatgttaccgccaatgcaagtggcctgtgaactcaaaagcggcctccaagcatgatagccaggcggaagaaccttggccctgaaccgaagcgcatca

SEQ ID NO: 706210 - DNA, 99 bp, Homo sapiens
ctacaagcccgtttttgtaaccgaaatcactgatgacctgcacttctacgtgcaggatgtggagaccggcacccagttggagaagctgatggagaacat

SEQ ID NO: 706211 - DNA, 358 bp, Homo sapiens
gtaacacgcagtgggcattgcggaacggggtagttgaaggaataaccaaacgcagccttaaggctcatacagaaacagattcaccaaaacacctgcagtgcccgccactgggtgtggggttatgggtgattttagcattcttcctacagtaatccaagtaattcctgtgaaactgaggccccatcctaagaggatcacattctcagaaaacctgacacacaaacaaaaccatccctgagaatacctcgttttccaaagggcttctccacctgcagcctctctccacacttcacccttccctgaacacatcttccatgaactctgagttctcctgccatttggagttaggtctacctgg

SEQ ID NO: 706212 - DNA, 439 bp, Homo sapiens
gacacgctgaggaaccaaacggctccatatggtatctcagaacagtctctaacaggaaagcagaatttcatgtttcatgttgtacaagagtagaacacttaaaaaatctgtgactacttgggagtaatttaagatattcattgtcaccagttttttagttcattaatgtttggctctggagtgggggaaaaaaagtgaaggcacagtatgactgtgttgtattttcatctgtaccttttacccagcctgagcagttgtgaatagaaagtggagtgtaggctatcataggatttatcagagaaataacatgcatttttaaaacccagaactttaatcacaaaattatatatcatttagtagcaaaactttatgaataatatattaaggatacttttgatcatttcaacataggtatagcaagctggagattcggcgtgtg

SEQ ID NO: 706213 - DNA, 286 bp, Homo sapiens
gcgataaagctggcgctcgtagttggccgggtagcccaacaggtgggcaataccgaagtacatgccgccgcgccgagtgaacacctcctggcgaatcgtaccgccatggctgtagggataatccgttgcatgcttttcggcaaagtcgatgctgacctgcatcggcccgccggtgtgcaccgggttcagcccgcccaacaagtttttgcccaacggcacgcgggcaatgacctcgtcgtacagttcgctcaactgcttctcgctgcgcactgcctgcaaacgctgc

SEQ ID NO: 706214 - DNA, 109 bp, Homo sapiens
tacaatgcttaggaaaacaatttgattggtaattcatctaaaaagttgaaatcgttagcatacgacctatcaagttcactcctaggtatatccccaagataattgaaaa

SEQ ID NO: 706215 - DNA, 270 bp, Homo sapiens
tgtgctatagaggatcccacaacattggctcgacacttaggtgggtttcgatgtagcgctgcatcgagcggttgatgtgtggaaagatgtgcgggctggcgtcatgcagggtatgtcgaggtcgaagagccagatcggatgagaggcgggcatgtaagctctttcctatgcgctgcttgccaaggctgtaaaggtacggccagctgccccaccccacaacccgactttagtaatagtgcgccccaagtccctgaaagggtaccgagctcg

SEQ ID NO: 706216 - DNA, 607 bp, Homo sapiens
  misc_feature (242)..(242): n is a, c, g, or t
  misc_feature (329)..(329): n is a, c, g, or t
  misc_feature (396)..(396): n is a, c, g, or t
  misc_feature (452)..(452): n is a, c, g, or t
  misc_feature (455)..(455): n is a, c, g, or t
  misc_feature (525)..(525): n is a, c, g, or t
  misc_feature (530)..(530): n is a, c, g, or t
  misc_feature (533)..(533): n is a, c, g, or t
  misc_feature (537)..(537): n is a, c, g, or t
  misc_feature (559)..(559): n is a, c, g, or t
  misc_feature (585)..(585): n is a, c, g, or t
  misc_feature (589)..(589): n is a, c, g, or t
tgggcttggattgcccgggaaaattctcatgccccaacggaaagcaccttggcgcatacatttcttcaacgcttaaagttttctccgaaggccttcccgcggctggtaacttctctggttgaaaatctctccccacgcgcttccccgcagccaaagtggtcgctcccaggctggcgacgtcggcttcaagcttcagagttaagtaggaactggacgctgttgggtctacgcagcggcctccnacttcctcctcccaggaggcctgcgtcagagcaaggacctgagggctgcagggcaattcggtcaggtccgctgcggcctcccccggnccaggggcgcttgcgggcccgtggctgcaaccgcggcgacggctcgttggagtctacgcacggcttncttgatgaggtttcccgagagcacgagctgctggaggagccgatgcgggtcgtcgntcncggcgcgtgccccggcttaggtccatcggcgctgctgcaagcggcgggaggtgaccgcgtccctgagccnatccntcncgcnacgccccggcagcgcgctggcntgcgcgacctccgccacgcagtagtngcgncaggtggcacgcggtcgc

SEQ ID NO: 706217 - DNA, 351 bp, Homo sapiens
gcaagtccacgacgaccggcgtctctgtcgcctggctggagtgcagcggcaccatatcagctcaccgcaacctccgcctcctgtgttcaagtgattcttctgcctcagcctcccgagtagaagaacagtttcttcaacctccagaaacatggcttactgctcacttagtagtcagagccttccccttcctttctctctgcccctcacatagtctgttctctatcacatcatttcgtcttttccagaatggaaactccatagaaatggattcagtgtatcgccttcgggtctagcttctttcgcttagctcgatgcatcggacattcgtccatgttgtcacacagtttgtcg

SEQ ID NO: 706218 - DNA, 1923 bp, Homo sapiens
  misc_feature (402)..(402): n is a, c, g, or t
  misc_feature (1142)..(1142): n is a, c, g, or t
  misc_feature (1306)..(1306): n is a, c, g, or t
  misc_feature (1450)..(1450): n is a, c, g, or t
ggcgtgaatttatgtgacgcgagtacgtgtgtgctctgtgagcgtgctaggcgacagttgcatcatcattgtcactgctgtgttctgaacctggatgtgccgtgcataaaccatgagatggtgactgagacctcatcacttcactcgcattgtcaaacctccaagagacactccaatgcgcgtacgctgtgactgcatgaaaggcgtagacgaatctggtctactctcttccttaacgagcccacgaggctcgggaatgccctagagtcccttcgtacctttgacctagttccgtctacacaatagcgaatcgattgagctagctgtcgcggtagtatatcgaacacccacatattcagattagctcaagctcaacctcgatagaagctaacatgtgcatgnagagtctagatagcactcaaatggggactaactagtggcaaatggagggatctggagccagatgaaggcgcgcccctcgtttgttcaagcgtgtctatggaatggttaacaccggacagagggggaattttacctaacgcaatattgtgcaacattttacacgaccattaccattgaaaggacaatatacccagaggatacataggaccattattacattatatcattacaaacaaagtgggaagccgacggagacaagaagcttaacgatactgcccgcagcaaatttacctcccaaaggcgtcagagtgagttagcgcccaaaaagagttacttatacataacggcacgttaaccacccctacaacaaggagtcatggtaacgtagtggcggcttaatcaccatatcacgcgttgcggaagctacacctcatcattaatcaaagagttgccgtaattgatattaccgctcaattaacagaataaaaaggcccatactgagacggagggtattaggaggagcgtcgaggagacttgtgtaaaaaatcccccacaaggatcgcacccagtggcgtaacactcggggccggagaaaacaaataaccttgtagacgtccaaatacatacatgtcgcacggtaacaacaatttgttagtcgtccccagaacggagtgaaagcggccattgtcaaacatttaaacagtgaagagacgcagtaggatgtgcctaacacctctgantatagctggagaaccccccataaaaattaaatttactaaacacgattaaagcctaattaagataaaagagcaccctcaataagagggattaactaacacttatatcattagaaagctttaagttaagagcccggggtgaattatacccatgagacgagtgaacnatacccaacacacagttaaagcgagctacccaaattgggccaaccgagacgggaaaacaccggataaaaagaaacataggggcgtacggcccagccgcgtaggaaatagacgcaactaggccataacagacagaatatgagacnttaaattaagccacttgatgacacagagatgagagcagaaagagacacacgcatcacatgtatacgaccaaaagagggagagaggacacttaggcgcccccacggcgataaagcccggaggattcatatagggccccgacgaattagggtggcccaatgtagatatgggaagagaacgatttaagcaaaaagacgaaacaagaaaagacgcatgtttaatatgacgcccgaacaaaatgattagagacaacacgtaaaagacaccatgccattatatgcagcatctatatattctatagcttaaggcctagagtgaagatgcaaactcgatcgtatgatcagatcaataacatctcgcccaccagatatataatagaggtgatgaaataaacaacgacaggaggtgatgacgatataaaagacacagcgaattacttcgaacgacatgtgtgaatcgagcgatggcacagcta

SEQ ID NO: 706219 - DNA, 143 bp, Homo sapiens
acccaccacattaacaacataaaaccctcattcacacgagaaaacaccctcatgtacatacaccatatcccccattctcctcctatccctacaaccccgacatcattaccgggctatagtagccagagaatatagtagcggga

SEQ ID NO: 706220 - DNA, 520 bp, Homo sapiens
tattgggggattcttaagttggattcaaaagcccattttctcccatgttggtaaatgggatatttttttttaccaatacgcccattaaccacagttaaatttttgttggttttcctgtttgaagccgtctatttgcaatgagggtgagtcatttgaacaaaagggatactcccaaagctttctcgggtccaggtatttttaataaaaatttttccccggggctatttttaaaactggggacataaagggcccggattttggaaaacttcatttgttttttttggttcaaaaaagttcatttatgttcaaagacgtttatttatgttcaacaggaaaaacaaaggggacgggaaagctcgctgtttgaaagggttcccgccccaaaaaaaaaaaaaaatcgggggggggatgggatggagtgagccccctccagttagttgggctagttttaaaaaaaggttttccgggttgggtttttttgaaccaaactgtttagtaaaaaaaaaacaataaatgttga

SEQ ID NO: 706221 - DNA, 2249 bp, Homo sapiens
tgtgatgcactccagcctgggagacagagcgagactgtctccaaaacaaacaaacaaacaaacaaacaaaaaaaccctgtagcttgggatcagccttctcttctgttgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaacaaatatgttcaaataaccacaaccccacccctgctccttggaggacaacgtgatcactgtattcagctctgtcaagaatggtccaggttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatctcagctactcagaagtctgaggcaggagaattgcttaaacccgggagggagaggttgcagtgagccgagattgcaccactgcactctagcctgggcgacagagcaagactccgtctcgaaagaaagaaagaaagaaaggaaattccccagggaagtacctcggcttatttcataaacaggtactgaaggaagcagaggcatgtggaggacttccccacctcatgcagctatttgggccgtggcgtctgaaatttcttatttcagagtcacccctttgatgaccttggcagtgaactgcagtcatctgtttaggcctttccatggcccacgtcaatgccgttatttctgtttgttgcacatttgatttccttgttgttggcatttagaaggccccctgtttcccagatcacaccacgggcatggaccacagagattgcatcttgtgagtctgtagaaatggtcaaggccttgtcctctcttaggtccagagctcaggtgaatgcagattttcccggccatctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcaaccgggcatggtggctatgcctataatcccagcattttgggatgccaaggcgggtggatcacctgaggtcaggagttcaagaccagcctggccaacatggcgaaaccccgtctctaatacaaatacaaaaattagccaagcatggtggccactgtactccagcctgggtgacagagcaagactccgtctcaaataaagaaagagaaagtatcatgcttttcagagttctgtgggttgttatggtgaattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccagcaattagaaaggcaagataagaagattgcttgagcttgagtctgagcccacagtgagctatgaccgcaccactgcactccagcctgggagacagagcgagactgtctccaaaacaaacaaacaaacaaacaaacaaaaaaaccctgtagcttgggatcagccttctcttctgttgtttttcttt

SEQ ID NO: 706222 - DNA, 1466 bp, Homo sapiens
ggcgtgcctgtaatccaacagggaaaccaatcagggatcccagtccagagttcaagacaagctggcctagatgttgaaacctgtctctcttaaactacaaatattagctgggcatggtggcatgcacctgtaatctcagctactcagaagtctgaggcaggagaattgcttaaacccgggagggagaggttgcagtgagccgagattgcaccactgcactctagcctgggcgacagagcaagactccgtctcgaaagaaagaaagaaagaaaggaaattccccagggaagtacctcggcttatttcataaacaggtactgaaggaagcagaggcatgtggaggacttccccacctcatgcagctatttgggccgtggcgtctgaaatttcttatttcagagtcacccctttgatgaccttggcagtgaactgcagtcatctgtttaggcctttccatggcccacgtcaatgccgttatttctgtttgttgcacatttgatttccttgttgttggcatttagaaggccccctgtttcccagatcacaccacgggcatggaccacagagattgcatcttgtgagtctgtagaaatggtcaaggccttgtcctctcttaggtccagagctcaggtgaatgcagattttcccggccatctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcaaccgggcatggtggctatgcctataatcccagcattttgggatgccaaggcgggtggatcacctgaggtcaggagttcaagaccagcctggccaacatggcgaaaccccgtctctaatacaaatacaaaaattagccaagcatggtggccactgtactccagcctgggtgacagagcaagactccgtctcaaataaagaaagagaaagtatcatgcttttcagagttctgtgggttgttatggtgaattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccagcaattagaaaggcaagataagaagattgcttgagcttgagtctgagcccacagtgagctatgaccgcaccactgcactccagcctgggagacagagcgagactgtctccaaaacaaacaaacaaacaaacaaacaaaaaaaccctgtagcttgggatcagccttctcttctgttgtttttcttt

SEQ ID NO: 706223 - DNA, 1165 bp, Homo sapiens
ggcgtgcctgtaatccaacagggaaaccaatcagggatcccagtccagagttcaagacaagctggcctagatgttgaaacctgtctctcttaaactacaaatattagctgggcatggtggcatgcacctgtaatctcagctactcagaagtctgaggcaggagaattgcttaaacccgggagggagaggttgcagtgagccgagattgcaccactgcactctagcctgggcgacagagcaagactccgtctcgaaagaaagaaagaaagaaaggaaattccccagggaagtacctcggcttatttcataaacaggtactgaaggaagcagaggcatgtggaggacttccccacctcatgcagctatttgggccgtggcgtctgaaatttcttatttcagagtcacccctttgatgaccttggcagtgaactgcagtcatctgtttaggcctttccatggcccacgtcaatgccgttatttctgtttgttgcacatttgatttccttgttgttggcatttagaaggccccctgtttcccagatcacaccacgggcatggaccacagagattgcatcttgtgagtctgtagaaatggtcaaggccttgtcctctcttaggtccagagctcaggtgaatgcagattttcccggccatctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcaaccgggcatggtggctatgcctataatcccagcattttgggatgccaaggcgggtggatcacctgaggtcaggagttcaagaccagcctggccaacatggcgaaaccccgtctctaatacaaatacaaaaattagccaggtgcagtggctcatgcttataatcccagcaattagaaaggcaagataagaagattgcttgagcttgagtctgagcccacagtgagctatgaccgcaccactgcactccagcctgggagacagagcgagactgtctccaaaacaaacaaacaaacaaacaaacaaaaaaaccctgtagcttgggatcagccttctcttctgttgtttttcttt

SEQ ID NO: 706224 - DNA, 769 bp, Homo sapiens
gagggaggacacaggcgaagaacgtgcagtgtagtgactgtataataaggaaatacaccaaacagataaataacctaaattaccagcatgcaggttgcacaaggtccaactgatagcatgaaagaatgtcatgagtcagagattgcgattaagcctaagcacttaatattcagtgataaatggaaaatcgacggccggaggcgcggtgagcttcacgctgtgtgatcccagcaattagggaagacgtgaggcgggcatatcagcctgagtgtcaaggatgttcgggagcagacccagaccagtcgctgtcgtagagaccctgtatctactaaaaaaatacaaaattagtggagtgtggtggtgcgtgcctgtagttccggctgctcgaggaggctgggggaggagaatcgcttgggcccgggaggcagaggtttcagtgagccaagatcacaccattgcactccagcctgggcgacagaggaagactccatcgcaagagggaaaaaaaaaaattaaaaacaaactcggggggggccccggaggaccctcgaaaaaggggttccacaacccaaacggcgtttgggggccgggggcccacattaagaattagacacaccggggcacgaaacgggtcccggggagaacccggggcaagacaaggcgcgtggaatcccaccaaaaaaaacacgcccgggggaccggggtttctagacacaccgaagggatctggagcaacaacggactacaaagggccaggggccgattaatc

SEQ ID NO: 706225 - DNA, 818 bp, Homo sapiens
ggcgtgcctgtaatccaacagggaaaccaatcagggatcccagtccagagttcaagacaagctggcctagatgttgaaacctgtctctcttaaactacaaatattagctgggcatggtggcatgcacctgtaatctcagctactcagaagtctgaggcaggagaattgcttaaacccgggagggagaggttgcagtgagccgagattgcaccactgcactctagcctgggcgacagagcaagactccgtctcgaaagaaagaaagaaagaaaggaaattccccagggaagtacctcggcttatttcataaacaggtactgaaggaagcagaggcatgtggaggacttccccacctcatgcagctatttgggccgtggcgtctgaaatttcttatttcagagtcacccctttgatgaccttggcagtgaactgcagtcatctgtttaggcctttccatggcccacgtcaatgccgttatttctgtttgttgcacatttgatttccttgttgttggcatttagaaggccccctgtttcccagatcacaccacgggcatggaccacagagattgcatcttgtgagtctgtagaaatggtcaaggccttgtcctctcttaggtccagagctcaggtgaatgcagattttcccggccatctgtgctgaagtccctgtggggaggctcctggctggtttcctgtaggtagacagctacacgtcctgcccttcattggcttcttttcatgaagctcctgccattcaacgcctccgggccattcaacgcctccggccattcaacgcctccgggccattcaacgcct

SEQ ID NO: 706226 - DNA, 1058 bp, Homo sapiens
ccttccagaccctgccactggatggcagccaactgttttggccaccccatggacggggcaattccgaaatatatgtttgggggacataaaatttcctccctggtggcgttaaaaaggccccctgtttcccagatcacaccacgggcatggaccacagagattgcatcttgtgagtctgtagaaatggtcaaggccttgtcctctcttaggtccagagctcaggtgaatgcagattttcccggccatctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcaaccgggcatggtggctatgcctataatcccagcattttgggatgccaaggcgggtggatcacctgaggtcaggagttcaagaccagcctggccaacatggcgaaaccccgtctctaatacaaatacaaaaattagccaagcatggtggccactgtactccagcctgggtgacagagcaagactccgtctcaaataaagaaagagaaagtatcatgcttttcagagttctgtgggttgttatggtgaattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccagcaattagaaaggcaagataagaagattgcttgagcttgagtctgagcccacagtgagctatgaccgcaccactgcactccagcctgggagacagagcgagactgtctccaaaacaaacaaacaaacaaacaaacaaaaaaaccctgtagcttgggatcagccttctcttctgttgtttttcttt

SEQ ID NO: 706227 - DNA, 376 bp, Homo sapiens
ctggaccttctggaaactactcacgtaaactcaatgcacaaataattcttccaacattcattattgcttgcgttttcatcagatatcgctgctgagacacggaagactacgagtacatggagctggcatcaggagcgtaggtcatggagggcctccctgaagcacgaattcatgggccagaacgagagatgggagaccagagaacagcagacctacaaagggccattgcagggcataaggaaggtacatcagtgtgctatggcttgatcagagcttggggactttacacaggatgaagctggaaaggaatagaagggtaatatcagtcgggcgcggtggctcacacctgtaatctgagcactttggcaggatcagt

SEQ ID NO: 706228 - DNA, 151 bp, Homo sapiens
ctttacgcgctttcagtttttccccattgaggattatatttgctgtgggtttatcataaatggctttgattatattcaggaatgttccctctatacccactttggcgagggtcttgatcatgaatggatgttgaacttgcggtaaaagctt

SEQ ID NO: 706229 - DNA, 864 bp, Homo sapiens
  misc_feature (25)..(25): n is a, c, g, or t
  misc_feature (102)..(102): n is a, c, g, or t
  misc_feature (117)..(117): n is a, c, g, or t
  misc_feature (181)..(181): n is a, c, g, or t
  misc_feature (304)..(304): n is a, c, g, or t
  misc_feature (368)..(368): n is a, c, g, or t
  misc_feature (469)..(469): n is a, c, g, or t
  misc_feature (556)..(556): n is a, c, g, or t
  misc_feature (637)..(637): n is a, c, g, or t
  misc_feature (640)..(640): n is a, c, g, or t
  misc_feature (650)..(650): n is a, c, g, or t
  misc_feature (663)..(663): n is a, c, g, or t
  misc_feature (686)..(686): n is a, c, g, or t
  misc_feature (730)..(730): n is a, c, g, or t
  misc_feature (760)..(760): n is a, c, g, or t
  misc_feature (802)..(802): n is a, c, g, or t
taagttactgatgcacaaacaaaanctaaacccaacttactaactatgcagatctctcctgatctccccaggttgggcagttattagttccttacaggtgtnatcaatggtccaganaaggcagctactgttagttacagttggtctgcggcatcaaagtggaggcagcagagtggaaganccacagagggctgtgatacagccagaaaagacaatggagagtgaaggctagaaacattgaggaaggggtcaagaagcactggtacttcctgtgatcttttccaatagaatattcctgcaagtnacccatcagaaaaaggtgtgcagagggtttgaaaaagaagtggttagcccatgccagtgaaggngacaaaaaacaaaacaacttgatttttggtcaaatcagaaaggatggagggaaacacccaagttcatgcatggacacaagtgccccagccaaaggagtgcngtgttcaccagcgaaaaattttctaacagcaacaacaaaaacccacagaagtgagtcacagggaagtggatcagtcctaagccaaanaaggattcccacctggggcaaaagccgactccctaggacatgaactgaacacatcacagttaaagcccagttgaggctgcngcnagttccagcnattagtaattatnagggggacaggatgacacctcanacggaccacccctagcaagagggtttgtttcagttctagctgtnagaggaatgtttgcagttcccacaggtgtnctaagctgtgaagcccatggcccctgctcctctctttgcctnccacacacttaacagttcacacagactttgctggcaagtgctgtttgttcctgcactgccat

SEQ ID NO: 706230 - DNA, 287 bp, Homo sapiens
ggggaaattttttaccctgtcccccccccccccggtttcccttttggccctggaaaatttattttggccggcaaagtgggggggttgggggggtggggctcccccccccccccagcccgggtggggttttttcccggccccccgttttggggtgggggaaggggggcggaaaattcctccgcccgggcccccgggtggggtgggggggttccttttttggcgggttttgggggaagggggtgggaatgggggtggttcctcctcccgtgggggggcccattgggccc

SEQ ID NO: 706231 - DNA, 282 bp, Homo sapiens
gggggggggggggcccccccctttattccccccccttggggggttggggcggccgattcccctggggccggggttttaaaaccccctgggcccccaggggaaaccccttttttttttaaaattccaaaaattacttgggggggggggggggccccggttattcccccccctttggggggtttggccgggaaattttttggatccccgggggggggggttccggttttttttttaggcccccttcccccccggggggggggccgccccgggccccttttccca

SEQ ID NO: 706232 - DNA, 490 bp, Homo sapiens
tcacctaaactcctacacaagttcaatgatgttgtgtggcacgtgagctggtccatcacagccaacatcctggctgtgtcaggtggagacaataaggtgaccctgtggaaagagtcggtggacggacagtgggtgtgcatcagtgacgtcaacaagggccagggttctgtgtcagcctccatcacagagggccaacagaacgagcagtgacagcacaggcagcctggccttcctgttacctattctggaacaacctccaaacaactgggaagaagagtcccagtgctaccaagattccacacccgagtgcccacacatgcaacactgggtgttcacctgccttactgggatcccatgtgtttagtaatttaacgtccagctgaaagtattcatgtaaggaacaaatgactattatttttaaatatttttggccatttttaactatcttttggttaaaagctatccaagctaataaaatcatattgcatag

SEQ ID NO: 706233 - DNA, 722 bp, Homo sapiens
  misc_feature (573)..(573): n is a, c, g, or t
cgggctgcaggaattcggaacgggacagcagggacatgaggttacgcgcttagatccagtggctacggctactaatggtctataggtgccggatgtaacatgcatatgacccagaatccaatggccctgtctgaaggatgtgaagacagagtcgccgtctttagcggtacaggtcagaccattagagattatggcaattgctatcaacagaagccagtgactgacggtaaactccggagcacagctgcatgcactaggtaaactgactgcccatcaaactatagaggccctggatctgggacggatttcactctcagtatcagtagcttgaaggctgacgattgtggaagtaatttctgccaacagtgtgacatgatgccgtggacgtccgttcagtgtaccaggagtggaaatcaagcgagctgagactacaccatgtgactcgatgttcctgccatcagatgagcagtagaaatctgaaactgactatgatcgttgcctgctgaataactaggatagcagagtggctaaagtacaatgtgaggtggatcacgcactccaatcgagtaactnccaggagagtgtcacacgatcatgacacgatggacaggacctacagacttagtagcactcctgacgcttacagaagtagactacgagaaacacacagactacgtgtgtgacgtgacctatcaaggactgagcttagccggtactgcttc

SEQ ID NO: 706234 - DNA, 98 bp, Homo sapiens
gcggccgcctaactactactactgctcgaattcaagcttctaacgatgtacggggacatggaaatacagttgttggcctccggcctcccctcaaaaaa

SEQ ID NO: 706235 - DNA, 1085 bp, Homo sapiens
  misc_feature (60)..(60): n is a, c, g, or t
  misc_feature (67)..(69): n is a, c, g, or t
  misc_feature (78)..(80): n is a, c, g, or t
  misc_feature (85)..(85): n is a, c, g, or t
  misc_feature (91)..(92): n is a, c, g, or t
  misc_feature (94)..(94): n is a, c, g, or t
tggaatttcattaactttattgaaaggtatatcccttagtactaaaacataatggtagtnggttagnnnacctctgcnnnctcanaattannantgatggattcaaaatattgaaatttatcagcctttggggaaaactaaaaatgttacccataaaacatgggtttcacaaaagtgttaaagaataaagatatcactgggggtccttggggttttccattggtggtactggatccataacggtgatggtcaatttgggatatacgccatcatgggataagactcagggcttataactattggcgactggatgtaaactggtgttcacaaccatctttaaacactggtgacttcttacactattccactaaactggccaaggggaggatcctaaaacaactaacttcagcgagcttcaattcataagttagtgaaagggtgtctacgtgggcttttctataagaatttgtgggtttggggcccagttagaggggcatcgaggggagagttatattctctatttataaaattggcgcaatcatttttaatttaaaaacggttcgtgtcgctaaaaacattcggggaggtgttcaattctagtcgtggaattaccttaggggggggaaagccaagttttccgaaagggggataattatatgggagcttactaataccaatgcaaactaagttccgtgaagggaatacacgtttgacggcaagcgagttcctggacttcacacacttttatcgtggaaatacacatggttcaccgggtttctataacaaaaaaaaaaaacacaacagaaaaaaagagggggcgcgcacataaaattccccacgaggggcaccagataacgacgagacccgcagaattatgaacaagaggggccccaaggagggagcaaaataaaaacgagacgggcagcaactaaaaagcagcgagcgaacaacgacacgggaatcagggagcagccacaacacggggggggaaataggccacacaacacaagatcagcgcggcgcaacaaaaacagcagcatgcaaaccacgcacgcgcaggaagaatgatactataagcagaagca

SEQ ID NO: 706236 - DNA, 522 bp, Homo sapiens
tacaagtgaggtaggtaggacaaagaaagtatgatatactatatgatgagtaactagattatttcacatgtgataggacatcagaatgaaggcatgaccagagtgatcacgaatccgaaaagatctctcagctcataattgtttcaagtgttgaataaaaaataaaaattctatcatattgacattacagctactatttgcagcttataggtataatattcttatcaagttgtagcaaacctattcacattagtatgttcaatatggtcaccatctatggcctatatattgatatagaacatgttttgggcaccttcaagtcaggatacatcgttcgggaaaaaatctctttcctgaagctactttagtgtagaatgagtcctttccactgtcatttctaccttatgaaaaaaacaaaatcacctcctcctatattctcattctcagctaatgaccttatcatttacacaatctcaaagcagaagaaccttatagtaccctggatcctactttactctctat

SEQ ID NO: 706237 - DNA, 209 bp, Homo sapiens
tagggccagaaattgtgtaccctcctctagaaagaaattccagtaatgatctgtaaagtgtcagggagcagaagagaggacggtgaatgtacttcaactattttagcacatttttagaaataggaattcttgagtctcttttctttcttcagatcttttccatttctttttcttttctttttcactgtaatttctgtgcccatttcaga

SEQ ID NO: 706238 - DNA, 612 bp, Homo sapiens
ggtggaaagaatgtcattcagagaatataatggtttttgtacttcaaagtgtgtctacttaaaagggacaaatcatcatcttcaacatcttttttgttgtttgtttttgagacggagtcttgctctgtcacctaggctggagtgcaatggtgcgatctgggctcactgcaacctccgcatcccaggttcaagcaattctcctgcctcaggctcccaagtagctaagataaattacaggcacccgccaccatgcccagctaatttttgtatttttaatagagacagggtttcaccatgttggccaggctggttttgaactcctgaccttgtgatccacctgcctcggcctcccaaagtgctgggattacaggcgtgagccactgcgcccagcctcagctaactttcaacttttgtcttttgtagagatagggtttcaccatgttacccaagctggaggaattttttttttttttttttttgagagggagtctcgctctgtcacccaagctggagtgcagtggcgcaatcttggctccttgcaacctccgcctcctgggttcaagcaattctcctgcctcagcctcccgagtacctgagattatagacgtaagc

SEQ ID NO: 706239 - DNA, 1045 bp, Homo sapiens
gaagaagctgccgttgttctggagtactacaagcagaagggctatgcggaagcgagcaccccacgatctgagatgcgctccatgccgcgtgtgacgcctgagggccaccactccatctgcctcctgagcctagggcctggcctaggctagcaagcgtagaccagagagtgtactatacaacacccatatcacacacatacagataactcccacaactcgacgacagtacctgtagcacccaccactagaccccacacgcgcccaaacatacacccagccaacaacccctcacacaccacaccccccacccctttcccattacccctcgcctctccacaactccacacacaccccaacaacacaaacttcacccccctcaccccccaatataaccacacccgccccccaacacccccacacccccctcctccacctaccctacacacacacaacacaaacacaccccaccactcccaccacaacaacaccacccccacgcccaccacacaccccccacacacaaaacacataaacacacacacccacccccaccaaccacccccaatcaccacccctccccaccaaccccacacctccacacctctacacctccccccatccccacctcgcccacacccccaccccaccacaccccaccacaaaccacacacccaccacatacaccaccccctacaccccacctatcccccattcacactccctcatcacctacaccaacaacacacatccaccacctcctcccaacacacctcactcaccatcacctccacacacctactccaactcacaaacaaaaacaacgcccacctacccaccccaccccccaccccctccaacacacacccacaccacctctcacacacatacaacccacacccttcccccctacccctctcaccatctcccctccactctcccccccatcactgtcacctatcctctactactcccctacccactgtcaccattacaccccacctcacccaccacacaccccccccctcaccccccacacccccacacc

SEQ ID NO: 706240 - DNA, 243 bp, Homo sapiens
cgggtgtgtcgtaaggtactctacaggatttatgtggtactgctgagatggccgattatgaaggagagtgaggctgtggagtggcagcagaaggtccactgattggccagcagagcctggggcaaatgtctgggaaggggagggaaagagagagggactgggtcccaaatggcaagagtgaaggcagggggacgggtccagaggtcagtaccttgaaagacaattttgttggccatagaggac

SEQ ID NO: 706241 - DNA, 1535 bp, Homo sapiens
aaccactgtgtagtcagttgccccagcatgggttttcgtcgcgccggcatcaacattacaccactctgtggtggggcgcccttcctagatatggtgaagtccaccctcgtatgctccagattggtgtggttgttgtctcctctgacagtgatcccctggagtgcccctgtgtgatgtatgttctcctccatcagatgatgattgcgtcttgtgtggttgtggatcaccacagagctagctccttgcgacaataaggagcatttttctttttggtggtggggtgctcgttgtgtagtaggcacactatggtgtttcgatcttgccacccccaccgcataataatagtgtcgtatagttcttcttattgaattaaaatcgtcctcctcctctccatcatgtttgttatactaaaaaatcctatcttttcctctgtgttaataaatgagaagaaccaacattgtttctcctccctacaactcctcatccacgccgtacactcattggtctcagttttatttatctacacaatcgtcatgtgtgttttgtagtagttttgtgtggtgatgaataatatagatctcttttcttccaccaccatcggctgtagtttcttcttcgtctttgtgctgcgccctactctttttattaggtgccgcgccgtcctttgttgtagtagttgagtaccacctcctcatcggtgttgattactaacgccttcatgattgtggtggggacgtggaggatgggtgggccccacacacctgcacaccatcctcctctcccgcgtggtcggcgtgattaggacaccgtcttcctctgctgtggagtagacctccttcggcgcttgaccacagtgttgttgtgatcacagagaagtgtgtttccacacaaactgtgttcgcgagcagcgcttctggtttgtgagtttgtgtgtcccccaccacttgtggatgaagaaagagagagtgtcacccacagctggtcccaacagagccactctactgtgtcacaacagagagagcttgtgagttctctctcacacacctctggtgtcagagttgtcaacataccccaccaagagcacacacgctctcacacacacacacacctcgtcactcggctctccacacagcgtgtctcccctcgccacagcgagactatcaccacacttttctccactctgtgagaagcacctctccacatcgatagaccccctctgcacaatattgttcacaaagcacagaatgttgtcacaccacacggtgaatcacatctcccacaaagaagctgtgagatgaacacatgtggagagagggaaggcggaatttgtaagagggctgtggttcacaggccccccacacttggggctctccaccctttccccagagctatctgttttcctcacctgccttttcctatttaaggaaggatggtgaaacccccccccgttttcccccgggccacaccccttaaaggtattctaataaagttctgaacttctcccctccccatacatcaaagaaaaaaaaaactca

SEQ ID NO: 706242 - DNA, 347 bp, Homo sapiens
tcagcagtttagtcagctcaagtgcaagacgggtgacaaaccggtgttacgggtagacacatcaaatgacgcttgggtaccacgtcacattcatccttgaagactcagccatttctcttggctgctacgttgccagagaggaaatggtggtccaccataagcacagaacagcagcagtacatcggaagcacagatgtgctttgggcggactgaattgtcacatctggtggcacagcatagctgcccaaaggatgaaaaatcaagactggtctccagcatgacggtaagcactgggaaaacacactggaagtgacagtagacgctccagcaatcaccaggagccagcc

SEQ ID NO: 706243 - DNA, 348 bp, Homo sapiens
  misc_feature (345)..(345): n is a, c, g, or t
ttttttttgagacagggtcttgctatgtcacaatcatggctcactaacagcctcaaactcctggactcaagtgatcctctcgccttagccacccaagtagctgggactacaggtgtgcatgcacactacacccagctaatttttttatttttcgtagagatggagtctccctgtgttgccaaggctggtctcaaactcctgggctcaagcaatcttcccacctcagcctctcaaactgctgggattacaggcatggagccaatgcgcccaactatgatcactttttataaaaagacaagctccagcactcgcacacataaacacagaatattaaattaattccancct

SEQ ID NO: 706244 - DNA, 521 bp, Homo sapiens
catatctgtgtgggccagtttctggtctcttacttctgctgtatttatctatgtgactttgttcccttattacaccaccactttaatagctattttgtaaaatgtcatcaacatcagataggacagtttttccctcgttcttcattttcatcatcaacttagaccttctcattctttcttttctttgagttttaaagccatattatcaagtttcataaaaactctgttgtcatttgttttaaattagatcaaagtacatctccccattaattcaggtcatctttgtatcctttaatacaatttgtgtgtgtgtgttttattttggagggactttggccctgtcacccagggctgggatttgtaatgggaatagatcatgggatcactggaagccttaatctcctggggctcaagtgggttctcactgtctccagcctcccaagtagctggggattaccattggcccaccaccaggcccaagttaatttgtggtcactttaaggtacagacggggtttcgca

SEQ ID NO: 706245 - DNA, 554 bp, Homo sapiens
  misc_feature (16)..(16): n is a, c, g, or t
  misc_feature (105)..(105): n is a, c, g, or t
  misc_feature (120)..(120): n is a, c, g, or t
  misc_feature (125)..(125): n is a, c, g, or t
  misc_feature (142)..(142): n is a, c, g, or t
  misc_feature (144)..(144): n is a, c, g, or t
  misc_feature (152)..(154): n is a, c, g, or t
  misc_feature (158)..(159): n is a, c, g, or t
  misc_feature (167)..(167): n is a, c, g, or t
  misc_feature (170)..(170): n is a, c, g, or t
  misc_feature (175)..(175): n is a, c, g, or t
  misc_feature (178)..(179): n is a, c, g, or t
  misc_feature (185)..(185): n is a, c, g, or t
  misc_feature (198)..(198): n is a, c, g, or t
  misc_feature (205)..(205): n is a, c, g, or t
  misc_feature (231)..(231): n is a, c, g, or t
  misc_feature (265)..(265): n is a, c, g, or t
  misc_feature (276)..(276): n is a, c, g, or t
  misc_feature (281)..(281): n is a, c, g, or t
  misc_feature (283)..(283): n is a, c, g, or t
  misc_feature (332)..(332): n is a, c, g, or t
  misc_feature (347)..(347): n is a, c, g, or t
  misc_feature (353)..(353): n is a, c, g, or t
  misc_feature (377)..(377): n is a, c, g, or t
  misc_feature (394)..(394): n is a, c, g, or t
  misc_feature (397)..(397): n is a, c, g, or t
  misc_feature (403)..(404): n is a, c, g, or t
  misc_feature (415)..(415): n is a, c, g, or t
  misc_feature (420)..(420): n is a, c, g, or t
  misc_feature (435)..(436): n is a, c, g, or t
  misc_feature (439)..(439): n is a, c, g, or t
  misc_feature (449)..(449): n is a, c, g, or t
  misc_feature (475)..(475): n is a, c, g, or t
  misc_feature (494)..(494): n is a, c, g, or t
  misc_feature (539)..(539): n is a, c, g, or t
atgcatttcacaatgngggcccggattcagggagtaggttagaaagcctatgatgagtcatgacaagctgactttgactaatagtcatcccattaaaaaaatganagccacaaacatggncaganaccagtcatagaatatntnagggtatnnngcanngggtgggngcntcggncanntcggtnctccagaggcacnggatganaaggatgtttgggaaatattttctgnaagggcaccatattaaaaattatcctatacctanctttatttttntcagncntcccaacaaagaatctgctatataatttccattaacagctctaaaagangggggaaatattttntcctcnggcgggcactttccgtctcacctntcctcgctttccgcccnggnggcagnnacacccccccngctgnctcgcacgtagtacnnacngggctgaaantgcagaatattgacaaaacacacagnacagacataaccaatttcnatgagatttcgatgacagaagcaagcagccctgtagtcaacatgnacggggggtgggagg

SEQ ID NO: 706246 - DNA, 1043 bp, Homo sapiens
ggtcttcttgctgcagcaacgctagtgggagcgccaggatctcgggctcggaaagagagtgcacggatcgtaaaagaaaatggagacaaacagacatgggggaaactctgccagcttcagaatagaggccaaggcttgagatgaaaacgggagtacgcaggtagagagtaacagccttgcctgtgcaaagcagactatgtgaagcacagcgatacagcggcacgttgagaatgtgccatagagattcctggatgggattttccgtaggcccacgacactcgtacgaagaatcgcccaggtcgatgctgttgggtagggacagaggccattctgacaaagaatggaccacagagccgacaacatgcgtcgctactggtgaatgccattgggccaccctctcggtgccgggaatagccatgcggggaccgtgtgagtgttctcgtggacaggggtaacgcaccacccacaagtctgagattgtgcaacgacttcctcgaggcttacagccccgggggaatagttagtagaggaagagttaaatacggcattgaatactctgacatttagaaacacaatccttgcgtggaaggaaactaaaacaagagacacatagcaagagacacatcacacttgagtgcgaacagcacggaaccacgccagcaaagaacgtgaatcaaggaaccaaaggacgagttgagtggcgcgggaggcccacttatgaggacaaacgacagcaagtgcgtgcacatgaatgtgatcctgacacaagagaagcctcgcacgggacaccagaagatacggcgcgaaggcacccacgactaattaaacaagaacgcgccgcgagaaacgcaggtagggtttcgaacaacacctaagagtggcaactagtcagcggaactacgagggaccatacagcacgcgatcacagggagcgacagaataatacacccgcgggagtataaaaggcaacagacacagacaagagtcgacaggtgacaaagcaaggaccacggaacaagcagcagaagaacaaagaacacagc

SEQ ID NO: 706247 - DNA, 351 bp, Homo sapiens
  misc_feature (164)..(165): n is a, c, g, or t
tttcccccttgggcctttttgggggcccctttaaaccaggtttggccaaaaaaggggggggggcgggggggggatttccggggattttgtcccccccgggggcccccccgggggcccctttttggggttttttagggggggggggggggccccggttttccccnngaccccctttgggggattttttgggtttagggggccccgaaatttttttttccccttagggggggccggggtcccctttcttttttttttgggggtttaaaacccccctttttggcccttttttggggggttttttgggggacccctttttttttttcccctttccggttttttttgggggcccca

SEQ ID NO: 706248 - DNA, 419 bp, Homo sapiens
  misc_feature (168)..(168): n is a, c, g, or t
  misc_feature (180)..(180): n is a, c, g, or t
  misc_feature (186)..(187): n is a, c, g, or t
  misc_feature (277)..(277): n is a, c, g, or t
ggcgggtctccccagccacaccaggctgatgggtgggatttatgtgccaggtactgtgctggctatcactggggcctggtggtctcttggagtcacaagcagccgcctgagatgaggtttatcattttgagctagaataggactgaagctcattcccgaggggcttgncgggccggctcntcgccnntgccggcatctccactgcctctgctgtcctgaagctcttatgagggttcacattactaggacgccaatgtgggttctcctctggcactgncccaaggcaccccaacctcagacatgtcacctcctgggcctactagaaatggagactgcagttctatgatgggaaaatctctacaccatcggtcatttgggctatagaagaaaaagaaattattttcagctgcaaaaaaaaa

SEQ ID NO: 706249 - DNA, 81 bp, Homo sapiens
gaggggagttactatggttcggggagttattatagaggccttgacttctggggccagggaaccctggtcaccgtctcctca

SEQ ID NO: 706250 - DNA, 727 bp, Homo sapiens
agcggaaagattgggcccaaagtcaaagagagctaaaaagaaaaataataaaataagaaagtaaagaataaaatagttgaacaaataaggttcatgaaaaaaaaagaaaagaaagaaaaggtaaagaaaagaaatccagtgataaaatatcaagactttgttaataaaaacaagtctggccctgttactgtggatgaccccaccttggcttgtctaaccctaatcccagccccagttttaataaagactgtatttacagaatataggcagctgggcacgtggaccgagagataccaagtttgatttttctttagaagtattacgaattaaaagtattacatcactgtgtcttcattcactgagtttcgggggtagcccgtttaaattttggtatgcaaggtgaattagctcacccctctctccgtggcctagaatctgggggatcctcctgtccctcccacagtgcctgatagcacggcctggggctggtggtgtgcctgttggcctagctttatctctccagatactatatggggtgtgctgttctaagaagtgattaggttagcgttttgcatattaacaaactacctcgtgaaacttagtggcgttaaagccaacaaatgtattaggctttataagtgattcggatcagtgatgggggctgggcacggacaggcgattcttctgctgggctgggctgaactcaatatgtctaatggtcagaggg

SEQ ID NO: 706251 - DNA, 435 bp, Homo sapiens
  misc_feature (1)..(1): n is a, c, g, or t
  misc_feature (57)..(57): n is a, c, g, or t
  misc_feature (85)..(85): n is a, c, g, or t
  misc_feature (88)..(88): n is a, c, g, or t
nttagaacagtctctgtacaccaattccctccctaaaaaccatccttttttaaaaanaagaattgttccagcccataaagaaagnacnagatccatgccctttgcagggacatggattgagctggaggccattatccttcataaactattgcaggaacagaagaccaaacactccatattctcacttgtaagtgggagctaaatgagaacacgtggacacatagagggaaacaacacacactggggcctatgagagggcggaaggtgggaggagggagagatcaggaaaaataactaatggatacttagggtgatgaaataatctgtgtaacaaacccccatgacacacctttatgtatgtaacaaaccagcacttcctgcgcatgtacccctgaacttaaaagttaaaaaaaagttgaacttaaaaataacaga

SEQ ID NO: 706252 - DNA, 170 bp, Homo sapiens
tgcctggccggtaaatctgtgtattctagactacatctggaattagatcacttaccacatcaatcctgtcagtcccactcacattatctcgttaatgtcctaattgatctacttatgtctgtcctcatccctctattcatcccagcctccagggcgagcctttgaacaca

SEQ ID NO: 706253 - DNA, 303 bp, Homo sapiens
  misc_feature (141)..(141): n is a, c, g, or t
ttggtctgtttggttaaattgtgttagaaagtctgaagggaaactatctcaaagcaaagttacaaacaaaaccagaacaactgtaacaaaaccaagaggtgttttccttcagctggccttgactcaccacctgcctgcggncatggtgtcaaactccagatcaagtgaaacctagtctctcaggctgggggtatggctcaacccgaggtgagtgaggccctgggttaaatctccagtatcagaaacaaatcaatacattgcaagaccaagggacatcgtattccatactgcaggagaccctgt

SEQ ID NO: 706254 - DNA, 261 bp, Homo sapiens
catcatgcccagcaaattagtgtctagtagagacggagtttcaccatgttggccaggctggtctcgaactcctgactcaggtgatccatccgccttggactcccaaagatgctgggattacaggcgggagccaccatgcctggccagaacaaatgcctttttaccacccttttccgaacattttacacactgtctttttctatgtcacatgtaacgtttatttttttacaccactaccaattgctttgccaaaaaaaacaa

SEQ ID NO: 706255 - DNA, 705 bp, Homo sapiens
agcgggcctagccgccccgcgggcgcgactctcggggcagtgacgaactgggtggagcccgccgccggccgccgccgccggcggggagagcgagccccgggggcggggtccccgaggccgggcccgcggacgggccgcggggcccgacgggccggagcgggtgaggaggtgagcgggagccgtggggcgaagagcccgccggcacccaggctcagcgatggtaccatttgttcgagctgggtggactaaggtgcctgaggatcatcagcgtcacatccgggtcaaggctggggaagatcggccgggaggaggagcttgcggactggcacctgttgcggagtacgggaggaaacaggtgttttccaagaagttctgaggtggctcattcgtgcgagccggaggtgacagggtggagcaactaaggatggctccagaggggcacctggatcggacagagatgaatccgaagacagattggagaatacaacaaggtctaggtaggcgcaaagccagggcggggatcgccgaggcaaggccccacgccaatcggggggacagagaaagccgacaagggggcccagggggccaatcactagcagcacggccccgcaagacacgggcgccagaaggcacgcatagcagacccagcaacccggaccacccaccagcccggggatgcacggcaagtggaaccaatccagaaat

SEQ ID NO: 706256 - DNA, 100 bp, Homo sapiens
tctagagatccgagccagatggtgctcatctctctctctctcaggctgcaggtgaccaggcgtccactcactctctctctcgggctgcaggtacacgagg

SEQ ID NO: 706257 - DNA, 212 bp, Homo sapiens
acatccgctattgtgtcatgcaggagcattctgttcttccataagcagcagagttgagtgttagagtgcaggatccagagcggtgagaggctgggcggagttgggggctggaggctgggcgctggttacttgtgttgacgtgcagagctctctctggtgggctgcagttcatcttggggggagctggactcagatgcccccgtagtgattac

SEQ ID NO: 706258 - DNA, 465 bp, Homo sapiens
aactgctggacttcaccctgagcgccgcggcgcgcggctcggccgaagccaccgagggcatggccaccatcgacatgaacaccaccttcctgtcgccgggcaccggcgacctggtgatcgaggcgcgctgcctgcgccggggcggctccatcgccttctgtgaaggcgacatccgccgcgccgacggcgaactggtggcccgcgccaccgccacgttcaagatcatccgccgccgcccgggcggcgactgaacggcgccgcgcgccccggcaaacggggcgcgaacaggcctatttcttgaaatcgcgcgacggcggcaccgtcggccgcggatccagcggcatgtagctggcgcacgagctcatgccgtagtagatcgcgtcctgcatggcgcgcatcgccgccgcgtcccaggtgcccttgccccacatcacgatgcgggtttcggtggtcttgggaccggcc

SEQ ID NO: 706259 - DNA, 104 bp, Homo sapiens
gctgatccgcttaaggggcgtcgggcgactcctccgagagcagccccggacaagcttcatccctctcccaaatgtaacattggcttgaaactgggtaccgagct

SEQ ID NO: 706260 - DNA, 1537 bp, Homo sapiens
  misc_feature (343)..(343): n is a, c, g, or t
  misc_feature (373)..(373): n is a, c, g, or t
tccattttctgttttccaggcccagtctgactctgtctgtaatacctgattgcattggagaactctagacacgcataaacatggacagtttttctaaatgtgagacttaagcctgtgatgtaaaataggaagttctacttggaataatataaaggaaccactagaatttacaattattttgaagttacagggattagattttgaatcttaaaatcctttaggtaatttttagaatttttaaattaagattaatgtgaagagaattaagtgagcagcaggtggttcacttgagcaaactgcccattaagtcagattaaaccatttgaatgatagtagagatgtnttaagtaatactggatttttacagtaagtntatggtgtactttgaatcgataggtgtccatgcatattttatgaattcgtggagaatgaatgcaatgaagacaagtaagtagtcttgaaaattatttaaataaagttgtagatttttttagtgccccctaggaatatattagtgaactttggaacttttaccaaagttatgtaacctcagtgtagataattttaaatatttctatttttatattttaaaatgttgaatatactctggaaacaacatttgaagatttgctctgatgtcaactttttctggttataaaacctattagtattgtgtataattctcagggtaggtatactctaataggtgttttgtcaattgctttatttttgtaaaggctagagttagtgcatattgaatatatttatgtacaaataattcctgttgtaacatttagtggacgcgattatctgtatacctcaaattttaatttaagaaagtatcacttaaagagcatctcattttctatagattgaggcttaattactgaaaagtgactcaaccaaaaagcacataaccttttaaaggagctacacctaccgcagaaagtcagatgccctgtaaataactttggtctttcaaaatagtggcaatgcttaagatacttaaaaatacacatacatataagctgaaagcatgtcaagcctatttccatagaaaatagttcttaaacagtattgttcattagaaattgctggggagcattttagagattccataggcctggtagccacctcagcttactaaatcaacatctctggagatggagtgtatatgtgttttgaaacagctgctcaagtggttctgttaaacactcctgcgttacaatcacttaaaatagagcaagcatccccttaggctcttaattgtagtttaaattccagtactgcctactcagacccaaaagttttgttttatgaaaaatttgtattgtgttcaatattgtttgaaatttggggttgttgcataaatgattatggaataacatttggttttaaaataatataaactgacatgttatgctacctgttacacaatttggttttcagttttaattatatgaagctggtaacaatcgtttttgttgtaaaagaattatttttcactaaacagtatgtttaaaactgaaaaaaaaaa

SEQ ID NO: 706261 - DNA, 1483 bp, Homo sapiens
  misc_feature (343)..(343): n is a, c, g, or t
  misc_feature (373)..(373): n is a, c, g, or t
tccattttctgttttccaggcccagtctgactctgtctgtaatacctgattgcattggagaactctagacacgcataaacatggacagtttttctaaatgtgagacttaagcctgtgatgtaaaataggaagttctacttggaataatataaaggaaccactagaatttacaattattttgaagttacagggattagattttgaatcttaaaatcctttaggtaatttttagaatttttaaattaagattaatgtgaagagaattaagtgagcagcaggtggttcacttgagcaaactgcccattaagtcagattaaaccatttgaatgatagtagagatgtnttaagtaatactggatttttacagtaagtntatggtgtactttgaatcgataggtgtccatgcatattttatgaattcgtggagaatgaatgcaatgaagacaagtaagtagtcttgaaaattatttaaataaagttgtagatttttttagtgccccctaggaatatattagtgaactttggaacttttaccaaagttatgtaacctcagtgtagataattttaaatatttctatttttatattttaaaatgttgaatatactctggaaacaacatttgaagatttgctctgatgtcaactttttctggttattttgtcaattgctttatttttgtaaaggctagagttagtgcatattgaatatatttatgtacaaataattcctgttgtaacatttagtggacgcgattatctgtatacctcaaattttaatttaagaaagtatcacttaaagagcatctcattttctatagattgaggcttaattactgaaaagtgactcaaccaaaaagcacataaccttttaaaggagctacacctaccgcagaaagtcagatgccctgtaaataactttggtctttcaaaatagtggcaatgcttaagatacttaaaaatacacatacatataagctgaaagcatgtcaagcctatttccatagaaaatagttcttaaacagtattgttcattagaaattgctggggagcattttagagattccataggcctggtagccacctcagcttactaaatcaacatctctggagatggagtgtatatgtgttttgaaacagctgctcaagtggttctgttaaacactcctgcgttacaatcacttaaaatagagcaagcatccccttaggctcttaattgtagtttaaattccagtactgcctactcagacccaaaagttttgttttatgaaaaatttgtattgtgttcaatattgtttgaaatttggggttgttgcataaatgattatggaataacatttggttttaaaataatataaactgacatgttatgctacctgttacacaatttggttttcagttttaattatatgaagctggtaacaatcgtttttgttgtaaaagaattatttttcactaaacagtatgtttaaaactgaaaaaaaaaa

SEQ ID NO: 706262 - DNA, 288 bp, Homo sapiens
  misc_feature (87)..(87): n is a, c, g, or t
  misc_feature (97)..(97): n is a, c, g, or t
  misc_feature (109)..(109): n is a, c, g, or t
  misc_feature (167)..(167): n is a, c, g, or t
  misc_feature (177)..(177): n is a, c, g, or t
tctacatgatctctgagagacgtgttgcatgtcattaaggagagaaggagagaagtaagccgagggcgtctttgattgtgtagatancgggtggaangtgattttatcngaatgggaggtgattcctagggggttgtttgcatccctgtttcgtgcaagaataggangtggagtgcngctagggctgcaataatgaagggcatcatcaagtgaaaggtaagagaatcgtgtgagggtgggactgtccgttgatttacatcctcagattcattgcaacacggtctctca

SEQ ID NO: 706263 - DNA, 474 bp, Homo sapiens
gaaaaggaaagatagccaggaaaagtacattaaataaaagtaaggtttgttatgtaaacttgcctttctcattgtaaaagtttctcatggtttagatacggagaggaaggtgcccttgcaaatggaggttttctttacagatagaaatttctttcacaaagagcttttaaagagccagtgaaatgccataaatatgtactttggagacggatttagttgaataggtggcttttaaaattagtttcaatttcttaactgggtcattgatttcagggcaacatccattaacgaatagggccaaatcaactcataactctcaggactccatgagaaagaaaggcggccccaaaagggggtcactggtgtcaggcctctgagcccaagccaagccattgcatcccctgtgacttgcacgtataagcccagatggcctgaagtaactgaagaatcacaaaagaagtgaatatgccctgc

SEQ ID NO: 706264 - DNA, 435 bp, Homo sapiens
cttgatgttggtgtcctttggttgaggccattgagtggatgtgctattcctttctgcttgttagttttccttctaacagtcaggcctctctgctgcaggtctgctggagtttgctggaggtccactcctgaccctgtttccctgggtatcaccagtggaggctgcaaaacagcaaagaatgctgcctgttctttcctctggaagctccgtccgagtagggcacctgccagatgcctgcaaaagctctcccatacgaggtgtctgtcagcccctactgggaggtgtctcccagtcaggatacatgggggtcagggaccacttgaggaggcagtcttacccttagcagagctcgaatgctgtgctaggaggtcagcttgtctcttcagagtggtcaggctgggacgtttaagtctactgaattgcacccacagctgc

SEQ ID NO: 706265 - DNA, 267 bp, Homo sapiens
gtcgctcccaatgggctgggtctgtgtttctccagatcctgcgtctccactcgctccttcccagagtctctgaggtctctgctcccggggcttgggaccatgcttgtccttggctgagacgaccacataaacgtgcctggcctactttcagggagcctccctgaattcccagcttcgagtataaaatatattaaacaaacatgatcatacatgagtggcggagcacgtgagggggcgcgccattcaaacgcctccggtccattcaac

SEQ ID NO: 706266 - DNA, 456 bp, Homo sapiens
cccttgcgagtctcatactcttatatgccaacggattaaaagggtcaacataaaaaaaaagacattaggataataaatagtgctacttggggctagtaataaataaaaagtatattaacaaggaatgcacttacccagccacaagtatcttcaaacattaatgacaaacaattatatatggccatagttcacagatacgcagccaaaagctgctccactaacagccttaaacaacatgggagcttcctacccttctccctccccttcaggaagtaatattcacagttccaaagtcctctggatgaaatgctctcaacagagagaattaaagaatcaatgcacctttctgcaaaatggtctgacaaacctttaaaaaaaggtatctcaaggaaaactgcatacaggaacactctatggatagtccaaagtccagaactgtatgccttagcctgttac

SEQ ID NO: 706267 - DNA, 329 bp, Homo sapiens
  misc_feature (68)..(68): n is a, c, g, or t
cacgagcaggcgctgctgctgtcggcagagtcttccaggtctgccagagaggcccccgtcactgtgcngaggctgctccaggcgccggagtaatgcaccttctactcccaccacccccaggcgctggcagcgctgacctccgcaggctccaaagcatcatcgtctgcagtgtctttgaacacactgtccgggtggatcgaggcctcctagggcggcggagcggtcctcggcctggccgatgtctgggtacttgtatgccgtgcacgggcacgcgtggagggtcgctgcacctggaaagtcccaccctctccgtcgtcagaaagatgctg

SEQ ID NO: 706268 - DNA, 429 bp, Homo sapiens
acctatgctgccctttatttctttttatgagagggagtcttgctctggagtgcaagctgggctggagtgcagtagcatgatctatggcccactgttaacctccacctcccgggttcaaacaattctcccgcttcagcctcctaaagcagctgagattacaggcacatgccaccatgcctggctaacttttgcatttttagtacagacggggtttccccatgttgaccaggctggtctcgaactcctggtctcaagtgatccgcctgccttggcctcccaaagtgccgggattatagccgtgagccactgcacgatgatgggaaatttctttatggcgagtttgtatatactcaggatgtagggaaagttagagtcctatttatagggtttctggctggccttgggggaaaggtgctttggttttcggga

SEQ ID NO: 706269 - DNA, 169 bp, Homo sapiens
gctcggtaccactaataatatgtgaagcttattcaagtgtccagtcttcagcacttcccatcctttggaaactcctatctgcctccctcccaaaagggctgtttcttttattaaaaaaaaaaagaaatagaattaaatttgagaaaaggagaaaccctggggaaaagta

SEQ ID NO: 706270 - DNA, 128 bp, Homo sapiens
agctctagaggaccccaagcagttacacagactctaacaaatcaacagatatactagtggaaaacacaatataaaactacaatgccattgtctcctttaattggttaaaagcaaaaatgtaacaggca

SEQ ID NO: 706271 - DNA, 294 bp, Homo sapiens
cttgtgaaacctgttcggactgtaacgtgacagtattacgttggcggactgaacgcagactagtgacggacacgttgacgccaataatgccgtgcagtccgtggaagcctgtggctacaaaacaatgttgagccgtcgactgccgtcggaaactggtgaccgggcgactcgaccgtcctctgacggcttgtaggacgggtaaacactacgacgacccccgtaaaacttgtaactacacgcacgtgcttgaccttacttttggtttccggtctgttctcctacttacgacctact

SEQ ID NO: 706272 - DNA, 371 bp, Homo sapiens
ggaaatttctccctggccctgcaaagactcccccacacccacccacatctccagcatctccttttttcatctcaagctatgccattaacactttggtctctttctgttccctaggagtaagatccctttcctttctgctacagagtctttgcacacactgccgtctcagcctggaaagcactcagcactgttctaatttgtcatttatttgtatgattattcaattaatatatgcttcctcacattatattgtaagagtttggagggcaggtgtatctctggtgcctagtacagcgcctggcacatagcagatggtcaatacatatttattgaattgatgactgaataaatgaatgaatgagtcacaaaaa

SEQ ID NO: 706273 - DNA, 325 bp, Homo sapiens
attcatggatcttcataattgctagcagaaatatctgatcgcctcttatctaggtctctatgcttaggtctcacacaatttaaatccagtcctcttaaatatgatgccatgggataaaaaaaaaaaacccttcctaacttttttttttggggtgccttacccttggctggaaaattaacgggaggcctcttggcatttggcttctaaaacccttaatttttcttttcccacaaccttgattttccaagccctaacttccatggccacaccccttttctctctcaaaaattatttatgcgcagtcttacaggtataacatgccctt

SEQ ID NO: 706274 - DNA, 392 bp, Homo sapiens
cagtgcgggggaaaccacggtagcgggagggaaagaggtaagggacaaaatcccatactagtacaaaggcacagtccgaatgctgcagtgatgacagtgatgatcacgtatgcagaacactacgcactgacacaggtacagttctagcagcttcgacatcattagctcgtatcagccccagaagccctatgggtaaggcatcatcatagcctccttctatcgatgaggctcagaggcccagaaccactaagcaagtttctatcagtgccttgcggcccagccacgggaacactcccctaaacactgcacccgctgtttaaccagatccaaactcacgcgcccgagtcagaccctgactcaccgctcttagctcactaggacacttatgcatc

SEQ ID NO: 706275 - DNA, 357 bp, Homo sapiens
aggcctaccccccaaaccccttggacatcctcctcccccccgggtgcaaaggccaaaggcccccagcccaggggtcctgcacttacttgtttttttgacaacgtttcaacgactccgttggcccctcccaaaggtgggccagtttgtggatcaaaaatgccccccccaaccaagggaacctgtgtccggtatttgatactgcgcctttttgcctggagggtatgactgcccattactcgggggtggggaaaggggtcggctgcccctgctctttttttggtccgtggggcggggccccaaccaaaggctgggttcttttttgtaacccccataaacgggccttgtcctttcgggcca

SEQ ID NO: 706276 - DNA, 125 bp, Homo sapiens
atcaggtggtagaaatcctttagtatatgttactttgtcattagaaaaaataaatcatttttcttccacaaaagactgtgtgtgtgaaacttgggatcctttgaaggaactgattctgaacttag

SEQ ID NO: 706277 - DNA, 1224 bp, Homo sapiens
cacgcgtccggtggagcagcctctaggacgagctggaggattgcgcctactgacccagcgtctcggagcctctgcgggccgccagtacaatccacgtccatccgcttggaaatggacttcgtcccggcccgcgaccgctcccggcggacagtgcagaccccatagaagcccccgaggctcccctttctcgggccccgcccagtcctcggtgtctgtccacccctctactccgccctcaagaggatttcaaagatggaggctggcggctctctgaaaccccttttgggtgctcatccgcctccatcggaggtctgacggggctctcgtgaccccccggcgaccgcggcgggaagaggggacccctgtccaccggcggcaggccgaattgacgacggtgtccagtatacggggactgccgggtttgcagactgcggttctccttgtggctcgccggccggcagaggccgccgccattttcctgctgtcgccgcctgcggagcgtgcaaagctgccgggagttgcggggagggacggcgcagggagacaggagatcccgccgggatcacgcaacgaggcatgacgcctgggaggggccaggggcagcggccataccccaccatatcacgggtgatgctgggaccaggacgatgaaggagaagccgaggctaccccggactttcaccgcagcttgagcggaaggcggatccctgagggtcaagatggctgcaaaacggtgactccccgaaaggctccctggtgtgaacacgacatggcagggtaacagggcgactggcacccaggagcacggagacacagtggcagacagtgcatcgagacagccatcaacacggcaggaacaggaaggacattagaaaaaccccacacaaggggctctgggacccagcattatgacgtggggcccgtgacagacacacacacccggaagcgtgtcaaatcacaaaataacgatgagtggggtaacaaaccagtggagaccgtccaagacggatgaaaaagatgtgtgaggaggaacgtagtggtagatagtaggacggtggctagaaagagacgagcaacatcacaatgaagcgcggagggcagctaacagagacaacgattgagtcagtcaggcggacgattcaccgacggaaggaaccgacgagtgcgcacgtcagccaatgcgctctcacgcccgcgctctctcccttctcgatcgcatcaaac

SEQ ID NO: 706278 - DNA, 377 bp, Homo sapiens
actaccaaaccataaaccattagaaaccacaaatcagccaaggctggatgtggtggctcacgcctgtaatttcagtacttgtgggaggctgaggcaggtggatcacctgaggtcaggagtttgaaaccagcctggccaacatgatgaaactccgtctctactaaaaatacaaaattagctggatgtggtggcacacgcctgtagtcccagctactcgggaggctgagacaggagaatcgcttgaacccggcaggcggaggttgcagtgagcctgagatcacccctttgcactccagcctgggcgacagaacgagactctgtctcaaaaaaccacaatgttgaacctcatacacctagggaagaaaatctcaaactga

SEQ ID NO: 706279 - DNA, 111 bp, Homo sapiens
ccaaacccatgccaccttaccaccagacaaccttgagccaaaccattcaccaaagaagtaaggcgttagaagtttgaaacctagcgcaattagtcataggaccccaaggga

SEQ ID NO: 706280 - DNA, 247 bp, Homo sapiens
  misc_feature (13)..(13): n is a, c, g, or t
ggggggggattcntgccccaccttaactgagtgattaaccctgtgaattgttctcctggctcagaagctccccaactgagcaccttgtgacccccacccctgcccaccagagaacaacccccttttactgtaattttcctttaccaacccaaatcctataaaatggccccaccccatctcccttcgctgactctctttttggactcagcccgcctgcacccaggtgaaataaacagccatgttgctc

SEQ ID NO: 706281 - DNA, 265 bp, Homo sapiens
tgtgtataccacacctggctaatttttattttgtagagatggaggtcttgctctgttgcccaggctggtatcgaactccctggctcaagaaattctcctgtctacggctccttcatgtgctgggattacaggtataagccaacacacccgggcctcaacctttgtgtatacagttgttgctcagtatgtgcaggatactgtttctaggatgctgtgaggataccaaaatctcagaagctcaaagtcccctaaccacgacacagtg

SEQ ID NO: 706282 - DNA, 982 bp, Homo sapiens
tgggacaaaaggtttttttccccaaaaccaaaccccctgtgtgggtttaaaaaaaagggggtttggcccccaagggtccctgtgtgtgtgtgtgtgtgtggcacaaaagagatttccccgcctcttctcatcacacaaggagggaggcgggggggcggcggtcatactatgggggaaaaaaatgagggattacaccaagaagctgcgccgctagacccttctaagaaggaggggggagacattcgcgcaagaaagtatagacagcgcggctgcttggagcgggagcacctcagtcggcccagcggtggcgaccacaaagggagtcgcacccagggagacacccctgctggtggagaatcgaggtgtacccacgagagagcatggcggggggacaaagagagagagggggtggtccgacaccctggcgggaagagtaaaggagagggtgttccacagtagtaaacccacagctcagtatgagagagggcgcacacatatctgtgtcgtgggaaacactactgtggcagtgtgtgctggcctcggagacaccggggggtgggcgaaacaaccccacggcaggatcaccacgaagtagtatgcgccgcggcggcaacacgacgagaaaagacacgacgacgtgggtgcgcaccaggggcgagcaaactataggtgcggagcagcacttcgggttggggatccaaccacacacaacaaagagcaccagtgggtggtgttcctccagagaggacaccgcctgtggaactatagaagaaaaaaaaggccgcgccaggagagaggaggttattaacggccccaaatgtaggcggcgatcaaataatacgtcgtaggagaaaaacagcggcggcggcacaacagggggaaattcctcgccgaggggacaaatggtccagccacgcaaatttattagggggggggggacaaagccacacatcttggcaaaacttatctccccgttgggtag

SEQ ID NO: 706283 - DNA, 265 bp, Homo sapiens
cagaggatcccccgacgtgtgcctgaaatctcctgctgaggcaggagaatcacttgaatccaggaggcagtatctcccacctcagcctcctgtagtagctggtattacaggcatgttccatcatgcctggctaattttttggttgtttgtagggacggggtctccctgtgttgtccaggcctgtctcaaactcttgggctgaggcagtcttcccatctcagcctcctgagtagctgggactataggcacacaccatcatgcccac

SEQ ID NO: 706284 - DNA, 207 bp, Homo sapiens
agaagcaagcatatgctgacggagaatgttttcatgttacttatactaacattagttctactatagggtggtcagtatagataggtcagtatagataggtcagtatagggtcagtatagataggtcagtatagataagtcagtatagatagcgtcagtatagataagtagtatagataggtcagtatagatggcgtcagtatagata

SEQ ID NO: 706285 - DNA, 569 bp, Homo sapiens
tgtgcatcgcaccgtgctgtacatgtgcagacgcagcctgcagccaggtttttatttaatgtaaatagtttctgtttccactgaggcagtttctggtagtcctatgcaatattacttagcttttttattgtaaaaagagaatcaactcaactgtcagtactgagaagggatttgggtgtaggggcacctggcctccgggagccattgggctgtagactggtgtcggtatccatttggtggttggtttttaacccaaactcagtgcattttttaaaaatagttaaaaatacaggacaagaacacttgaacacacagaacggagactatgcctagtgtaggttttgcagttaatggcctgaatgctagttatcagatcacctgtttcgctgtgggaacaggagagaaggtgatgaacaaaccaccatccgctgcatggtcacagtagagcccccgtgactcgcctgtctttgggtcacctgcattccatagcattgtgcttgtacttgtgctcacacggttacctagggtaggctgggagccattgtggggtgcagggcctggcttgtact

SEQ ID NO: 706286 - DNA, 104 bp, Homo sapiens
ttcaaatcaaaaataaaaattatttcccttttgttaaagaacttacagggtcagggttttccttgtcacttagaattggggccctgccaggcaatcctttccca

SEQ ID NO: 706287 - DNA, 323 bp, Homo sapiens
tttaagaccagccgggacaacagtgctgaaacccggtcttaacaaaaaaatacaaaaattattcaggcgtggtggcacatgttggtggtcccagctactggggaggctgacactaggggtgctgagctgacatacagaactattcagctttataaaaatgtgaaaaacataccgctaagtcacggacattccacagaacaaatcataatagaaatgaaaaaacagccgggcacaggggctcaggcctgtaatcccagcacttggagaggccgaggggggcagatcacgaggtcaggagatccagaccatccgggccaacacgg

SEQ ID NO: 706288 - DNA, 187 bp, Homo sapiens
  misc_feature (168)..(168): n is a, c, g, or t
ctgcatcggagtatatgaaaccatgaccgagcgtcgtttcggttatgaaaacttcaatgatgtaaggcgatctgggcgtgaaaggcgacgaacgccgtaacgtaaaagaacgtgatgtggaacctcgcatcccatatctgcaaaccacgttggaacctggacatcgcngctgagacgctgagatgcc

SEQ ID NO: 706289 - DNA, 520 bp, Homo sapiens
  misc_feature (1)..(1): n is a, c, g, or t
  misc_feature (74)..(74): n is a, c, g, or t
  misc_feature (94)..(94): n is a, c, g, or t
  misc_feature (120)..(120): n is a, c, g, or t
  misc_feature (132)..(132): n is a, c, g, or t
  misc_feature (150)..(150): n is a, c, g, or t
  misc_feature (175)..(175): n is a, c, g, or t
  misc_feature (182)..(182): n is a, c, g, or t
  misc_feature (216)..(216): n is a, c, g, or t
  misc_feature (219)..(219): n is a, c, g, or t
  misc_feature (306)..(306): n is a, c, g, or t
  misc_feature (354)..(354): n is a, c, g, or t
  misc_feature (369)..(369): n is a, c, g, or t
  misc_feature (371)..(371): n is a, c, g, or t
  misc_feature (394)..(394): n is a, c, g, or t
  misc_feature (397)..(398): n is a, c, g, or t
  misc_feature (439)..(439): n is a, c, g, or t
  misc_feature (455)..(455): n is a, c, g, or t
  misc_feature (470)..(470): n is a, c, g, or t
  misc_feature (485)..(485): n is a, c, g, or t
  misc_feature (491)..(491): n is a, c, g, or t
  misc_feature (514)..(514): n is a, c, g, or t
nagagggcagctctgaactgctggctgggaccagctcagtaggaacagatgaaaggaagttttctgaggtagtnggctcgacgccagtagcttnctcgggtacacagggccacgcagtanccactgcgggancagggctggtgagcagcntagtacgcaaagttccagcggctgntgttaantcactgaaagtgtgtgcagcgacctgagcttgtnatnttgctttcaatccagacttgaccttggttgagcgcgctgatagaacattggatttgataattaatattgaagttgtggatggaaacnaggttgctcttgtagtaccttcggtaagtaaactaagtttgattaaangtttgaagatttttnancaggaggtagtggcaggtttggnacnnagggatgctcaccacttttattgtgttttcttcctcagganacgtaaggtttttgtncaccatatttggcantgagatagatttaanagctcnattttttttggagggattttcanttccag

SEQ ID NO: 706290 - DNA, 494 bp, Homo sapiens
tgcattatacgtactgatgtgaatgtatgaagcataaaggtgtgacttcatatcgaaaggctttctgcatctattgagataatcaagtggttttgtctttggttctgtttatgtgatggattacatttattgatttgcatttgttgagtgcatcccaggaatgaagccgacttgatcgtggtggataagcatcttgatgtgctgctggattcagatagccagtgttgtattgaggattatcgcattgatagttcattagggatatgggcctgaaatattctttttttgttgtgtctctgtcagattttggtatcaggatgatgctggcctcataaaatgagctagggaggagtccctctttaactatggtttggaatagtatcagaagaaatggtactagctcctctttgtacctctggtagaaattaggttgtgtctccatctggtcctgggctatgttatggttggtaggctatacactactgcctcaattt

SEQ ID NO: 706291 - DNA, 212 bp, Homo sapiens
gatacagtccgcaattactagacaaggccattcacagtggctcacacctataatcccagcactttgggaggccaaggcgggcagatcacttgaggtgaggagtttgagaccagcctgggcaacatagtaagaccccatctctacaaaaaagagaaagaaaaaaattagtggggtgtgatggtgtgtgcctgtgatccctgctacccaggagg

SEQ ID NO: 706292 - DNA, 714 bp, Homo sapiens
tactgaggaggctgaggcaggagaatagcttgaacctgggaggcggagattgcagtgagctgatgttgctccaatgcactccagcctggccacagagtaaggctctgtctcaaaaaaaaaacacaaaaactagccaggtgaggtggtgggtgtctgtaatcccagcacttttgggagaccgaggtgggtggatcacttgaggtcaggagttcgagttcgagaccagcctgaccaacatggtgaccccgtctctactaaaaaatacaaaaagctgggtgcggtggctcatgcctgtgatcctagcactttgggaggccaaggcaggtggattgcttgagctcaggagttcgagaccagcctgggcaacatggtgaaaccccatctctactaaaatacaaaaaaaaaattggccgggcatgatggcacactcctaccttagcctcctgagtagctgggattacaggcgtgcgccaccattcccagctaatgtcgtattttcagtagacacaggtgtttctcccatgtctggtcaggcgtgatctcaaaactcctgacctcaggtgaatacaggccgcctagcctccccacagtgttgggaattactggcgtgagggatcggggcccagcaagcatactggacttagctttgacctataccagtttttgagattaaggcagggaataactctcttctgaacagtctcgataacacat

SEQ ID NO: 706293 - DNA, 317 bp, Homo sapiens
acgctgcaccgccgttcaaagttaagaacgggaagaatgggtggcaaggtggctcctggaagagctcccccagcacaggtgccctgagctcggagccttggttactagtccctggggagatttatatttaataaatttttatataaatacccagagacatagacaatataaaatctgaggggttggggcagaagcgtgagggactcaagcaggaagccagagcttggagaggtcccattcagggccaaacttgacctcctccttgaacccctttggcttctgggttctcctccttgggttttctcctcttcggtgac

SEQ ID NO: 706294 - DNA, 1004 bp, Homo sapiens
gcactgccaaatatcccaaggaggggaatttttcccttgagtggcatctttcaaaagtgtgacgtgtgatagagtgttctttactcgggggaactgcgctgaaaaaatgcctaactctcgggaatttggaaggtgtcggaagttaccaacccaaacccaggggccagcgaaatctccgttttctttagcccccccccgggaccaccagaaatgtgtccttgggggagaaaggcccggccgggatttccggggacttgcactgctggtgagttcccagaaagaaggttttgggcttttccccagagggcgccattgtagagcctttaatatctcgataaaaggtgggcccacataaagaaggttcttgttgtgcccatttgccccacaggcaaagttcttctgcggttacccaaactgcctaaggaagggcttttgctgtgtgcggaaggggcctcgcttattggttgttgcttccggtttcatacaatgggaagagattggggccccaaaggcttgcagaaggtttgttggtttttggggagaaactcccgagggaacacagagggctaaatagccctagaagttttttggattggcctcgatgagttccaccacccggaagaccccttgttaactactaacgttgagacacactgctgtgcgccacacgtgttggctcaagaacacgggtgttctgggcaattcaaaggtgaaagaatcaatgctggccctgggaacccacaactggtaaagaattggccctaagaagcccctgcctgagccaacgtgaggcacattgtggagaaccccaaagaatgacgagtactgcccacccacacccccactttcagaaacacagaaagggtgggaaagccacagagagccgcctgccaagccccacagccacgtccccacagcataacagggtttccttggcagctgtattttggagtttggatgttgctttttaaagaccctttcaatcaaattttgtacaaagacca

SEQ ID NO: 706295 - DNA, 842 bp, Homo sapiens
  misc_feature (53)..(53): n is a, c, g, or t
  misc_feature (262)..(262): n is a, c, g, or t
  misc_feature (363)..(363): n is a, c, g, or t
  misc_feature (675)..(676): n is a, c, g, or t
  misc_feature (776)..(776): n is a, c, g, or t
  misc_feature (801)..(801): n is a, c, g, or t
ccaaatagtaactgcttcatccatcacagccaggtttaaacttgccatgaccnatcatttaaatttttctgtttctatctagtctatataatggcagttatgctgtacatgtactccaagctgcaggatttcataactggggcaaatgtggttggatttcatcccttactggtctcaaccaaaatattcctgtaggaatcatgacgataatcatagcagcacttttcacagcatcagcactcatctcactacttatgttcanaaaagtacatggactatatcgcacaacaagtgctacttttgataaagcccaacaggagtttgcaacaggtgtgatgtccaacaaaactgtacagaccgcanctgcaaatgcaccttcaacttgcagcatctactgcccctcagaatgctttcaaggataaccacatttaagaatcttcatacaatacactgttaccttttgactgtacctttttctccagttactgtattctacaaatatttttatgttcaaaacacacagtacagacagcatgaatatttcctgttcacttttgcctggcctaaaacccagaaaacttgcttgtcttattactttacctaatagtttcttaatttttcagtgccctttgtgtaaaatattacatgctaaataaatttctccatattaaaaanncattaaacagaaacccctataattcaattatttctaagcctataaagaacccagaagtctcataaaacaccaatagcctatcagcctacattctatattncaaagtctcaagtataactatagtncattagtgatttcttctcttcgctaactcattctcacttgt

SEQ ID NO: 706296 - DNA, 250 bp, Homo sapiens
  misc_feature (212)..(212): n is a, c, g, or t
gacgtatgtaggatcaccatacattggatatgcacccaagtactgggtattctaggcacaccggaagcactaaaaagaaaaacccagaaggagctggtgaatgaatagtgaagcgaagtccatcaaagtgggaatggagtaaaggcttaagtgcagtggtgtgatcatagctcactgtaacctcaaactcccgagctcagacaatgctcctngcctcagacgtagcaccaccaatacgcgcaggtaggca

SEQ ID NO: 706297 - DNA, 946 bp, Homo sapiens
actaccatgactcctacccctcacaatcatggcaagccaacgccacattatccagtgaaccacatatcacgaaacaaactctacctcatctatactaatctccctacaaatctccgttaacttataaccattccaccgcccaccagcacactaatccatcatttccatatcattctatcgaacaaccaccactataatcccccacctctggctatccatcgacccgcatgcaggcaacccagcccagcacacagcctgaaacgccaggcacaatacattccgtattgtactcacacaccatagctaggcctcccattcacaccatacatcactcgcgactcgcattgtaacagcgtcaccacacccaccacctagcgactcacataacaccatgccctcactcactcacactactacaaatagccgcgacagcaacctcaatccaacaatccttcgcagccccaaccacaactctccctccatgcactccagctctcacacccacagtcagcatatcttcatccagtcaccgaggcaatacaccctccctaaacacacagggacgctacaccacacactcagcggacccatcaccctacacaggaccacaacggcaccagacacaggcccacccgcacatcctggcccctgcgcagacacaaacagtacgaccacgcaagcgccaccgcaaagaaacaactccatatacacaacaaacacaagagccgccgacagtaagacgcggatcagtcacagcacaaagacaagcgacacaacactaaccaaaacacctccaaacccacccccacatgcacacaaaaccacaccagcacatacggcccccacacacacaccctatccactaggcacccacacaaagccccacaacagaacggacaaacaacgccactaacaccacgacatcccatccccggccaccagcagc

SEQ ID NO: 706298 - DNA, 226 bp, Homo sapiens
cacctatgtgtaaaagagacagactgccttggtgtgtgacaatggctctggtgctctgtaatggccggctttgcgggggacgattgctcgcagggcgtgttatcccatccattgtggcgacgtcccaaacttcaggcgttgatggtgggaatgggacaacaagacagctacgtgggtgacgaagcacagagcaaaagaggaatcctgaccctgaagatgttggtgg

SEQ ID NO: 706299 - DNA, 807 bp, Homo sapiens
gttcaccaggacaaatacaggttctatggttgttacccagcctggggaggagccttcagtcggcctggatgtcagcccaaagcatgtgctgtcagagaggtctgtgctgcagtgtggtctgacggtagctaggatgacctggaagttcctccatgagaatgagtatgttcatggaaatgtgacagctgaaaatatcttaagtggatccagaggaacagagtacaggtgactatggcaggctataggctttcgccataccgatattgcccaagtggcaaacacgttagccataacgatggaaaggcagtaagggagacccatcaacaacagaggagaaccattgacgatacagttatgcaatgagacacgtacaacaatgaggatagcgaaggtcacctcccagcacgtcaagcgaaacctccatgaaagacctagagaactaaaatgcaaatagcaagaaaagaagagacacataaacgaaagaatatacaatgaacaaaagtgaaacaaaacgtttgcacgataaccacaaatcgaacatgacgggaacaatcaactagaagagacaaaattaaaataacgtgaagagttagtctaagaaaaacaagacaaggagaacaacatatagaagaacgacacccaagcagagacgaacagggaaacaagagaacccaaagaaaaaaacacaataacaaaaccaaaccaaacaaaaaagaaagaaaagaaacatcaaccgaaaaataaggcaacaaaacaacaaaaaccaacacaagaagaaaaaaacagcaagaaagaaaagaataaagc

SEQ ID NO: 706300 - DNA, 921 bp, Homo sapiens
gctggggcgctgctgtgtgcttgctgaccggggcctcccgcggcttcggcctgacgctggcccggtcctggcctcatgctgtctcccgggtccgtgcttgtccttagcgcccgcaaagagcgaggcactgcgccagctggaggccgagctgggcgccgcatcgtgtctgcgccgtgcgctgtggatgctggttgcccgccgactctgggcgccgagtgcgcggcttgcagcagcatgctcggcgccctgcgcgagctcccccggcgccaatgtggctgcaggcgactgctgcttatcaacaacgcggggtaagcaccccgtggctggagcggactccccatgtgagcgcccacgttcctaccaccgcttgggtgaatcttaagggctacgtcctaggggtcagataggacgcctagaaatctaaagccctagtttgttccagcttgagtagcaatgtggaggcgaggtgtacaggaagactcgggttgccgtcgggacacacaggtcttgaccccgacttctctggcaaacagttcggccgatgccggagtcctccaaaaagcgccttgtagaacttacccgatcgccttgatcttgggcccctctggcggcatgcctgagtcagggcttgaagtctccaaaggaagtaaactctctgcttcgtccaaaggaccggtcagagcattaacgttcaggcccaaggacaagggaggtgccttctcaattctggcagctttgggcatgagctgaagttacccccagactgttgactattaccggaagcaggcaagcggaaatgcagatgaaagccatcttgaaagaaaagagccatatggcgagcgtcacacaccgtctaagggtactgacatgggagagcagggaaaatggggaggcaagtaggaagggcttggcgcaaaataa

SEQ ID NO: 706301 - DNA, 1055 bp, Homo sapiens
  misc_feature (1055)..(1055): n is a, c, g, or t
aaaggctggtgggagattcagagtccactggtgctttcgatttgacttaagtgaagtatcttggagcctagagccagagcttcgctaagacccacaaagactgcagttctgaatcttatcttggcttgtggatcttacaaggagaatcactaatcacagacgagattcagtgattgatccaggtgtttggacgatggactggttgagcccatccctattaataataagatgtcttctgagcaaccgggagctggtggttgacgtattctcgtccattacaaggcttgtcccagaagaggtagtacgaagctggagtcaggtaattattgaatgatggtaagagaacatggacatgcggcccctagaaggggacctgtaaatcgatgatggagagccccagtgccatgaatggtgtacccatcctggctcctggcagacatccccggggtgagttggagccacgtggttcaccagcaatgaggtttggatgcccgggaggtgatctccatggcagcagtaaagcaagcgctggaggcaggcaggctgacgatgttggtaactgcgtgtaccgccgggtcgtcagatgacctgacatcccagcatccacgatcacccaggacagatatatcagagcttgaacaggtaagtgagtggagctcttccgggatggggtaaactggggtcgcatgggtgtcctttttctcctcgggtggggcactgtgcgtgaacgcgtctgacgaaggagatgcaccgtagtggtggaatcgggatcggcgtggattgggccctacctggagttgtcaccttagagcgctggtcccggcgaagggagggggaacctttggggacactttgcgaaaaggggacactctgctcaattgccggagtcaccgcgttaccagagagaaatgcagcgcgtgcgctgcgagcaaaagcacagtataaagcacatatacaccctttatgcactcatcacgtcaaaaaatccacactctatgggtaccacaaaaaaatgaaacaccaatagagatgtgcgtctgacttgcaatcttggn

SEQ ID NO: 706302 - DNA, 160 bp, Homo sapiens
cttacagtggtgggggagcgagaggactgggtgagtgttccctccttgggtgtgggagcctccttggtctgaaggagccagatcactctcattggtctcgctgcctgtttcttgagccccgctgccggcgccgcttggggatttcctcatactctgtaac

SEQ ID NO: 706303 - DNA, 119 bp, Homo sapiens
cgactccgggtctcgcgggccgcatacggtacagtgccccaaacacttggccagcatgcaggggctgcccattccatgctgggacttcaggccacacggtacgcagctgaggccgccca

SEQ ID NO: 706304 - DNA, 269 bp, Homo sapiens
catcatcacactcagctatttttgtattttttgtagagatggggtctcgccatgtttgtccaggctggtctcgaactcctgggctcagcaatcctcctccctcagcctcttaaagcgccgggattataggcatgcgccaccacgcccaactttgttttaatgttcgttgtgacagaagcagtaaaatggttgtgcatctctgtaggtctcaatacaaccatatccattttaatgctaccctccaaagagaaagacctgagcaagccagg

SEQ ID NO: 706305 - DNA, 242 bp, Homo sapiens
catgtgtttgtgtctgtatgtgtgtaaccatcctcaagagtgtaaagtcatatctcattgtggttttgatttgcattttcctaatgatgactagtggtgatgaacatcatttcttgtgcttattgttcatttgtatatctttggagtaatgtctgttttgagttttttgattttttttaactgggttttttgtctttctgttgttgaattttaggagtatgatattaaactgtatgtgatac

SEQ ID NO: 706306 - DNA, 436 bp, Homo sapiens
  misc_feature (251)..(251): n is a, c, g, or t
tggtggggaaggtccaaaacaaaaaaaagttttttttttttttttgtcgccgggccaaaaaaaaaaaaataaatttccctttttgcttctctcaaaagaggggggggggtttttttttttcctctttttaaaaaaaaaaaacccctggagcagtggggaggcttacgcaataaaaccccaggacttggggggcccaagccaagaggtatccctttggaggccaagagtttgagacccagcctgggcaaaantggggtgacccccatctctacaaaaaataaaaatatttgccgggcatggtggtatgcatcttgaagtcccagctaatttggaggttgaggtgggaatatcatttgagcccaggagttcaaggctgcggtgagctatgatcacaccactgcactccagcctcggtgatagagcaagaccttgtatc

SEQ ID NO: 706307 - DNA, 264 bp, Homo sapiens
ttgggcagccacctttggccagcagcactgcgatgcacttgctgaccgcccatcatgatatgtctgtacccgccccagcgaaatggtgctctcctgcagctgtttccaggaagtcatagatatgtcctgtatcaaaaaaactggttgtccattctcttcaaagagcttgctctgccagggccataaacaaataagaaaggctcaggactaataaaaggctcgctatttgtctgagacaatcagcccagacctgagcaagccagg

SEQ ID NO: 706308 - DNA, 1090 bp, Homo sapiens
ccccttgctgactactgtgtcaacagctggaagcgaacttggacggggaaggactttactgtctgacaccctgaggaatgcctggaacttccagaggatggaggaggatacaaatacgcatggataggatggaatagcatgccgagttgtgactagaccgtcgtggctgacatagtctatggatagggatagtattggggacgcaagatagcgttgcagaatggcgtgcgatatgtgctcgacaacgcgacttgtggtaggacatcgtcgcatgactggtatttggtcatcatacgcatgcatttatggttctgcatgcatcacacatcatgtaggtagaagataatcctgtataagcctcaaaagccctctaagagaacaagcttcacatgaactgcggggttatccatgaggaacgccgaaaatgacaacgagccctggataaataaaaccgctgaacacaatttcgcacttagttagaggagccgtgtatgggtccaaatggagcatgaggcattgactactaatcgaacatacgctactgttgagccggactctgtgtctcactactctgtcgtttgaaatgaatatcgtgtccctcctgtatctgtctggggcatatctatgatcttggaacgatccccctagaataccattgtctaatctagggactccgagcaggggattgagtcatgaccttgggctctggcgatattcgaatgaacccagtgatccctacatggtcttgtactgtatttacctacctagggtggacgtggctacaccgggaatgggataacgtgtcaccaacccgcattgtaagggaagaatgaaacgcatgagcagtcacgcgcgatggatcgtaagttccgtgaacctaactctcttggcttgagggggcaatgactaaaaccctggtttcaggtacttctaacaaattccctctgcagtaatatattttggcccccggggtgttggaactgttatttagaggttctcatctgaaaaagtgctggtgttggcccttaaaatagaactttaagcgggggaggacttcccctttctgttcttactccatggattgcgtgca

SEQ ID NO: 706309 - DNA, 86 bp, Homo sapiens
  misc_feature (1)..(1): n is a, c, g, or t
ntccttcatctacctaaccacaggaacttgatctaggaaaagtcaagagaagagagcagaaagcaggctcttgctgcctaaaagag

SEQ ID NO: 706310 - DNA, 205 bp, Homo sapiens
  misc_feature (37)..(37): n is a, c, g, or t
aaggccagggttgtagaaaacatccccacatggcccnccagtggagacctgtagggaagattgtacttgcgaagcctcgaaatcaggcaccctggcttgccaatatgcttgtctattgtcttaatagtcagcctcaggattctgtcatctaacttacacaacttcattctctccaggctggttcttccacttttaaaatcataat

SEQ ID NO: 706311 - DNA, 831 bp, Homo sapiens
  misc_feature (687)..(687): n is a, c, g, or t
gtttcaccgtgaggacctgctggagtggctgcggctgtctgtgctgatgacgcctgttgcggtgcgttcccgattcacgtgctgcagattgggggcaatcatttgcacctgcactgaggaggacagtagagctcctcgtgttctttagcaagtgaagccattctcgagatagccctccatggtcgcccaatgagacaagcgtagacgatagcgtgacatttgatgaattgaggagaaccggtacatgtcatattcatggaacgtccgtggtaatctagatctacgcgacgaggcttgaagtttcacgcagcgttggttatacttttatgcgaagcattgtgctacctatgaaaagtgaatatgtcataaccaactaatccagtgggtgagactatgctacaggtgatgctagagccagatgtagcgatggagaatcaaggaaggagttggggaactgaaggttttgaaccatgtgtcgtctcgtttgtgttataacagcgcagatgcagagtgctgcctgctgagggtgtgaacggagctgtgttctgctgctgcttacatccagtctcctcctgcttccatccgtctagaaacttctccctcgagagcgccgagatgagcatctgcacgagatggcactggagcaatgtcacggcaggcagctaccggtgaattgattccacatgngtgagcaatgaacttctgtccgctgtcctgtgatgccaagctgtggtgaagtgtgttgcagtcccttctatccacgtattgttgaccactcttggtagctcagcaggggctgggatccgaggacctgggaaaacctggggagcc

SEQ ID NO: 706312 - DNA, 1611 bp, Homo sapiens
taaaaaaaaaatttttttttggggcccccacatatggggcccgcgggccgtggccataaacccccccacaaaaaaaaaaaaaaaaaccacaaaatgggggggaaaaacaaaatttcggggggaggaagaaggggggcagaagacaaaaaacagggtaggggaaatccgaaagaaccaccgcgggggtaggagggggtgtctctgcctcttagagggcctcctctctttgaggggctctctctccccacgcgaaatatactctctcctccctctctttgtcgggggaggggtgctgtctctcccctggagacgcgcgcggtgtgttctcctcacaaagagaagagagagtgtgctgcagagtgtgtgtgctcctctcacacacctgcggggggagacctctctccttctctggtgcgaagtgagacctctcgcgcgcgtgtgtgtgtgccacaccgagggagagagagagagagactctctctgcgacggcgcggtgagacacagtgtgggccgagagagaaacacagtgtggccccagcgaagagagagactcctcctgatgagagagagacacactctgcggaggagagagtgacggtgtgtgcgccacaacagtgcggcgcacaagagagaggaggcgagagagcgtgtcgctcactgcttttgtgaagaggcgcgccccaccaagtgtagtggtgtgcgtgtggttgtgaagtagacaccacgccattgtgtgttgtgtggttgtgatgagaccatacccgctgatgagaagagcagaatattttgttgtggggcggcgcccatcagatgattcctcctctccgcgaggaggagtgtatttttcttcttcactctcttcaccacatcttctaatataacacgcgtggtgggggcggggggcggtgatgaaaacacaccacaccgtggtgtgtttgtgttgtgtggctgggcgtcgcctcacgagataatacaatcatatcattaaaaaacggccgtcgcggtgtgttttatagaacgccccgcggtgggtcgtcggcagatgcggcgggtggtagtcctctcttggtggaatacatcacacccacaatttctttgtggttggcgtcgtgaccatgacgtgagaaaacacacacaaccccctccctcctgtttatttttcctctatcacctccccaacacacgacgaaggtggaaccacaagaaggagcacaaactctccttctgcttaacaaataagagtgctgtcccgccactatataaatttctttgtttgtctccccacacccgacacacaaagacatgattgtgcgttgttgcttctacctaggagaagcagcgcacgtgggttcgtgctgataataaagcgagtactcaactacccactaggactgggcgagcgaggctgggcgggggacgccgactcacatctattctaattgaccgaccccacacacccatacatagtataggtcggctcgcggtcgccaccacacaaactggcggtgcgaccaccacctgtggtgtgtggagcaaaacacacacgcagccgcatctgtcttatataacgaccggcggtcgacgacaaaacccataactcgtttgatgcag

SEQ ID NO: 706313 - DNA, 138 bp, Homo sapiens
tagagatcgactctgaggatccccctggggactccttattgcatatacttccaaagcatccgccatctggttctaggaagggcctataagatatttaggagaaggaagtcattatcattccatcttcaaagcaaaagg

SEQ ID NO: 706314 - DNA, 174 bp, Homo sapiens
ccagtgctaacattaggtaattaaacccatcgcgaaaaaaaatggaaaaaaagttcggtccggcttcgaccccgacgcagaaaataaacagcataaagccaagattaagcgcatcggtgttaatgctgaaatgttgttggcctaataacagcgatacgactaaaacggcaatgg

SEQ ID NO: 706315 - DNA, 246 bp, Homo sapiens
ttacatgggcacagaaatcagtacctgcttacacagcatctggttcggctcgagcatgagaggatcatagagagatgcgtgatatgagtcgtgaattctctttgcaaattctctattctaactctggagcccaagtgccagggtggagtctttgttctcccactttctagttagctgtccttcagcaagttacttaatttctgggcctcaatttcctcatctgcaaatatctagtgcccatttcaa

SEQ ID NO: 706316 - DNA, 95 bp, Homo sapiens
cccaaaaaaaggaggtggaggcacccaaaaatttcaggagccagtttcctttcctggtttttttccttccttcctttgaatttaaagaggggtaa

SEQ ID NO: 706317 - DNA, 474 bp, Homo sapiens
cagttgttacattgatatagattttcaaccagaaagataagatagtgctgggagaataaaaaagatagggtatcttccaacctcactgactataaatcttgtggaatacagcactactaaactaaaaacacacgtcaaaaagaacaattcactaatcccagtgggatgctcaaaaatcgtctttagcaaggttacaggattggctaatactgctattatcttattggctgcggcaaaacaagaacacagagctgctgtctaaaatatctaccaaactcccctccgagttcagcaggcaacaactcagatttgaaagaaactctgcagcaccctggcacatatggttagctgagtcgacatatgattagcaggcatttcaaactgatttcctcttaacatacgcaggagagacaacataaacttcctgcagggcatgtactactacatcatatctctgactcccttcttcctata

SEQ ID NO: 706318 - DNA, 141 bp, Homo sapiens
gttggtctatgagcgcagtagaagtatgcggatagaatgctgtttcctcggtttcgttgagtatatgaaccttgtattagacttatgcacaatagattcattctaacacaaagtcaagatcccacaaggttcttgcgttga

SEQ ID NO: 706319 - DNA, 427 bp, Homo sapiens
  misc_feature (417)..(417): n is a, c, g, or t
  misc_feature (426)..(426): n is a, c, g, or t
caaggacctccaacaactcaatgaaaaaaacacaaataaactccattataaagtgggcgaaggtcacgaatagacatttttcaaaagaagacatggatgtggtcaaaaagcacatgaaaaaatgcttaacatcactaatcatcagagaaaggcatattaaaaccacaataagataccatcttacaccagtcagaatggctattactaatgagtcaaaagacagcagatgtcatcaaggaataaagagaaaagtaaccacttaaacattgttggtggggaatataaactagtacttctatgggaaaggcagtatcaaggtttcttcaaaggaactaggaacttaaaaatacccttttgatcccggcattcccaccacggggatatcttcccaagggggaaccaaattcgtttacattnaaagggcant

SEQ ID NO: 706320 - DNA, 261 bp, Homo sapiens
cggcacgtggtgttagtccacatagatgggtgattgtaacttcattgccagtaaaggatgtcaaattgcagtcatgcttctgtgtacacatagtgaaaaatgggcaaataatgaggatctctccttcagtttgctttgtttaattctgttgtgtgttgttctgtaatgctgcgtccctaattgtacacagtctagtgatatgtaggagtataaagttgtcgcccatcattaaaattcacaaagttggtttatgaaaaggca

SEQ ID NO: 706321 - DNA, 120 bp, Homo sapiens
atcttggatcctcaacccgctatctttgtttcttatctggtctaccacatagccttctaactagtattctagcatatccttcttatcctctttcacttcttatcttaactctatatctca

SEQ ID NO: 706322 - DNA, 239 bp, Homo sapiens
gaaacagagacttgctctgttgctcaggctggagtacagtggcccaatcttggctcgctgtaacctcggcctcctgggttcaagtgattctattgcctcagcctcccaaatagcttggattgcaggcgtgtgccaccatgtccagctagtttttgtgtttttggtggagaaggagtttcaccgtgttggacaggagtttaacaacaggcctggccaatgtggtgaaaccctgctctact

SEQ ID NO: 706323 - DNA, 239 bp, Homo sapiens
gcggtaatgttaaatagtcaaagggggtgttctctggtgggcaggggtgggcgggtcacaagtgtgctcagtgggggagcttctgagccaggagaaggaaattcgcagggttaatcactcagttaaggtggggcaggaacaaatcacaatagtggaatgtcatcagttaaggcggggcagggccttttcacttctcttgtgattcttcagttacttcaggccatctgggcgtatacgtg

SEQ ID NO: 706324 - DNA, 114 bp, Homo sapiens
atcagcataaataagtcccatctgaagtcgcaccccatcttcaccatccagaaacctgagtctacctctacaggaccctgggatttaactccgtctctgccttccatatactgc

SEQ ID NO: 706325 - DNA, 834 bp, Homo sapiens
gctccatcaacagtgcctataccaccaaaatactacctcctgagaatggaaggcgccctcccacgccaggtgggccattaagacggatgtgcgccctgctgggcttcgtcttggacctgaagcgggacttcctagccgcgtgcgcgagcatgatcccggtaagacaatgctttacaaacgtgtacaccttcaactcggtccgcaagtccatgagcacagtcatccgcatgcccgacgggtggcttccgcctcttcagcaatggtgggcctcatgagatcctcttgtaaaaagtgcagccaacagtcttgaagcagcacactggcgaactccggtggctttcggaactcgggaccggtgacgacatgtgtgaggacagatcactcgagtccgaatggcttgcgatggccgtcacgatacgcatctgcagtcaggccttaccgtggcacctttcgtcatgcagggccacgggagccctgatctggtgagcaacgcagaattgatggatcgcatggcgtgaccctcagccttgacataaacgtgtactgtgcggcactttgaaggaacccactttgtgccggacgccagagtgttcccccattgaaggctattccggaaacaattgcacacgcagttggcttggacattccacatagttccggccagttggctgaactaggtgggaacaacaccatccaaacagcggcacacggggaccactccgacagaaccaaaattggcgggcaatcagtccaggacccgagaggacggaacttacctggtgccctaagaaggggaaggaagtccaagccgtgtggattcctacacatgagaac

SEQ ID NO: 706326 - DNA, 577 bp, Homo sapiens
catggggtcgtataataactcctcttatgtaccacatatttagtaactctgtgtttctcgtctttcttatttcttgataacgccgtgtctctatagctgaataaatcgtatgatcttttaaagaactaacttttggttttgttttctctcttgattttttgttttcaatttcagtgatgtttgctctcatttttattttgttcttctgtttgctgtaggcttaaactgctctttctgtagtttactaaggtagaagcttagattattgactatagatatttcttcttttctattatatgcattcagtgatatacacttctggcttattactgctttcgctgcatcccacaaattttgataagttatattttcatttagtttaaaatattttaactgtaagagttgatttgccattttttggtctggcagttcttttaggcagtttttgcctcatattttgacatgctgttgttaggtgcatatatgataaggattgttatgtcttcttggagaattaacccctttgtcattatgaaatgacccactttatttctgataatttttttatgataccgcg

SEQ ID NO: 706327 - DNA, 728 bp, Homo sapiens
tccaaacaagggtttgaaacaactacgggaattttgtccacaataagctggaagttggtggtagtatgcctcaaatataactgacggtatactataggggtaacttttcaaacagcccttagcacttttatactattttaacccattggtgctttgagtttccttttaacaaatgcttgttgtgaaagacacagatacccagtatgcttaccgtgaaaagaaaagtgtgtcctgtttggtaaaggaacttcaagttattggtcgtaaatactgggacagaggttggctgaactttaaaaaaatattaatttcattattataaggacctaatttattactcctggaagattaacccattttttggtcttcagaatttcacaaagaacaagacacagggtgtcctacgctgttggcctcacagggaaaaacaagatttttatcagggacgcaatatttttatctttccaaacataatttgcgtctaatggaatacttttcccaacaacttacgactggaacttcagccggatatagtcataaccttctgggtggggagattaatcccattcctggcatcaaaaacggtctttttcacaaaaaacaaacttggtaagatgctggctttgggtttttccaatccaggcgcagtttttttgaacaatactaccgagggaatttagggacagggtggtacaattcttttaattattaatttcaccgcgattttg

SEQ ID NO: 706328 - DNA, 635 bp, Homo sapiens
ccgaggacgcagacctgattactgcgcgccctgcgagaatcagtatatcaccgccagcatgctgtaccgattgcacaaggacatgaggatcacgttactgatcgagtaactagctctggtccgtggctatgaatgaataaacgtgcattggtatgtttctagtaccctctgtaaagcatagccgactgatgatcatgccagagcatgatcagagacgtgtctatgagcgaacaagtttcatggcatcagttgatatcagttacaacaatgttcacgtgcatgtggtaacaagggccctagcatgtggacgctacattcgctagacagtacctgggcagctgtataaagtctggtcgcatggttactgagtatcagatctagatctgacgtaggccttgagactgcgcgctcaccgtactacctgctagtatagcatgcatcattgagcagactcgtccgagaattgcgagatgctgataaccgtcgaactgagagggctgaccagcatgcacaacttcatatggagcgtgcacgcccattgtatcatgtccatgaacacccccacacagctgagtcggttacaggtcacatacattaataagcccctcggtacgacatgttcttctaagcccccc

SEQ ID NO: 706329 - DNA, 203 bp, Homo sapiens
cctgatagagatgacgcccaggtcaaagaagaacgcagcctctgaaagctgggaaaggcaaggaaatggattcttccctgacagcctccagaagaaactgtgtccctgatcggttccttctgatgggttcttggtctcgctgacttcaagaatgaagccgcggaccctcgtgaaaacatcaatattctgaatggacatttctc

SEQ ID NO: 706330 - DNA, 83 bp, Homo sapiens
ctcttggggaaccgcacagtaacttccgcaacaagggtcggaggccaccgggttactgggggatacgcggcaccgataaactc

SEQ ID NO: 706331 - DNA, 280 bp, Homo sapiens
agaaaacgccgatgaccatgagtacctattcaggggcgcaggtcggacgttatgaaacccatatgagcatgtgctgagagtggaggatcagactgtgcaacacggagccggcgccctagattgggtgcaccaggaacaggggcctgtccgagctctgcacggagttgagccgtatcagggtggggccctacgggatcaccagcaggtagcgcaggttcagctgagtctgctgctggaccagaccattctccttgggcgtgggcatgccagctcgctggcc

SEQ ID NO: 706332 - DNA, 961 bp, Homo sapiens
gtctggcttttactatctttcttaagaaaaggaaagaaaaagagtcaatagaaaatttcaaaaaaaggggatgatactagccttaagagtgttaccgtgtcaagtgttagtggatatgggtcataaaaggggtatcttttaaaaatcagcaacagagacttaatttttaaatcttaagattgggtagaaagggtttctaggaataggactatttaaacaagtgattgtgaaacccagtggctgtggggttagacaatttgttctaattatttccatggagctcagattttggggaacttagggaattatcagagcaaagcaatcatggtagagtagccacaagtattgggagaacacgtggtctggtcttggttaccaaaaggttgggcacacaatttatttcaataccttttagatttcataaagggcagggtgatataatggcctacgggaaagactgtgcacactcctggacaattttctttcaagccaaggtgtcacaaaacacttttttgagccggtaaaatgctcggtgactagacttcaattggcgactaatatattctgcgtgttgccttttttttccccccatgtggtatattaatatgcgcgggggacaatgtgaacctatgcacatacacaactctggggacgagcgaccttggggagatatatccaaaatgcgtattcgccggcgaaaagtgccaggcacttaaacaaggacgatgtgttcccgaccatgacggagaagagctgagccggcgtttctagcaacggcttttcaccaatggggagcgcacacgcgctacacgatgagggctaaagtatccattaacgactcaggagtctcacccatagtaatactcagaagcgagggaaccggaccgtaccctcttctcgtcgtctcgctccgaacattaattacacttcagagagagtaaacagacacgagagcgaaatc

SEQ ID NO: 706333 - DNA, 340 bp, Homo sapiens
ccagcagtagcatccttcttgcctgtattcaaagaatagagccaagtggtgccgcagtcattcaattcaatggaatatgttgtgtctctggtagagccaatgtttggaaacccggacttatttaataggggcaagaaggcttttgaaagatacattgagaaaatgactcagattcttacaagtaaaagttggattttgcagtaagttaatagagccaagggttgtttcagtaggggagtacatacaattacatttttaaaaacattggccttgtgggagaataataacataaatgtgttttcagggttccccaaaccagaccaaaattttagtcgaatat

SEQ ID NO: 706334 - DNA, 115 bp, Homo sapiens
ccatcaccctctacatcaccggccccgaccttagctctcaccatcgctcttctactatgacccccctccccatacccaaccccctggcaaacctaaacctaggcctccaattaat

SEQ ID NO: 706335 - DNA, 584 bp, Homo sapiens
  misc_feature (63)..(63): n is a, c, g, or t
  misc_feature (76)..(76): n is a, c, g, or t
  misc_feature (163)..(163): n is a, c, g, or t
  misc_feature (179)..(179): n is a, c, g, or t
  misc_feature (288)..(288): n is a, c, g, or t
  misc_feature (417)..(417): n is a, c, g, or t
  misc_feature (527)..(527): n is a, c, g, or t
  misc_feature (542)..(542): n is a, c, g, or t
  misc_feature (545)..(545): n is a, c, g, or t
  misc_feature (553)..(553): n is a, c, g, or t
  misc_feature (556)..(556): n is a, c, g, or t
  misc_feature (559)..(559): n is a, c, g, or t
ggatggtctggccagtacggggaggagcctgtgcgagacccaactggtgctctacgctgacgnggaggagctgaanaggagtgtgggcgagctccccagcaccggggaatcactccagaaggtgcaggagcaggtgcacacgctgttcagtcaggaccaagcncagggcgcgcgtctgnctgctcaggactttctggacagactttcttctctagacaacctgaaagcctcagtcagccaagtggaggcggacttgaaaatgctcaggactgctgtggacagcttggntgcatactcggtcaaaatagaaaccaacgagaacaatctggaatcagccaagggtttactagatgacctgacgaatgatctggataggttgcttgtgaaagtggttaagattcacgaaaagggctcaangaattgcgtgtgcagggcgcggaattaaagtccaatttgtcatgaccaatgagtggttttttcccatgtgtcccctacccaccaattttttgtgccctcttaagcagatnttaccacctgaacancanggcattgnatnttnatgcccaggttacctatttactttt

SEQ ID NO: 706336 - DNA, 129 bp, Homo sapiens
gagcatgggaccgtgcgccccgaagtgcctctctctccttggttttcacctaggctcctcgcctgtgtcaggagatgacatcagcctctgtgttttgtggcttcccatactccagagtgtcatccccat

SEQ ID NO: 706337 - DNA, 101 bp, Homo sapiens
tttttttttttccccaacccttttcccttccggggtttttgggcccccccccccctttttgggggggggaatttcccaaaaagggggttttttttttccca

SEQ ID NO: 706338 - DNA, 552 bp, Homo sapiens
  misc_feature (63)..(63): n is a, c, g, or t
  misc_feature (76)..(76): n is a, c, g, or t
  misc_feature (163)..(163): n is a, c, g, or t
  misc_feature (179)..(179): n is a, c, g, or t
  misc_feature (288)..(288): n is a, c, g, or t
  misc_feature (417)..(417): n is a, c, g, or t
ggatggtctggccagtacggggaggagcctgtgcgagacccaactggtgctctacgctgacgnggaggagctgaanaggagtgtgggcgagctccccagcaccggggaatcactccagaaggtgcaggagcaggtgcacacgctgttcagtcaggaccaagcncagggcgcgcgtctgnctgctcaggactttctggacagactttcttctctagacaacctgaaagcctcagtcagccaagtggaggcggacttgaaaatgctcaggactgctgtggacagcttggntgcatactcggtcaaaatagaaaccaacgagaacaatctggaatcagccaagggtttactagatgacctgacgaatgatctggataggttgcttgtgaaagtggttaagattcacgaaaagggctcaangaattgcgtgtgccaggcgccgattgcccaatttttattgcccataaagggccaattgtaacaactggaccaccaagcgtatggtttttaatgccgggttacctaatttctatttgtctgtgggctctggtttgg

SEQ ID NO: 706339 - DNA, 365 bp, Homo sapiens
  misc_feature (95)..(95): n is a, c, g, or t
  misc_feature (365)..(365): n is a, c, g, or t
cacgagggacagaccacagaggactgtgtatccacgatcatgagtggggaagctgaggcgcatgagctcgtatgtgagaggttgtgtacatatanggcaagtgtggtctgtggcctgtgttggcaggcgtgtaacaatggtgaagaaatcaagttctgaccttacactgggaccatctgagaaggcgagaagtcctgtcatatccgagttggcagaaccgcttgcttgaacattcccaagggcctggtctataattagatcaaccactgtggaattgatgaaattttcagagaaaggtgtgcccctgggtctatagaaagacttcagagtctgtgagctgtgtatgggctcaggctcctgtgtgn

SEQ ID NO: 706340 - DNA, 1201 bp, Homo sapiens
cccgcgttgtcggagcgtagggtttcgccttcacgctgtgctgagtgcccctcctggcctttggggggagagtctcgtggccgcaatggggtgttgtattgtgctttctggagctttccgggggtcctgttggcgttccgcctcccttcaccctggaggtttttgatggaggtggtccccctcctggggacctttttgccgaccgggaaaaattttttgttgaagctctccaaaagatatgggcttgccagaggccccacgggggaaaggtatccacggcatgtccagtggaagcttccccagagaaggcccataaaaaggtaatggctcctgatgcaacttattgaatgtaagccgtggagaccccacggggcccctttgttggtctttgccgcgtgtcccctaggataatggtgataaaggggaggccgtcccccagggggaatatgggaattatcctgcccaccctcctgattactggaaggaaaaggagtctcttagtgagcccacgagtatgaccccaaagaggttgggccgaagctttcacatatagcccttataaagaaggaaagggttgacccccccccctttatcccccgcttccaccatttctggcccgtgtctcggaggaccagagagaccccaaaaagtttgctctcccgcgaggggccctcgggcacggcccacaccttggagttcccaccttgcccccgcctattgggcccacccactttggagtcccccggagagagaaagttgtggcgcttcttctccacggagaggtggacgccaaactgagagagagtgaatgttccctggagagaatgtgaaaaatgaggaaaggaaaaaactcactggtcacaaggttcccacgaagccactatggaaatattctctatgagggaaggacccttcggcgctctgaccacacggaggttatgaaaaaactataatgacccttgttcagcaataatttaatatagagccctgctctctaattccacagaaggtggtgagggggaatgccaaggactaccgggattgctggaatttttgagctaagaaactgtgaagcccagaatcttgcttccacctcttttttaccctgccataccccccttacccccatacccaggcccactggcatagagcccactgagataaatgctatttaaattaagtgtatttaatgaatttccca

SEQ ID NO: 706341 - DNA, 193 bp, Homo sapiens
actctgacacccacacagtcacacagacgcattacttcccacacgacgcatacacacatgcacacacacacgtacacacatgcacacacatgcatagacacccgccacacacatacacacatgtataccaccccgatacatacacatgtccacaccagccacacacgcatacacacgtgcacaggctccacac

SEQ ID NO: 706342 - DNA, 1312 bp, Homo sapiens
gtgtcggcgctgcgtgtgtagcgagcggggttgtgtaggcagggggtcccgccggttgttggatgcggtgggtgttagtggcgatcgtgaggcgttggttgttactgtcgttcgttggggtgcgctgtcgtggtggccgttggctgtgttgtgcctcctggcgcttttgaactgtcccgccgttgtgcgctcccctggtgttatggtgcgtagacgggtgtgtgcgggccgcgctgctggcagcgtgcggtggtttgtgcctgctttctggtgtgcggcccccttgggggagacccttgttggctgtggaagtccttcgtgtattgtcctaacgtacatgttctgcgtggcgggagccgtgtggggggcccgccgtgtgtgatatgtctagccgtcctggggggcgttcgttgaaacgcgaccccatatgcagcgcctgtgatccaaaaaccaaggccaacgtcgtgctgttgaccacatccaagccaaggattttggggttggggctcacgagaaggacccagttgagaagcccgtgcttgcccgagtccagccatgggcagacctgtgctcgggggtcccccgttgcacacacgcttggtggaaagcttgtggttgctttcgcgtcgtgtggccaatgaatgcttgctgactgcgtgcagctgctgtttgggtcccacgcgggcgttgttagtgaggctgtagaccccgcgggatagattcgtgcagcgtttcacatccgtgaggcccccaagccgaggacccactgagcgcccacccgggagggagacccaaccaactcccagaccgcgtcgtgcgctgtaagagcctgtgacaccactccacccgcgaaggttctgtcgccagcgttccacgtccgtgatcccagcggagacccagagaccccgggacgcccacccagaaggatagaaactctcggaccacaattgtgaacacatccacaagggcaccagactcccagatgccgcccacccttaagagctgtaaccactcacccgcgagggtcccccagcgttccattcttgaagtccagtgagacccaagaaccccacccaattcccggaccaccaggatggactcaccagttgaaccaatgatgttatgtgtgacactttccaaatagctagaagagaagatttgacactgtttctaactcacaagaaatgcccaatgttgagctgatggatatcctgattaccctgatttgagtcatcaccacccttgcactgcactgtattagaacatcacatgtacctataaatatgtatattattatgtatccattttttta

SEQ ID NO: 706343 - DNA, 357 bp, Homo sapiens
  misc_feature (20)..(20): n is a, c, g, or t
  misc_feature (32)..(32): n is a, c, g, or t
  misc_feature (94)..(94): n is a, c, g, or t
  misc_feature (144)..(144): n is a, c, g, or t
  misc_feature (205)..(205): n is a, c, g, or t
  misc_feature (310)..(310): n is a, c, g, or t
gcttggctcacagttccgcngctgtacaggangcatgactggggacacctcaggaaacttacaatcatgggggaaggcgaaggggaagcaagcntgttttaccatggtggagcagaaaagaaagcaaagagggaagtgctacanttgtttaaaccaccagatctcatgaacactcatccactatcatgagaacagcatagggganatctgcccccatgatccaatcacctcccactaggtccctcccccaatggcacaacaatttgacatgagatttgggtggggacacagagcctaaccatatcattanggctaagcaatgatgttcaagtaggctaggtacgttaactgcatttt

SEQ ID NO: 706344 - DNA, 390 bp, Homo sapiens
tgttgttgtcattctactctcaaggttgtttcttgttgtttccttgcagaagatcagaaaagggaggacctcatatgttccctcctaattatacccagttacacggtctccataccacctgttacaaagtgcctttctggtctggaaggacttctcttgttttacctcctgtcttctgtgtcctgtctgctcttgtctgtataaatttcaggactcctgaaatagcacggaagccccctcctaatcctgtggtttgatgtttgatattgttaggattacaaaactatgtcatagactagaggagtcagacattccagagttcacagaaggtgttggtgtcccggtggttgtgggacacaggtgccctcctagtcccttggctttcaaact

SEQ ID NO: 706345 - DNA, 749 bp, Homo sapiens
  misc_feature (200)..(200): n is a, c, g, or t
  misc_feature (287)..(287): n is a, c, g, or t
  misc_feature (588)..(588): n is a, c, g, or t
ggatgcccccgggctgctaggaattctggcacgaggctgtctttgtaaggagcccttgttttccaagcaccggcggaagctgcacctgtacactctgtgtgggagactctttccacgctgggccaagaggagtcaagactctaagaacaataagatgtgtgcttttccccgcgtcaatgtaaaatttgtgtgcgacttcnttttgggctgagactgttaagaggggccttctccagaaggctctgagagcagagccatatttccaaagaagatgaagaaatggtganctgtgtgttttatttgaagggaactttcaacatgagagaaataattgttctaaaatggtgtatatatgagagtaatataagacctcctcccgcggaaagcatgggaggggaaaaggagggtgtgtaaaaatagacttcccattggagaactctttaggaaagcaagtaggattccccggggggcttgtgccctttatgcgtttagaaggaaaccacatagaagctgggaactgttaatgggaaagcaggccaccagctgagtttttctgagacccaagaaaatttacttgcgccttccccnaattttccgtattctcggttccttcctctgggggtgtccgccctgtcgccaatttcccctttttttgctgtccccttttccattacccgtcgatatgtgtctacccctggggcgggggggggcccacaccctcctcattccctcatttgtgcggcctttcg

SEQ ID NO: 706346 - DNA, 105 bp, Homo sapiens
gctgctgccccttctccccttcctggccacactctcatgtcccttcctgttcttccttcctagaagcccctgtcgggctagtcgggaggggctcctctagcgtcg

SEQ ID NO: 706347 - DNA, 892 bp, Homo sapiens
  misc_feature (256)..(256): n is a, c, g, or t
gcaacgattgtgtctgcctcatggggttttcctccagagcctttattctgtagccagacgacacgaggagtctgtgtcactgagccagtgcttctagatgctaccctgtgtgggacggcagctcaggcgacagtagatcagaaatgctggtcttgaaaccttgaaaagatcaagctgaatgttccttttcatctgtcgctgttgagtcgttcatctattgaagtaggtatgctaacgtgtcctcgtctgtatttcnatgaagcgtgcatttccatctctactttccgttttgcaggcaatactggaggtaaccgcttcctaaaccatttgcagaaatgtaagggtgttcggttgcgtgcatgtgcgttatagcaacagatctaccaacccgtgtgcatgactgagtgttggggaaaagagaagaagtaagaaaagttcccaagtcactttgtgttatgtggaggacatgtgtattaccaagtggggttgttagcttttaaatcaaaagtactgattacagatgtacaagttagcttaatcagaaagcctctccagagaagtttggtttctttgctgcaagaggaatgaggctctgtaaccgttatctaagaacttggaagccgtccagccaagtcggcacatttctcgtgcaaagtgtcatagctttatataaatgtacagtattcaattgtaatgcatgccttcggttgtaagtagcagaatccgtctcaagtgaacattgggaacatggctactgttttaattggggcctggacagatgggctaatgtatacatttcattaagaacataaaggtgtttgagtggtacacggtaggcctccagtcatttcagtaattttgaggttgagaaaggtatttagacgtattaagg

SEQ ID NO: 706348 - DNA, 364 bp, Homo sapiens
  misc_feature (262)..(262): n is a, c, g, or t
atggggcggggggttgggggggaagataaatgcattatttttccttctgacaaacatattaatattttttcaaccctgtattccttattttcaggatgtgaattatacatattatcattagcctaggaacactcaccaacacgatggcttaatttctctagcttattttctaccaaaaacaaggttatgaggggaaaaaagacctctgtaaaatagggggtatgtttcatatttggttaaagcaagataaaactaaaactgnctttcaaaaaaatttcaaaaactcttgtcttttaaaattatttatcctttttacaaatagataccaggtttctccttttaaacatagcactacttattttaa

SEQ ID NO: 706349 - DNA, 283 bp, Homo sapiens
  misc_feature (20)..(20): n is a, c, g, or t
tattcccctcagtcccctcnggaaatgtacacagaatgcccctaattttatcctctctctctactcaaatgatgccctgtttcttttcaaagaagccttccccggttcattcaatatgaagtggcattctctgtattcttaagtaaagtacccatactttacttttcttcagaacattcagtctgatactatgttttctgtctatttctaccattagattacaaactgcatgaaggcagagaattgtcttagttactctagacctctagcaattagaacagtg

SEQ ID NO: 706350 - DNA, 124 bp, Homo sapiens
  misc_feature (6)..(6): n is a, c, g, or t
cagtantgctccgctcagagtccccccaacctcactgtttccgttgccattagatggggaggttcactgtactcatggtgaggccaggaaggccttgagcttgggcctgggcactgatggcgcc

SEQ ID NO: 706351 - DNA, 1045 bp, Homo sapiens
  misc_feature (566)..(566): n is a, c, g, or t
aattagctagtagaggctgggtgaatcggcgaggcataatattatacttagcatataccatctcacttctaggaatactagtatatcgcatcacacctcgatatcctccctactatgcctagcatgggaatacatactatcgctgtcattatacgctactctcatacatccctacaatgacccactccctcttacgccaatattgtgcctattgccaatactagtctttgccgcctgcgaagcagcgagtgggcctaaccctactattctcaatcttccgacacatatggcctaaacatacgatacatgagcctaaatctactgccaatgctataagctgatgtcggtcccagagcatttgatattgagctaccagcctggacatgcagctttgccacaaaaaacactataatttgtacatcaactacaaccacccaccggcctgatttatggagtcatcatccctctactatgtttcttaagccaagatcagagcaaacagaccgtaatgttatgctgttgcccgcggatcctcttttccctccgaaccccgcctatacgaacgnctcagctccttaagtactaagacgtactcctgtatgtccctaccgccttctgcatgtgcatggccaaggcacaagcgacgcggttatccaggtgaaccgcactaattggcgcaaaagagataacgctaccgtgctgctatagtaatctcccgactgatctcccttaattcatggcattgcacacgccaacaggatagttgaatccataatattgcataatcttgcctatgcgtacaaccactcattacttacccggcttggttattcgtgcacctcgtagtggagggccagctgccagaacggcctgaatcgcaggcacatagcttcgcgtagtctacaccctatgtagggctcctcccccctaatcaatcgccctaatgtacgctcataagaaacctaggctccctaaaaaatctaataaggcaagcatcaactggccagaactttaaactgctgagcagagattaagatggacaagg

SEQ ID NO: 706352 - DNA, 211 bp, Homo sapiens
ccgtcgatggctcacgtacattatgagcagtacgagaaatactagtcaggaggaggtcaacatcaaccgcaagaagcgcatctcggataccacgcgtcactgctcgcctcgtactctcatcccgcggccaccggccactccctctaggcccctggcactgtcgagtttatcacagacgccggtacctaggtgagtcaatagtcgtcccggg

SEQ ID NO: 706353 - DNA, 339 bp, Homo sapiens
cccaggtagatctaagccaggtgagagcccaatccactggcagtttatgtgggcttcatgtggtggggtggacagtcctaagtggagatctccagctccttccggtgggctgcgacagactgctagccccagaagggtcaatgttgggagtggtcgtggctgtgagctgctcgacggagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagtt

SEQ ID NO: 706354 - DNA, 177 bp, Homo sapiens
ctaccacacatctgttatctcacagtgggtccagaaggtagagcagctcagggggtcactccaactcagtgctcccttgttggtttacacccattcatgcttgtctgcctctggccgtgccgtctcaacgtgctctactgactgttggtttgatctagcttgcctcacgctgttgca

SEQ ID NO: 706355 - DNA, 176 bp, Homo sapiens
agagatcttgggaatgtggggtctagaggagcacacagggagtcgtgtcctgaatatcgtggcagggttctccgtagcagaacttcagatatttcaggaaagccatgagagccctcaggaggcatggcttctcccagataaacgccagctacttctgcaggagatggggaaagatt

SEQ ID NO: 706356 - DNA, 431 bp, Homo sapiens
agcggagatccggtcggctcggagcccaggctccagccgggctactcacgctccggaggcggagcttcagcagcgggagggggaggaatctggggcctcccaatggcagctcgggtgtcttccatcgcagccattcaacgtctggcgacggtcaaatttaaacacccctcccacctcctccgccgggacctgtcgggaaagcgtttgcagttattgcggcggctggacacgccccgccgccgaagaggcgggagaagggcggggcctttctccgagttggcctatcactacgggcagcctgcggagaggcgggaggcggcgccaatcggggcgagcagctggagcccggcggagcagttggctgagttgttgcaacttttttcgaaagctgggtttcccgggagatcccaggcggtgacagagtggagcca

SEQ ID NO: 706357 - DNA, 475 bp, Homo sapiens
tggatgtcatttggtgtaagggcccaaacggctgcaaagagtggtgatagcgcctaagttagtgtaaagttgggattagggggtattccggcaagggggtggaaggatgataaaaaaatcctgctacaatatagtgcttgagtggagtagggctgagacgggggtggggccttctatggctgaggggagtcagggtgtggagacctattggggctgattggcctgctgctgctaggaggaggcctagtagtggggtgaggctgggatcagcgttaagaagggctattggtggggggtctcatgagtgggagtgtaggataaatcatgctaaggcgaggataaaacccgatatcgccgatacggtggtataggatcgcttgaatggtgctgtgtgggcatctgctcgggcgtatacatcactgatgagccagacggatataatccctagccctccagcgatgacagtggaaagtgg

SEQ ID NO: 706358 - DNA, 316 bp, Homo sapiens
catttacaaagctacagtaatcaaaaaagcatggtattggtataaaaacagataccaatgaaacagaatagagaacccagcaataaacccacttttttttttttcacagccaactgattttggacaaaggcaccaagtacgtacaccgaggaaaggatatcctcttcaaaaaatggtgctgggaaaatgggatatctgtatgcaaaagaatagaactgtaccccatttctatccatacacaaaagtcaacccaagatggattacagacttaaactttagacctgaaagtttattaatactcagctgttgtaactgg

SEQ ID NO: 706359 - DNA, 145 bp, Homo sapiens
cgaggatcacttagtcaggagttcgaggctgcagcgagctatactgtaccactatactccagcttgagcaacagagcaagaccatctaaaaaaaacaaaaaaggactctaaaataaaactgatgttcacatagttcagcgtctga

SEQ ID NO: 706360 - DNA, 432 bp, Homo sapiens
gagttctccctctccatcgtcccctcctctagggggtagggccaaatctcccgtgggttttttgccccccccccccaggggttttttcaggtggtgccagggggcatggtgtttctccaccaaccgggggacccggtttgggtttaaaaaaacccccaaaagggtccccttttcccggggtttgggcccggaggggtttttagggggttctttttttttcatttgggttggggaaggggggggcccccccccccccccccccttttgggttccatgatcccgcctgtaaaatgggggggcttttgcttcccctgcttaagggggggggctggcttttaaaccccccgggctgggtgccccctgccccctgctttaaaaagctcgtttttttgcccttttcctggaataaccctttgggtttgggtttgctga

SEQ ID NO: 706361 - DNA, 526 bp, Homo sapiens
  misc_feature (128)..(128): n is a, c, g, or t
  misc_feature (365)..(365): n is a, c, g, or t
  misc_feature (402)..(402): n is a, c, g, or t
  misc_feature (511)..(511): n is a, c, g, or t
gggagaccttcctttctctattgaacgatgctgctgccttagcctctgagtaggtgggattacaggcgtaccacacacgcccggataatctttgtatttttagaagagacagggtttcgccatgttgncaggctggtctcaaactcctaacttcaagtgatccacccacctcagcctcccaaagcgctaggattacaggcatgagcactgctcctggccttatatgccatcttgagaaggctaagggatgcccgaatagctagtaaaacattatttctgggtgtgtctgtgagggtgtttgtggaagaggttaagtatttaaatcagtagactgagtaaagaaagatccgccctcaccagtgttnggccagcatcatccaatcagctgaggggcctgaatanaacaaaaaggtggaggaagggagaatactgcctctccttgagctgagacattcatttttctcctttcccttggacatcagagctcctggttctggccttttggatgctnggtaatacttgcctc

SEQ ID NO: 706362 - DNA, 256 bp, Homo sapiens
aaaataaaaaatagttgggccagtggcgtgtgcctgtaatcccagctaatcaggaggctaagggaggagaatcgcttgaatccagaaggctgaggttgcggtgagctgagattgtggccattgcagtccagtctgggcaacaagaagtgaaactgtctcaaaaaaaataaagaaaaggaaaaagaaaattcacaaagttggtgtggaacttttattgaacttaacaatcttctcacagatgtattttttatttgag

SEQ ID NO: 706363 - DNA, 945 bp, Homo sapiens
  misc_feature (534)..(534): n is a, c, g, or t
  misc_feature (900)..(900): n is a, c, g, or t
tggagacagagaatgactatttcaaaaaaaaaaaaaaaaattcggggggaccggtggcccccccccccctcttttcagggggagtttctctggcttgggcccccaatttctctcccatgagtttctgcccggaagaaagaagcctctgggggggtatatcttttcttttttttcatccaggagaggggcgtctcctcttgttgcccccccgggttgtgggctgtggcagggggggaccttggcgcatcctggcaaccctgtcggccctcggtggggtcaccaggtggtatccccccccacctctcgactctgtggagatgaccgggggaaaaaatggcgcggggttgctcccaaacaacccggggcgacaaatttggcggtatccccacatatattgttgcgcccagagtggttgtctttttaaagcccctttggaaccaagaggtgtaacccacaccagggtgatgtggggacgctaccaaaacacctgttggaaatcagacgggataatcaccacccgtagtacgtggacanaggggagagttcactaccatcccaaagaaatgctccaccagactcgatgtagtggccagcattgaccggacataccacccgcgatgggaactccgtatgaaccgcacgaagctacacaggataaaaaaaggtgccagcaaactaaataaaccgctgaagttgatccaccactgggaaagcacacataccagtgaagcaacaatcagacacgacatcatgagcacgcaggtcaaatgttgatagacacagcgacctcccataacaacgtgagtgcacacgcaaaatccacacacgtcggaaccacacgaccgctgggaacagtgcaccaaaaaactacgagaagtacgtgagacagccgtaccagcnaggaaaaggtgatcgaacaaacccgagtaggattgacacccggcc

SEQ ID NO: 706364 - DNA, 846 bp, Homo sapiens
attcctggtggagccggagctgggcgcaggattctgccgaggcaccgaggcacctcagaggaggccgcggcagtgtcatgaatcgcggctggggatgtccgtcagaacccatgcgtgtatcaaggacctgtggcgccggcgctcttctggctccagttggcacagcgagacagctagagcgcgccgatcttgtgtattggcgctacattgtgcgttggacttgccatccatggtaggggcccgttggagtcgtataggcacacgttcgacgttttggtcacacgaggactaccacgttgcgatgcgggttgaacgttccgtcccctttgggcgagcgcaggttgattgctggggggtcacgttaggccccttgtgcccaaaaggcgttctaatccctattacgcacaccagggtgggccgcgcccgtgccttgaaggggacccggggggattgaatggtatgggagcgaggggaccgcggcctaggggcatgtgccaccttgggggccaaaccccgttccaaagcaccatttgagcccttcggttggacgctatgttcgagggcgggcgggatccacggggccgtagagcaacgggggaataagggtaaccggccaaaggtttgggatgtaggaagcccctttgggcttacagatgccggttgggtatcctcattttggtgttaaacccccccagttttgtgtattagccccattcgggccctttccaaatggcggttaggaaggcggcgaactagtgtggccctttggaacaggggggcggtggatttctccgcagccgaagtgagtggtgtgtgggcagcccccttctatggggcgagatgggc

SEQ ID NO: 706365 - DNA, 266 bp, Homo sapiens
agagtagtcatgtgtatcctccatcatatgctgactggcaaagctgccagagatattttcacaaaggattggtttgggttggtgaaactggatgtgaaaacaaagtcttgcagtggcgtggaattttcaacgtccgcgttcatctcaatacagacactggtaaagttactggtgacttgtgagaccacaatacaatgtggtgtgcagtattggtctcgacttttcacacgaaaagtggaacactgtataaccactctgtggaacag

SEQ ID NO: 706366 - DNA, 905 bp, Homo sapiens
gccaaagccagctccagcttactaccagacaagcttagccaaaccatttacccaaataaagtataggcgatagaaatgaaacctggcgcaatagatatagtaccgcaagggaaagatgaaaaattatacgccatagcatagatatacgcagaggactgagacccgctataccattctgtcagtactgaattaactagaaagtatactcttgcaaggaggagccaaagctaaagaccccccgaaaacagacgagctaactaaagaaaccagctaagaagagcacagcccggtctatgtagcaaacaataagtggggaaacgatctatcagggtcagaaggccgcagcagagaccataaccggaagcctggatgcattagctgggtggctccgacagcatgagcagatcatttcagtctcaaaacagtctcacaacttggccacacaaggaacgccatactaaaatccgcctaagggtcaaccacttgtagacctgtaaggctcccaaaaagaagggaaacccacgcgtcatgtttgggaacaacatacggacaaagaagagctatgctgagaagcagtaagctaaacaaagacagtctgtaaaccagccccaactaaggtacgcgaccctaaacaaagcgagtccaatggcaaagatcttaacggcagcaaggccgggtctacaaaaagctctgcgaacaccaaacccgcaaacgttagaccgttgagagcaaaaagtcgccgccaaaaacgaagttaattgaagcgtggcagaacttccctgtcaaacaacaccaccaaagtgtgaggagcgccaaaattcgttaattccaaacccgattaatcaggaaagggacagcctaacatgagttagaagtcagtgacaggtcaacgcatggcaaagcac

SEQ ID NO: 706367 - DNA, 105 bp, Homo sapiens
tcgcattagaccactagtgattgtggcatccagcatttgttaactaactttacacacagtatttggacaaggagaaggtattgaaaagactgcaggtgggtacgt

SEQ ID NO: 706368 - DNA, 369 bp, Homo sapiens
tgctaagatctacaggatgaaatcattgactcaggtgaatcactaccatcggctggcatgtggcttcttgcagcagaatgtcacagagcacataaaaccagaaacagctgacaaggcaatggccaccacaagccaaatgttccaccccgtggagggacttggttgcactttaaaactaagagtggcctgtgacatgaagcctactgacttgtgttagctatgactgctggttccctcctgagctgcgggggagccagacggtggcagggctgcagattgggaactggcaggacttgtactgtcctggactggtcattcatccgctccacacgaaaggtcaccttatacctggctggttagggctgctgt

SEQ ID NO: 706369 - DNA, 1281 bp, Homo sapiens
ggggatgacggcgggaaagatcgccagacaacgtgcagagaagaagctcacccgcgcgacagtgagagaggtatctcccagaagctggggaaggcagatgagaccaaggcatgagcagtttgagcaggtgctgtccagaatttcgaacatagcagctgacggcgggcgacccggtctgcagaaggatctccggaccatacctggcctccgtctaaagcctatgcacgaggcttcgcaagaagctgacatgcagctgtctgcacggagcgtgctatgagcccgcattggccgcggccgggatgcaggcaacacaagatcgccgagcaacaaccgatcctgcgtgtgagactcgcgagttacccaccacgaagctggtggcacccactggctgctgctgaccacttggcacagcgtacctgcggccagattccccggacagtcaacgtcaacgcagtcgccaaccggcgcggcgcaaacctgcgtgcgactacgacagctgcccggaacctactaacgaacggtccctttcaaactgccaccaccgacaggactgaacgcccacaccatggcccccggcccgacgcacgcgcaaccctcgatcccaacgccccacaaagcgccgcacccgaaccgcagcactgcacactgctccgactcatgccaccgcacgccaagccctgccccaacccccctgagccacaccacgccccaacgcaaccgcctacatacccgcctcacacacagccgctcgcccagcaagccactccgccggccgcacaatggccacgccgcaactacaccccgcgcaccaaccgcggccgccacctgccagcccaaagaacttcgacaccaagaacaacccctccacacgcaccggctgacccggccccgcgaccgcgcaccaaaacccaaccacgcgtcccgccacacccccatctcaccgcgaaacaagggacgcagccccacgcagcaccaccagccgacacctgccacacacaggacaccacccacaggcgccctccgcccctcgcagcataccagcccagggccggccacccccggggcgcaccgcagcgcaaccaccacgaacgccacgcgacccccccgggccgggcgcacccgcacctggggccccaccgcccaccacagcccacatctccaacccccacaccgcgcaacccagcgcgacagaccaccaccaacattaaatgcacgcaacgcaccacccaacagcaacacaaacacacccccccccagcaagcaacaagaagccccacacac

SEQ ID NO: 706370 - DNA, 163 bp, Homo sapiens
tggcagtacggatgtgtatgtacactagttatagatgtacttagtggaaggtggtcatttatcaaaggaagtgatttgctgcttaagcttaccagtgcctcatttgtactagaatacgtgctaacggtaactatgggaattatagacctcttcagccggcctg

SEQ ID NO: 706371 - DNA, 989 bp, Homo sapiens
gcagctcaacgattcagcttgccatactaattgaacgagctggagtgtatggcacagagtgatctacattcccaacatcagcaagatgtgctacggacccgcttaaagaccacggggatcgtgtcagacacacttcacctacaaggacctcacacgtgtcaagatgtaggaattgtgggctgtgtcgagcgtgatctcgaagcggtaagaagtggactcctactgacattcgagggctgtcgatcagcccatcgattgtgctactgcagtgggctcgaaggcgcactatgacttggtgctagatgccccgacgaggagattgaaccgagatgcaatgcaagcatgccctgaatgctagttcgatcgtcatctgcagatcagaacaagtggtccacgatgagcaacgtccaatcagtccttctatcctctaggcatatgaagagatacttgttaatgacggcagaatggatctacaagcaaccgatcacctcgtgactcatcatgcctctccactagatgctatcacgagggtgacaaacctacaactaattattggagtgcagacaagctgcattcgcaagaaagtaacgtatctgaagcgaccatgaattaaagccgtcaaagacgaccatagggaggatgtctaccaactagtacccttccatcgatgcgagcccactcgggatcatgcaaaataagactgtgcacctttcgagtgtatcgatcgccatctcctggttgctccgtcattctaatgaccgacccttgacggacatagccgcgtcgtctacatgagagcgacagtagggcgctgggttggcgatcgggccagcaggtgacgtttagtagcggtacccacctcgctggtggagagtggtggggctaaagatttcggttcccctggctgttcccccgccggttttcatccatctacagctccttggcttaagtccccctggcccctaggtccaaactagggggggggttcc

SEQ ID NO: 706372 - DNA, 892 bp, Homo sapiens
gcttgccgatctctttttattgatatgtcttgacaatctatgcattttatttaaggattctgacatagaatagtacattgttaataatggtcatgtatataatccacagcctggctcagaacaggaattgccaaactgtttctttataggtccaaagagtaaatatttttgactttgagagtcatgtggtctctgttgtggctactcagttctacccttgtagtaggaaagcatccatagatagtatacctaatgagttggtgtggccttattccaactagactttaattacaaaaacaggcagctagctggatttggtcattgagctgcagtttgtcaacccctgtctgcaggactctaatgggaaaatgatcaaaatcttaggtgactgtgcacggaagaagtggtatataggaggtgtgagtggttggcatgaggcagaacccaagcagactctgagcaacatatacaaataatcgcaatttgactggagcagtggccacccaagtagtggtacaatgggcagtattatatctttcttaggggagaggtaaaatcaaaggcattaggtggggcttgaactattaaatggggagtgaataccctatctggcctaaaaagagacctttagggggaccaggcagggcctgataggatggtacctttaacctggtggaggtgaaactgcgggctaattactttagccttgtgggaactaactttgcttttaaagaaataatgtgaggatgtaagaactgcgccctgtggcgcgggccacaccctttgtgtgtttgggttaccttaaggtgtcccttcacaggactgatgggagcggttgtgtcgcgtggatgtcccttaagtcgctcggggagaactctgccccgggggggca

SEQ ID NO: 706373 - DNA, 330 bp, Homo sapiens
  misc_feature (4)..(4): n is a, c, g, or t
  misc_feature (235)..(235): n is a, c, g, or t
  misc_feature (287)..(287): n is a, c, g, or t
gacnaactgaaagaggctgagcacccgtgctgaatttgcagagagaacggttgcaaaactggaaaagacaattgatgacctggaagagaaacttgcccagcacaaagaagagaacgtgggcttacatcagacactggctcagacactaaacgatcttatctgtatataagcaaaacagaagagtcttgctccaacagaaactctggagctccgggggtctctctcttctcttgtnagaagttccttgtggtattgacatcttcgctggggtggaaatgtcaagcaanttatgaatacatcaccaaatattgtgtctcggagaaggtgtgg

SEQ ID NO: 706374 - DNA, 329 bp, Homo sapiens
aagactgagtctcacctgtcaccaggctggagtgcagtggtgctatctcagctcactgcaacctctgcctctgcctcccggattcaagcgattctcctgcctcagcctcccgagtagctgggactacagacatgcgccaccatgcccagctaatttttgtatgcttagtagggacggggtttcaccatgttggccaggatggtttcgatctcttgacctcatgatctgcccgcctcagcctcccaaagtgctgggattacaggcgtgagccactgcacccagccttcagtatctatttttatccatccagatacaaaccatttccagag

SEQ ID NO: 706375 - DNA, 511 bp, Homo sapiens
  misc_feature (295)..(295): n is a, c, g, or t
  misc_feature (511)..(511): n is a, c, g, or t
ttctacagactgtaggattcaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcntgactactgcccacaccaacgaggtgatctaacagatacatggcaacgtgtggaactgcaacaacgcctggtgccccagcacaaaccttcccaagtgttaaaaacaatgtgctgctgcttcacttccgccctcccggttatccaagcaaaatgtctcttgttgggccatctttactgggagagagttcccggggaacatagccttcacccaaggtn

SEQ ID NO: 706376 - DNA, 575 bp, Homo sapiens
  misc_feature (575)..(575): n is a, c, g, or t
atgcaggcactgtttgctttgccaatggagctgttgtaggtggaatagcccccaagaagctcagagctataatagtgcatcatcagatcctagtcggcagttccttatgaatggactggcggcgtggttgagctgatatggaaaagctgcaccttcctgcagaagatcaagctgatcctgctatcccaccccaaatttacagcctgtacggttatctttcagtgaaggcaggtatctgtgcttctcacatctgagaagcagttgttaagagcgcaaaggtggaggagatctagaaaagaaccgtctgtgtacagatttatcccagtgggtgtgaagggagggcaaagaacccagtggcacttcgcttatccagcaatttctgtcactgtggtgaccaacttctgcccgttccatagggtcttgaactgctcaggaactgggaattcattaaagtcaccgccttctgtaggaatgaggacattcatctcggaaggtttagcactgactatttcacaatccagggaattcttgctcaggtaagcatggcagccatctgttttgttgatggatatggn

SEQ ID NO: 706377 - DNA, 168 bp, Homo sapiens
aaatcctctgcacgcgtcttacttcttaggcgggtagcactccagatcagtgtctgcctatcaggcctgatttggtcaagaagttttacggatctggggttcaaaccccatatcaagcattctgtcagcttcgtccaatacaaggtaagtacatcggcgaagatatgt

SEQ ID NO: 706378 - DNA, 128 bp, Homo sapiens
tcaagcttctaacgatgtacggggacatgatattcaactgtcattgccatccagtccagaaccagaagatggtgataaagtatataagaatgaagatttattaaatgaaataaacagcttaaaggcga

SEQ ID NO: 706379 - DNA, 229 bp, Homo sapiens
ggcagtaggacgcgggttgttacgctgcacataggcgatatgtgtacagcttgcgctgtgagaagaatgacttgctgatcatcccggccggtgtaccgcactggttcgacatcggcgaaaacccgcactgtgtgacactgcgtttgttcaacacggcccaaggcgttgtgccctctttgaccggtgatgcgattgccgcccgctttccaaggctgggcgtccgtagcgg

SEQ ID NO: 706380 - DNA, 934 bp, Homo sapiens
tggtggtcacagacgactggccaggatattctcacctctgcctatctgtcctagactactgttcacacagtttaagaaggtgcgcaggggcagtgtgttagttctgtccgtggaggtgctacttccactggtagagaggacctgatggaggtgaccatagcggcactccgtcgccccacagagggcccggtcctggcagaagtggctcctgcgtgcgagctgcgacgtgccggctgctccgaacacttctcttcagtttatgccgtggtgtcagtcctgcatgtccagccccatccacaggcttcgggcagcctggtggggaagcaaccagggacagcctcatgagtcttttccatggctctgccagattttctccgcaggaggatagttattcccagagtcgggagctgctcgtgcaggaggtgaaggctgcagtctcctctggagccatttctccaaggaaggccccgaggtctggctcccggggtgggggtgtggtcccgataccttggcaccttcctgaaggaccttgtgatgctggatgggcctccaaggatgaggttggagaatggctacagtcagttttgacaacgcgggcgggaagggagtttgcagtcctttctgagttgcgacggtccacgaatgaatgtcgtgctattatctcagctgaccattggtatcagaggtgctaccggggctcggcccgtggcagaggtcagaagcctgggtatcctgtccgggggggccccgggtctggtgtcctcttgccccgggtgttcggcgacattggtctttcggtgccagtttggctcgggggcgcaaccggtttgtctttcgcgcgatgggagtggggggagaccctcctctgtggtggcccctttatgccttctccacatctttggagccttctgccgtgctctcccccaccctcgtg

SEQ ID NO: 706381 - DNA, 496 bp, Homo sapiens
gaccacttcacgtacggcctgtcggatgagataatgcaggcccacagatagcagctcttgctcgtcagccacgacaagctcctgtctgtagccgataggtacctcggcattgggaaaagcacacacggcctggccatcctcggacccgagaaccagaaaattgccaaggacccatcgtggatcatccgatgagcagccgtggcgctcgactgcacaggagcccgagtcaacacacctccgagctggatagaaaaggtcagaaatggtgctgcttttgcccagaaacctaaggccattgggtgtcgccccagcccccccactgcgacgttgggagctcagatcaatcccaagagcccacaggacacggttcgtttggattatcatgcatggagcgccaaggatgcgccacggaggagtttcacattggagcgccaggctcgttttccctcactctagagcactaaagaatgtagtaatatagcgcgagtctgactta

SEQ ID NO: 706382 - DNA, 982 bp, Homo sapiens
tattttttcatgtacttgattgactggttatataagagagggatgttaaagatcacttatatatgtgcatttgtctaacttcaattcatctgtccaatcatttgcttccatgtcatgttgcaagcgttccatgtcatcttatcacagcgctaatgcacgttggttcttgttcaatcattcatgcatgtcatctccattcatcgtccaagtgcatcatctcatcttcattcttgcaagattacattgtataagtatctgcatatagccgatacagcttgttccttacgttacataattgtggcatgactatcatgtaaagtgccagacactgtgagtaaagagcttgtgtcgtatatattataacatgtggactagaagaagaagaatgatagaagagaccagcacgaccatccgacatcactaggacaagcacccaagagaactaggaacagtatgcacaaacttcgccgaacggagaacatacgcgcgcactaccacacacggacacaccacatacaacaacacctaccccacgagcaacatacacgacacacagtctcatcccatgcacctcacacgaacctccccacgaagacaggcaatagaagagccaaaaaaacgccgcggcacaaaacgtaggccccacccgaacctacaccaaagcgataacaatacagacaaagtccatgacacacaactagcaagcacaccacggacgataagcaccacccggtgaatcagacgcccccagccccaggcgaacctaatgcaaaccaccaccgtggaaaccaacacaagaacggaaagacacaaagcaaaaaaccaccatggcacccgtccacaacaaaaacagcatgacctaggcgacacacaacaaagagtcgcaacaccaccacacacaaggcccgccggcgacccaaccaacacaggacacactacataacaagaaacaaaacaaccaaacatgagatcaaagcgtacg

SEQ ID NO: 706383 - DNA, 859 bp, Homo sapiens
  misc_feature (81)..(81): n is a, c, g, or t
agtttccgcgcgtatatgtttccggagaaactgggtagggaaaacataccgcccccggtgacatggggcccgcgacccccngaaacggggttacacgaggggcccacaacaccgggcaccccctctttggccaaaagcggggtcaccccagtgggcagacggtgctcggaagcccgtgccccaatttgtccgactcccctgggctgtcccccaaactgcgggagtaaaaaaggggcggtcacaactgccccgggccccaaattgtgctccaagcagggccccacagattcaatttggtgatgagccggacgcccaaaaaaagttgtggcgaggaaatagccatagccacgccagagtccttcgcaaaaaagggttggggacaccacacagcccccgcaggtacgggtcggcgtgatcagggacccgtcacatgtgtcccaaacaggtagaacggcctcggggacaaaccataggtactgccgagaccccgggtggccgaggccacaccgacgacacttctcctctggagcacaagggcgcaaaagagaaaattggggaccacatcacccactaccgtcccgggcccatgcccctgggataacccacgccctgggaagaggcgaagaaacctgggcaacggaaagaaacggggagtaccacccgcatggccaatggaggggacccctggccgcttcccccgagcgaatgtagaaaggagcgccaccgggcggagccgtgttaaaatatacaggcgcggcctagggaagcgaatcgagggggaaacaccggtcgcacgagagatgatagtatcggtgggcaaaccagaggagggaatttgggggtacaacccccataacaa

SEQ ID NO: 706384 - DNA, 469 bp, Homo sapiens
gccgagcctctcatactttggaaataagcctcagaatagagactgtccctccccacatttcatacttacatatcctccgagtctgaatatagttcctcttgcctgggccacttaatactactcctaggccaggcgcggtggctcacacatgttatcccagcactattgagaggccgaggtgggcggatcacgaggtcaggagttcgagaccagcctgtgcacatggtgaaaccccgtctttactaaaaatacaaaaattagctgggcatggtggcacatgcctgtagtcccagctactcgggaggctgaggcagaagaatcacttgaacccgggaggtgttgacggttacagtgagccaagatcacaccattgtactccagcctgggtgaacagagggagactccgtttcaaaaagaacagtttatgagatcagctttgtatcacatggatctaggacctctgtcggaa

SEQ ID NO: 706385 - DNA, 230 bp, Homo sapiens
tccaatgtacccagagtcacctttccaacaggcaagtatcacatgacccccctgccttaagccttcagtggttcctcagcggcttcaagataaagttcaagctccaggatatggctcctgcctcctgctctgacctcaacacatcctacctcaaacgttaggttccaaccataacgaaccacttgtaatttccagcacatactgtgctattggtaccattcacatccttg

SEQ ID NO: 706386 - DNA, 245 bp, Homo sapiens
agatgtattctcagcacagagctgtggtgtgtgtgctgaggtgcgaatgcaaccatcttgaggctggcggcgtacacaatataggcaagagactgctgctcgagtacgggtgtggcatgaatctgtgagcatcctttggaggtgcaccaccagcacatcggcaagcctccaccatcgcagagatgccctgttgccgcaaagtgtgtctcattgctgccgccggactggacgtcttcgggtcgttt

SEQ ID NO: 706387 - DNA, 137 bp, Homo sapiens
tgcatggttcatattctttcctaatggatcctgttaataatacttccaagcctgtccatggatctatcaaatgtcttcacttgtatatttacatggctaggtcatttctaatggtttatctcccatgatggggtacc

SEQ ID NO: 706388 - DNA, 297 bp, Homo sapiens
actaaccctaatcgcatagaagccgttgtcctcaagcacattgagggcggtgctcttacctggagccggagcgaccgctgacgatgatcaaacgcatgattactgcccgttttgttcatccaggacaacttgtgtacaacgcttcattgcttggaagcgctgcgcagtttgtcgcgtacatccttgcggtccagcatgctggtgatctgccgtagcagtttccaaggtgcgcatacggtggctggcttcctggggaaccagcatgcacaaaacatgcatggtctgacctggggcgcc

SEQ ID NO: 706389 - DNA, 170 bp, Homo sapiens
gtcgcgtatcgtacccgtaggtcagtaccattggtggccaattgatttgatggtaagggagggatctgttgacctcgatttgttattgtaaatgtgatgctgtagtgtgatgggatgggctgatgagtgactactgatttgacttgtgctgtgtgtgtggtacctgatgc

SEQ ID NO: 706390 - DNA, 122 bp, Homo sapiens
ttggtggctctcgccgggcagcttggagaggcgcaatactttccagctcccccgttacccgctaatataagtaaaggttggtaaaattcatactttaataaacaatttggggccagtcatgt

SEQ ID NO: 706391 - DNA, 264 bp, Homo sapiens
actgtaaatgattacttagatctagcagcatacagattaaaatccaatttgttggccgggtgcagtggctcacacttgtaatcccagcacgttgggagcccgaggcaggaagatcacctgaggtcaggagttcaagaccagcctggctaacatggcgaaaccctgtttctactaaaaatacaaaaattaaccggatgcagtggcacgtgcctatagtcccagctactcgggaggctgaggcgggagagtcacttgaacccagga

SEQ ID NO: 706392 - DNA, 732 bp, Homo sapiens
atcctcaggatttcattgactgaactgcacgttctatattgtgccaagcaaaaaaaaaaattgccttgtgacaccagaataatgagtctggcataaatttcatcttcaaccttaagggacttagctgggccacagtgacgctgttgtgcccaccaccggtgtcattgagagacaggggttactctcaaggcttctccaaggatacattttcacatctggcggctagaaacttgtgtacgacaaaggcattcatttgtaaaattattttcattacaaacctgtccacgtgggctggagagaagtatctaacattattttaccataggggtttggattaatatgtgtaattttctcaacttgaaacttgtaaccttttcttacagcacatctttttttggatgtgggagattggaggtatacaactgtcctggtggtacaaggagttggagcaattgctaaaaaccagcggttttaaaagagtagaaaagggtatgaccccgttgttcacagatgtgtatttccagaaaccttattataaagactcatagtgccataagattggtccccaagtggtatacgtcattatggcggaaacatatctcttggcaattattaaccttgatgtgagagctgaagtccttataagaattactcttaaggtgggggaatggccgggtagaacaattgggccatgtttatttaacgtggagaggaaattatgggcgaggggga

SEQ ID NO: 706393 - DNA, 221 bp, Homo sapiens
cggtctcaccctcccaaagtgctgagattacaggtgtgagccaccacacccagcatatcgagaagttttttccatttttggggttaggggggaagtctttggtggtatgtgggttttattggtgtgggtaacaatataggttttggtttggagacaggatctcggtggcccaggcttggtcatctctctacttagtgatcagtgggcatctctgttgccca

SEQ ID NO: 706394 - DNA, 438 bp, Homo sapiens
gaacctagatgacagaaaccacgaggtaaaccggaaataacccaaattgcgcttaagaaaaatactaccagacttgagaattttataacgtaacttcctaagtgtaaggtgacaaaatttgactttcgggatattctggcgtaaatttacccgtccgcctaaatgtgggcaaaaattcacagctacgttatattaagcaaatattaacagtgactataatttgctgggtgctgaaatttgataaaaaacttaaaagttaaaaaaaattgtttagatctttagtgtcacatagacttatctgggacatcgcattttttaatcctcacatgagatatggctaagtatatttttcacaatctgttaatctcacaaaaactaaagctgttaagcacagtttaaacccattctgcagggtaagaaattcatctgtaaggcaat

SEQ ID NO: 706395 - DNA, 95 bp, Homo sapiens
  misc_feature (32)..(32): n is a, c, g, or t
cgcggctttgttcaggccggccgcggttgctncgacacgaaccccaacgacgaattcgctcattacccagacctcttcttagtgagctgatctac

SEQ ID NO: 706396 - DNA, 217 bp, Homo sapiens
tgtgtactcgtatcgttcattaccattggtggataatttatttgatggtcagggagtgatcgttgacctcgtctgtgatgtaaaggatgcgtatggatgggagggcgattgaggactaagatgatggcgggcagagatagttcagacggtttctatttcttgagcgtttgagatgttcgtattagttcgttgtgttgtgagtgagaagactcgggcg

SEQ ID NO: 706397 - DNA, 275 bp, Homo sapiens
tgtgacagaagccctcactgccactcctagatttcaccagcggtaggaggctcccaattctttccattttccaagacaccgtgcctcagcgatagttaagggaatccccagtttttctttcttcttttctttgtactttcatgttctagcccacaggcaatcctgtggcagcagtggtggtgacagaggcagtgacagtgacagtggcagccgccagggccttcaggtgattaaagctctgaaggaaagtaaccttcctctctgattgtaggtcc

SEQ ID NO: 706398 - DNA, 298 bp, Homo sapiens
  misc_feature (48)..(48): n is a, c, g, or t
  misc_feature (55)..(55): n is a, c, g, or t
ggattgaggggccggaagaaaagatatagctatttaatggagatcttncagatgngaactcccccccccccccccccccacaaaaggacagctttgcagggccatttcaaaatacggccaagaaacatgtattggggtaaaatattttgactttcttctttgtcacataatgttatgccagagtcggattggaaagtaagtcacaacatagagggttaaataaaactaatctgatgagaatttatggtttgtagggcatgaatccccagaccacttagataagaatttgggcaagata

SEQ ID NO: 706399 - DNA, 108 bp, Homo sapiens
ccaggtatccacaactgacgaatgatcctctgtggcaggtgtctcgattctcgttgtgtgtgtgactatcgagcatcgcagatgcctaatagggtttggaatgtcaga

SEQ ID NO: 706400 - DNA, 868 bp, Homo sapiens
  misc_feature (632)..(632): n is a, c, g, or t
  misc_feature (862)..(862): n is a, c, g, or t
tttcgtgtgatatatgctagacgtagtgtgtgaagcagggaacaaagttctttttaactttcgttttaggtcgagggtacatgggcagattgttacataggtaaactacgtgtcacaggggtttggtttacagattatttcatcaaccaggtatttttctgatcctctccctcctcccatccaccactcttgttagtccccagtgtcttaattcctgcgggatgtggatgtgttctcattgtttagctcccaccaaaattcttaacatgatctaaaggccttgtctaacttcacataagcaggcttgagttaagttcttttctgtttttaagacataggtgccttttcttcgtatcattgtgcctttaaatattcatgcatgttcttgctggagaggaatcccatgcctacctctaaatagctgtgggatctagggaagattatgtaattccctaaaattctcttgccaatctgtgaacataaggtgaatattaacctggctattatttctcacccagaatcttgctgtctcctcctagtctccctccttcttcctttggtccccattgtctcttctgcatggtgtataccctaatcatgaaaaatgaaaccctgtgatgtattctctgtgncagatgcattgacttgctttctcattgagaaagaacccgactatcatgacttggtaagggtctgtgtgaagcttcatttctactcactgccctcatgcagcctgccccagctacacttgccttcccaagcatcctccagctgcagggccttttcatagtctggttccacctgactagaacactttttctctgcatataactggtataactcccttcctcatctcctttanttagaa

SEQ ID NO: 706401 - DNA, 405 bp, Homo sapiens
  misc_feature (12)..(12): n is a, c, g, or t
  misc_feature (15)..(15): n is a, c, g, or t
  misc_feature (130)..(130): n is a, c, g, or t
  misc_feature (235)..(235): n is a, c, g, or t
  misc_feature (285)..(285): n is a, c, g, or t
  misc_feature (332)..(332): n is a, c, g, or t
  misc_feature (351)..(351): n is a, c, g, or t
gacagtaaacanagncatgccccagggacatcagaggtctctctgcatggggattaacaggagaggaggaagccctgacatgtccaataaactcaatcatctggaagatagctcagtaggtgtatccttnacccagcattgtgggagaagatatgtctggaatgtgtatttctgcggggagtgagaaaggaatgtcagcagtcaggatgtctgcagatggggaattagaaatctntcttagtgttggtgggacccagttcaaaagagacttcagaaggattgatngtttagacgggtaatctatataggacctgtttagatgaacttcagtnggaatgagggatgatgtanttagggataataaggttagctgttaaccaagcaactgagcttttaaccaaagcc

SEQ ID NO: 706402 - DNA, 1150 bp, Homo sapiens
gtgtctgtgttgctttctcgctatgctgatgtgtcttctgctctactgctctcgcttgtctgtgtcccgtctggcttgtgtttgcgttgttcccggctgatgggcgctatctgtccggcctttccttgcgtgttatttctgcaacgcctcggtttcccctttgtcacgtctctgctttttgatggtggtttcctctcggggctctcttctgtgcacgagttggtgtccccacggcgctccagactttttccggtttgtcctgtctaaggttgttgtccggtcccatccggatcgctaactggtcatgctacactatggggtaatacttgggttaactcctatcgctacatattctgtttccctttgctaaatttggatatgtatcgtcctattcttatgataatttcatgggtttatcaccatggtatctcctggctgttacttacgcaatatagtgaggaattgctcacctagtatcgcccttgtgatatataggacgataagtcttcgtactcttcggcctttctactgcagattcagatgggacatatatgtcttgtactgagtgctcagtgaagtgcatagttttcatccagatatcatgtcgagatacctcaactcagagacagccatgactccaggagcatggcactaccgccaggtacatgagtctagcatccgaaaccttcagtggcctagctacagaccctacctgaagagcctatctcgaagactcctcagatgcctacctaactaaccccatcctagcagttccttcaccaaggtacaatatcctgggtcccatgactcttatctgcccaaatataatattacaaggactcatttagagttgttgaaagagtttctcttcgtaatggccctaagctgtgtacaatctgctgagatataaactgtaaatcacccatgtatttattgaactgcatacagtgagatactaccacatgatagtctttgctatctacaagatagtttatttgtgcaacgattgctgaccacaagagggctagtatcttgtgttgctccacctatgggaggggtaatggccagagaagtagagactgaagacaaagagtgtgttatgacccacattccaatttctttcacaactttaccttcgcggattggtata

SEQ ID NO: 706403 - DNA, 395 bp, Homo sapiens
agggtaggtgctaataatttctgctttaaaattgcaccatggaatactatgcagccataaaaaggatgagatcatgtccttgcagggacatggatggctggaagccatcattctcagcaaactaacacaggaacagaaaaccaaacaccgcatattctcactcataagtgggagttgaacaatgagatcacatggacacaaggaggggaacaacacacagcagggctagttgtgggtgggggcaaggggagggagagcattaggacgaatagctaatgcatgctgggcttaaaacctagaggacaggctgataggtgcagcaaaccaccatggcacacatatacctatgtaacaaacctgcatgttctgtacttgtagaacagaacttattaaac

SEQ ID NO: 706404 - DNA, 183 bp, Homo sapiens
ctgggaatgtgtcatacgggtagcaccaaagcggagcttgcctattctcttcacagagcttgcgggcaggtcagtcgcgaggaggtcctcctccacgtcggactcctccactctcatcatccgctgagatccggatctcagactcagactcctcgtgggatgcgagaggggactcctctagac

SEQ ID NO: 706405 - DNA, 310 bp, Homo sapiens
tcatggacataggtgcatcgtggggaaaaaacccctactccaaattccacaaatggtcaggagccgtgaccagaggctcaacatcattaatcattagagaaatataaatcaaagccacattgagagaccacttcatacccattaggagggctattgaaagaaaacacacacacacacagaattcaactggtgttggcaaggatgtggaaaaactgaaacccttatacattgctgggggaaatgtaaaattgggcagtcactatggaaaatggtaatggtggatcctcaaaaaattaaaatgttgcccagg

SEQ ID NO: 706406 - DNA, 350 bp, Homo sapiens
tgacctcataaagcatgatctcattctgcccatactggggcaacagtatccaagcggcattcaaattctgcccctactgaggaaattctttgcctgtagacgagcatgtaaggtcccaaacctttggcaatccacatgtgtcatccttccaaggctcaaagagagggctgaacaccaattttgaaacctctcctaagaaagtgaaatggtccagcacctgcacctaatcccgattatccctaatttcagatggtgacagttctgattctgaagatactctgagttcctctgatagatccaaaggctccgggagcagacccccaacccccacaagcagccctcagaagacc

SEQ ID NO: 706407 - DNA, 872 bp, Homo sapiens
ggcgtcagattgtggagtggcgtagacgagtgaagtcctggtctgcgtggaggtcgacgcatccgtcggagactacggacctgtctgggtctcagccggccaaagaccccgtccggaagtactagccgtggacatcatgagtggcaatgtcgggtatacatcgggagattaaatccagtggcagggatgaaggacgtggaaaaggattcttcaagggatatggaggtgtaagagatattgatctgaagaggaggctgtggtatgggggaatgcgaggatccagagggatgcaggatgatgctgtgtatgagcttgatgaggaaatagaattctgtaggtgaaagggttacctattgaatcatgcaaggggtcggatcaggaaggggagagaggtaggaggaacgatagctctgacggttttagatagtcgcagaacctcgaaagtgatagaggaaatgctggactgtaagaggagaaaatcgtcttatagtgagaaatgtatacctcaagagtcagtggaggatctccaaagattgcatgagaaaggctggggaagtaacgttttgggggatgcgctaccgactaaattgattgaaggtggggttgaggttgccttcataatgtgtgagtaagagactgctagtgacgaacctctactgcacgggaaataaatgggggaccagttaagttaattgaaggcgaaaaagccgggtggtcatgacggaggttcgtatccggacagaaagtctcgagggttgagcggacgttccggtatgcaattttaaacggtaaaagaggcaagagcggaaggagacccttagaaagtccgggtaagacaaggtgtttgaatcacccgacaggtaggtggtcaa

SEQ ID NO: 706408 - DNA, 1365 bp, Homo sapiens
agtgagactttcttgggaaaaaaaaaaaatgacagtgaagcagacttttagaatccgagatgtcattgcagaattattggtataaaattcagctgcaaagtgaagaaattgaaatggcccacacgttgatatcctgtggcaggttatacccttcatgttagcaaagacgaagccacgtcgctgtgttaagagggacaggctgggccggctgcagctgtagtggaagtgagggacacagggaaggaatggggagcagcaatttggggacagtagactggagtcactttctgactcaaaaaaggtcaagtacttattaaaaactatcttggttttctgttcagacttaggctcattttgatcattttaaggtcccagttgtcaaaaatatcaagtgaatttgtctcaggtttttcaggaaacaaaatttacaggaaggaagcaaaagccatgtcagtagccttgagctgacagctttaaagaaactggcaaacaggtaggttgtcctcatatagatccttccagtattctgaaaaacatccttttatttcttaaaaccagtaacccttacatttttcctataggatagttatttttgttgagatcaaatagacattctataaatgttataaattatgcttgcagttactcagcctatctaggcttaaggtttatcaatatttgaagttgaaacatcatcttatgaggtttagttttagggaagataaataaatatatcaaagtatttcataaagttgtatcaatgttccttctaacattagaagacttactgactgaggccatctgtgaacgactaggtgatctcagaatccttccagctctaataccctctgactaacactcacccagaattgctgtctgtgctggctgtgatctgcctccaggagcatacgccatcctgcgtgctgtgtccatcacagtgtctgtgctcggtgcccttaccactgtcccgtgtcccttggacgctgactggacagagaggagcctgtctctcagggcacatgagtcgtcgtggcaggaggagacgggcctcagtcacagtgtcacagacccttgtcacagtggacactagtcattcctgccatgtccttgcagcccaggaggactaaaaagattttaatgaagtctgtgttactcattctgaagaaaagaacttacctgagaggagtaatatttttttaatatatattgggtcagggacagggatggagtggttgttttatgtttacatttttaataagtaaaatagaagatttaagaactaatatttatggtattgaactttaagtgtgatatattccttagaaaaacacaactttaataaaaatggaaactaaaaaaaaaaaa

SEQ ID NO: 706409 - DNA, 242 bp, Homo sapiens
  misc_feature (112)..(112): n is a, c, g, or t
ccgaccgtgattggcttccgtgtctttccggtgatgctgttggggtctgtgggtttgggtgggaagagggccatctgcctgaatgtaacctgctagccctccgaaggccctngcgggcctggcttgtgtgagcgtgtggacagtggtggccgcgctgtgcctgctcgtgttgcctacatgtccctggctgttgaggcgctgcttcagcctgcacccctcccttgtctcatagatgctccttt

SEQ ID NO: 706410 - DNA, 551 bp, Homo sapiens
ttttttttggacccagtgtataaccttgacatagtggatacatcatttcttcctccatatatatttttcctccattaaaaaagaaacaaaaacttttttatacctgggttttgctcttgatttagctctcaaggtggtccttgtttactttttaataatcactgctcttcatctgtcaatatttaattggtatgatttatcccaaaattgtttatagaaagtcagttttttgttttcaactctagatctttgttcctgttcctcgagcctggtggtcaccctctggcttctgctaggcaatctgtttcctctgctggctggatttcttctgtgtatatggcactatgcagatggtagaagtggcattcctggctttggcttggaagaattgacgaccatcagaccttgaagcagaacttcacagcagcctgtcctcatcagcaacccaaccacctcaatcttggagaaggagaaggaactgcaagccaccaagtcttcatttttcagggtttgtaatcttcccaaagttttcctattttaaatttaatggc

SEQ ID NO: 706411 - DNA, 2423 bp, Homo sapiens
gcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtcataaataaagttcatcttaaggcaaatcatgtggtcaagagagatgttgatgagcatttaagaatcaagactgtctatgataaaagtgttgaagagttgctccctgagaaaaagaatcttgtaaagaacaagcttttcccacaagcgatttcttatttagagaagacttttcaggtccgtcgacctgcgggcactatcttacttagcagacaatgtgcaacaaaccaatacctccggaaggaaaacgatcctcacaggtactgcaccggggagtgtgccgcacacacaaagtgcggccccgttattgttcctgaggaacatctccagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggccaatagcaggatatgctaacctgtgtccaaatatgatctctacccagcctcaggagtttgttgggatgctgtccacagtgaaacatgaggttattcatgccctgggtttctctgctgggctgtttgcattctaccatgataaagatggaaatcctctcacttcaagatttgcagatggcctcccaccttttaattatagtctgggattatatcaatggagtgataaagtagttcgaaaagtggagagattatgggatgttcgagataataagatagttcgtcacactgtgtatctcctggtaacgcctcgtgttgttgaggaagcacgaaaacattttgattgtccagttctagagggaatggaacttgaaaatcaaggtggtgtgggcactgagctcaaccattgggaaaaaaggttattagagaatgaagcgatgactggttctcacactcagaatcgagtactctctcgaatcactctggcattaatggaggacactgggagacagatgctgagcccttactgtgacacgctcagaagtaacccactgcagctaacttgcagacaggaccagagagcagttgccgtgtgtaatttgcagaagttccctaagcctttaccacaggaatatcagtactttgatgaactcagtggaatacctgcagaagatttgccttattatggtggctccgtggaaattgctgactactgccctttcagtcaggaattcagttggcatttaagtggtgaatatcagcgcagctcagattgtagaatattggaaaatcaaccagaaatttttaagaactatggcgctgaaaagtatggacctcattccgtttgtctaattcagaaatcagcattcgttatggagaagtgtgagaggaagctgagttacccagactggggaagcggatgctatcaggtttcttgttctcctcaaggtctgaaagtttgggtccaagatacttcatatttgtgtagtcgggctgggcaggtcctccctgtcagtatccagatgaatggctggattcacgatggaaacctgctctgcccatcatgttgggacttctgtgagctctgtcctccagaaacagatcctccagccactaacctgacccgagctctgccacttgatctttgttcctgttcctcgagcctggtggtcaccctctggcttctgctaggcaatctgtttcctctgctggctggatttcttctgtgtatatggcactaggaatggaaaagtggatcttcaagatattcttttatgttatgttcttggacgctgactggacagagaggagcctgtctctcagggcacatgagtcgtcgtggcaggaggagacgggcctcagtcacagtgtcacagacccttgtcacagtggacactagtcattcctgccatgtccttgcagcccaggaggactaaaaagattttaatgaagtctgtgttactcattctgaagaaaagaacttacctgagaggagtaatatttttttaatatatattgggtcagggacagggatggagtggttgttttatgtttacatttttaataagtaaaatagaagatttaagaactaatatttatggtattgaactttaagtgtgatatattccttagaaaaacacaactttaataaaaatggaaactaaaaaaaaaaaa

SEQ ID NO: 706412 - DNA, 224 bp, Homo sapiens
atactttttgaactatcttagataatgtaacattcctttataacttacttaagcagtgtcaaaactggggtagaagggattttatttgttcccaaaagggttccatcttagctatctgttgatcgagccttcagcagacatctaagtatgatccaatcaaattttaatgggttgcatggcagtccggtgtacagctggcagtcagttggttggtgaagtcatta

SEQ ID NO: 706413 - DNA, 2276 bp, Homo sapiens
gcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtcataaataaagttcatcttaaggcaaatcatgtggtcaagagagatgttgatgagcatttaagaatcaagactgtctatgataaaagtgttgaagagttgctccctgagaaaaagaatcttgtaaagaacaagcttttcccacaagcgatttcttatttagagaagacttttcaggtccgtcgacctgcgggcactatcttacttagcagacaatgtgcaacaaaccaatacctccggaaggaaaacgatcctcacaggtactgcaccggggagtgtgccgcacacacaaagtgcggccccgttattgttcctgaggaacatctccagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggccaatagcaggatatgctaacctgtgtccaaatatgatctctacccagcctcaggagtttgttgggatgctgtccacagtgaaacatgaggttattcatgccctgggtttctctgctgggctgtttgcattctaccatgataaagatggaaatcctctcacttcaagatttgcagatggcctcccaccttttaattatagtctgggattatatcaatggagtgataaagtagttcgaaaagtggagagattatgggatgttcgagataataagatagttcgtcacactgtgtatctcctggtaacgcctcgtgttgttgaggaagcacgaaaacattttgattgtccagttctagagggaatggaacttgaaaatcaaggtggtgtgggcactgagctcaaccattgggaaaaaaggttattagagaatgaagcgatgactggttctcacactcagaatcgagtactctctcgaatcactctggcattaatggaggacactgggagacagatgctgagcccttactgtgacacgctcagaagtaacccactgcagctaacttgcagacaggaccagagagcagttgccgtgtgtaatttgcagaagttccctaagcctttaccacaggaatatcagtactttgatgaactcagtggaatacctgcagaagatttgccttattatggtggctccgtggaaattgctgactactgccctttcagtcaggaattcagttggcatttaagtggtgaatatcagcgcagctcagattgtagaatattggaaaatcaaccagaaatttttaagaactatggcgctgaaaagtatggacctcattccgtttgtctaattcagaaatcagcattcgttatggagaagtgtgagaggaagctgagttacccagactggggaagcggatgctatcaggtttcttgttctcctcaaggtctgaaagtttgggtccaagatacttcatatttgtgtagtcgggctgggcaggtcctccctgtcagtatccagatgaatggctggattcacgatggaaacctgctctgcccatcatgttgggacttctgtgagctctgtcctccagaaacagatcctccagccactaacctgacccgagctctgccacttgatctttgttcctgttcctcgagcctggtggtcaccctctggcttctgctaggcaatctgtttcctctgctggctggatttcttctgtgtatatggcactaggaatggaaaagtggatcttcaagatattcttttatgttatgttcttgtgaacaaagcacaaagtttgagtgagtgccaactgcagatggtagaagtggcattcctggctttggcttggaagaattgacgaccatcagaccttgaagcagaacttcacagcagcctgtcctcatcagcaacccaaccacctcaatcttggagaaggagaaggaactgcaagccaccaagtcttcatttttcagggtttgtaatcttcccaaagttttcctattttaaatttaatggc

SEQ ID NO: 706414 - DNA, 921 bp, Homo sapiens
ggatcggcccgcggtagtctgtggaagtgcttcgggcgctcatcgccgtctggagcgacctgatgctccggacgttggctgtgatggaagagttaagcagctgggggcgtacgcgtgggtagcgtaaatgtattctggcttcatgaaattaatgcagtattaataggaactgtggttatttcggagaactggttgagatagttgaggagagggaactgcgtgtggcgctgtgacgaaggatgaggagtgcctaggggtggatttgcaggagtgtgtgctttgtaggcgtggtgagagcgttgttgaggggagctatgtagagaggaagtggtgctataacgtggctacctctggagagggggtccgcgctacgctggttcaacacttacctccgctttgaggggcacaccccttagggacttttattcggttttcttgaagggtttggcttgggctgagggtacataacaagtgggagctcgtttcccttcctttttttgttctgggcttagggaaaacttgcgtgtgtgcttttgtggttcggtcctcggtagcaaaaggcggaaaggagaaaaacatttacttggtggggagcggggatccaaaaggggggaaagggacgtagagtcgttaagattcggctgggaaacatgtttgtggggggttggcgattggggcttctgagtgcgtgtactgttgggccggcaatttgagatttgctccgatgtttaggcgcgaatatggagagggtgcagtaggggggaacagtgtttgggttggacaccagaagattgtgggagtaattgggtaattcgggtgtggccttaagggaattgttaacaggtgagagaaggagtattggaattgggtgttgtatagatacttgggaaaggttagggttcgggacctgggactttttgg

SEQ ID NO: 706415 - DNA, 2413 bp, Homo sapiens
gcgcagaggcgtcacgcactccatggtaacgacgctcggcccgaagatggcggccgaatggggcggaggagtgggttactcgggctcaggcccgggccggagccggtggcgctggagcgggtcataaataaagttcatcttaaggcaaatcatgtggtcaagagagatgttgatgagcatttaagaatcaagactgtctatgataaaagtgttgaagagttgctccctgagaaaaagaatcttgtaaagaacaagcttttcccacaagcgatttcttatttagagaagacttttcaggtccgtcgacctgcgggcactatcttacttagcagacaatgtgcaacaaaccaatacctccggaaggaaaacgatcctcacaggtactgcaccggggagtgtgccgcacacacaaagtgcggccccgttattgttcctgaggaacatctccagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggccaatagcaggatatgctaacctgtgtccaaatatgatctctacccagcctcaggagtttgttgggatgctgtccacagtgaaacatgaggttattcatgccctgggtttctctgctgggctgtttgcattctaccatgataaagatggaaatcctctcacttcaagatttgcagatggcctcccaccttttaattatagtctgggattatatcaatggagtgataaagtagttcgaaaagtggagagattatgggatgttcgagataataagatagttcgtcacactgtgtatctcctggtaacgcctcgtgttgttgaggaagcacgaaaacattttgattgtccagttctagagggaatggaacttgaaaatcaaggtggtgtgggcactgagctcaaccattgggaaaaaaggttattagagaatgaagcgatgactggttctcacactcagaatcgagtactctctcgaatcactctggcattaatggaggacactggctggtataaagcaaattacagcatggctgagaagttagactggggccgaggaatgggctgtgactttgtcaggaagagctgtaaattctggattgatcagcagagacaaaagagacagatgctgagcccttactgtgacacgctcagaagtaacccactgcagctaacttgcagacaggaccagagagcagttgccgtgtgtaatttgcagaagttccctaagcctttaccacaggaatatcagtactttgatgaactcagtggaatacctgcagaagatttgccttattatggtggctccgtggaaattgctgactactgccctttcagtcaggaattcagttggcatttaagtggtgaatatcagcgcagctcagattgtagaatattggaaaatcaaccagaaatttttaagaactatggcgctgaaaagtatggacctcattccgtttgtctaattcagaaatcagcattcgttatggagaagtgtgagaggaagctgagttacccagactggggaagcggatgctatcaggtttcttgttctcctcaaggtctgaaagtttgggtccaagatacttcatatttgtgtagtcgggctgggcaggtcctccctgtcagtatccagatgaatggctggattcacgatggaaacctgctctgcccatcatgttgggacttctgtgagctctgtcctccagaaacagatcctccagccactaacctgacccgagctctgccacttgatctttgttcctgttcctcgagcctggtggtcaccctctggcttctgctaggcaatctgtttcctctgctggctggatttcttctgtgtatatggcactaggaatggaaaagtggatcttcaagatattcttttatgttatgttcttggacgctgactggacagagaggagcctgtctctcagggcacatgagtcgtcgtggcaggaggagacgggcctcagtcacagtgtcacagacccttgtcacagtggacactagtcattcctgccatgtccttgcagcccaggaggactaaaaagattttaatgaagtctgtgttactcattctgaagaaaagaacttacctgagaggagtaatatttttttaatatatattgggtcagggacagggatggagtggttgttttatgtttacatttttaataagtaaaatagaagatttaagaactaatatttatggtattgaactttaagtgtgatatattccttagaaaaacacaactttaataaaaatggaaactaaaaaaaaaaaa

SEQ ID NO: 706416 - DNA, 297 bp, Homo sapiens
tggctagctgcagttgtctgtgaggctgctcttctggcctacgtatgccttgctcagccccagtgcccttgtgccaccaccttgctggctgtcagcaggcccattgaccctggggccccactgcttgggtgggcacatggtggcccttgtgtcatgagacgtctacaacacacttgatgactgtctctgtggaggctagtggttagcttgacgagactgggggcctagtgacttatggccttgaaaggggcttgccccaattgtggtagtgggccagccgtacttgattggagatga

SEQ ID NO: 706417 - DNA, 753 bp, Homo sapiens
  misc_feature (478)..(478): n is a, c, g, or t
  misc_feature (485)..(485): n is a, c, g, or t
  misc_feature (512)..(513): n is a, c, g, or t
ctacacttaccatgcaggtcggcgtctatactcaatctatccaataactggaccaacggtacaagcttccttaggaatgacaccccaatgctattctagagtacatatctacaacggggtttacaacctcgatgttggatacaggacatcccgatggtgcagcacgtattaaaggttaggtggttcattgatcaaaggcctacatgatatgaggccagactcgtgtaagccagggcaggttctatctacttcaaatggctacctgtacgaagggacatgagaaataaggcctacttcacaaagagccttacaccgaaaatgatatcattttaacttagggttatacccacgcacacgccgtaacaggttttaaaataagaaccaaatagggacgaatgatcatggcggccgcctcaggacagcctgttatagactggagcatgctaatgcatgcgtccggaattcgggcataacgggncaatttnacctatagggagatcggtaacaacaannttggaggggtttaagaacctcagaaatgtgaatatggagcctaaacccagcttaatatgttgggggggaaagcgcttttgggcagagggcgtaataaagggagggaccacgccaagggcttccaacaagaggctgaaaggcggaggctaaaaatggagccccataatctgtaagctaaaggtaactttgtggatggcctaattttaaccaaaaggccgaacttcggaggtttaaaagaaa

SEQ ID NO: 706418 - DNA, 187 bp, Homo sapiens
  misc_feature (114)..(114): n is a, c, g, or t
acacatggttagcacgaacgctacagaagtgtatctcataatgatgaaaagaaattacaacttaaaacacacacacacattacaaaagaaaagaaaaacattggtaaaactcangagcctcagcacaaagaggacttatgcgtctatatagtgccaggcgagtgggacatcaagagctcccaagaga

SEQ ID NO: 706419 - DNA, 174 bp, Homo sapiens
ggacatactctgtggtaagcactgtgtttgtaacctctttcctttataaattacccagtcttaggtatattgttatagcaacagaaaacggattaagacatatgttgtacattgaaccttaatgtacttgaacttgaagtttgatggctgcagcggctatagccatcttacttc

SEQ ID NO: 706420 - DNA, 143 bp, Homo sapiens
cgctagcggcattagtgaacggaggagaggtgaggacagaaagacagaaatctagagatatggaaaagggtgtctccttgagtctgcagctgagtactgatcagtatttgatgtgagaaagcgttcacttaatgccgctagcg

SEQ ID NO: 706421 - DNA, 119 bp, Homo sapiens
aaaatttgctcatttaatctatgttttttaattttttgacaaacagttgatcatagtattcctttatggttttttaaatttttgtaaggctggtagtaaagcctctgtttcattcctga

SEQ ID NO: 706422 - DNA, 391 bp, Homo sapiens
gggaggttgttttgtggcatttgtttgtttgttttgttttgttttgttttgctttccatgtgggaaaagttaacattggaactgtttttagtaaaagatttttttcaggctgggcacggtggctcatgcctgtaatcccaacactttgggagaccgagggagttggatcacctgaggtcaggagtttgagaccagcctggcccacaatggaaaaactccatctcccctaaaaaaacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctca

SEQ ID NO: 706423 - DNA, 321 bp, Homo sapiens
atgcgagtatgcggaagaagttgttgtagtgccccggtcatgatgacgctgtcgctcccgttccaggcacattcaaacttgttgaaaatgcagtcgttctcgtacatgtggaacagagcttgctcctgaaggtagtcagtggacctaggtatggtctcatatgtggtcattgcctccagtgttcatgtgtcccatgacctttgacttgtaagtgtagtccctgtggtgatgcatgtatgctggcctgcttgtggcttgaaacttcactgtcgtgacactggagggagatagatttacctgagaacgaattgagctggttac

SEQ ID NO: 706424 - DNA, 294 bp, Homo sapiens
  misc_feature (6)..(6): n is a, c, g, or t
  misc_feature (73)..(73): n is a, c, g, or t
  misc_feature (83)..(83): n is a, c, g, or t
  misc_feature (266)..(266): n is a, c, g, or t
ctttantagcagcattagaaccaacttaatgcacaaactcaaccagaaataaaaaagggagggaagacttccncaactcattntatgaggtcagcataaccctaacaaaaaaatctggaaaagacactaaaagaaaactatagaccaatatccctcataaacatactctcaaaaatctttaatgaaatattagaaatcaataaggttaagagctctgttgtataacatggtgactacagttaataacaatgtataatatttttganaattgctaagagaaaagattttgtgttc

SEQ ID NO: 706425 - DNA, 471 bp, Homo sapiens
gtcgtctagaggatccggtctgtacatcacatagcctcatgaagaatacagtgcttataaaaatgtcataaaatgcgcaactacagttccttcaaatacagttgatgctatctttggtcctaatatgtgcttcttggatgttactaattttgttgtttgttattgttctttgaataactggtaataagcaccaagttgagggctgattctatctacaggtaagaagcttggatgttttctccctgattttgtcatttctttccaacttcccaaatgcatgtcatacagcagggaagaggcatctctcatgtctcaaaaaagcttaatggcacaggtggatgtgggcactgaatgttgtacagcagtggcaaccagccgggaaaatccataggatcatttcagaccgcattcaacacagatactcatgtagccccgacgtttcttgtgaagggaattgatgtattgcttgag

SEQ ID NO: 706426 - DNA, 277 bp, Homo sapiens
accagccatcccgtaagtattgctttgtggtgctcaaaggccggccatgtaacgatcgtcgacgatgtctacttcgaacacctggcaagcacaggcacgccaaggtccactctggttggtattgacatctttactgggaagacatctgaagctatctgaccgtcacctcctaatatggatgtccccaacatcaaaaggaatgacttccagcttgattggcatccaggatgggtacctatcactgctccaggacagcgggacaggtatttagaggacc

SEQ ID NO: 706427 - DNA, 872 bp, Homo sapiens
gccgcccttttttgtgttttttttttacagtgagagaaaagatggaatcccgttctcatttgggcctctctgaaacttccatttacacccatggcgctcatctatcaagaagaggaagaaaaggctctgcctgtataccataaaaatcaagtactcatgtactggtgagaggtggcaggatattggttcctaccagattatttgggctctaagaaatttacattttcagttaccagtgtattgagggaaccacggggcaaactgttggaagatggtcttcgtggaattatgtcagtgtgccattgcataaagtgcttctggaagttaaaatctgccaggactagtcaaaagtgtccacactttggcaacaaaggataaaagatcccagtgggtatcaccgagtccttcccagctgggtctcattatgggcactgctgctttaacctccaagccgctggccctcaccccaggcgaagcctccgtggccgttcctcaggtagtggattgtaattgggatcctcatctggtgtatcaaaaatagctttcaacaatagatggtgttttcagaattcttattccaccaggttgatggggaaatacatcttccaagaaaaaatattttgttgtccaatgcaatacccaaagggtccccaatgattgatgtttccccaacaaacagggaaatcccatgagcccacgacagaaagggggctggaattgagaaggccgcagaattctgcggactagggtcttccggtcccacatagacgagcttatgtaaggctggcagaaaatagttccacagaccaaggggttaatcccccagggtataagtgtgcggccaaactttttcgacgcgtaatctttatgcc

SEQ ID NO: 706428 - DNA, 402 bp, Homo sapiens
acttgcgctatgagcagaggtactctgagccaagattgtgccactgatctccaacatgtacaacagagtgagacctatctccaaaaacaaaacaaaacaaaacaaaacaaaaaaatcataaacaaacaaaaaacttcaaggagggctcggcacggtggctcatgcttgcaatcccaccaccttggtaggctgaggtgggtggatgacctgaggtcaggagttcaggatctttcctggccaacatggtgaaaccccatctctactaaaaatacagaaatttagccaggtgtggtggcgcctggttgaggcatgagaatcgcttgaacccgggagttggaggttgcagtgagccaagatcatgcctactgcactccagcctgggcaaacaagagtgggactctg

SEQ ID NO: 706429 - DNA, 375 bp, Homo sapiens
tcatgatttctgcattttttgtttaatatgacattggtagcctgtttaacttcattttatcatggccacttataaatagatagcttaagtctgtgtgcacaaaattatgtttcattctgttaaattttttgtttttttcttttttagatagagatttaagttccttatataactaagggtcctattccaaatttaacaatcaaggtacctagttgtatgaaatttggaaattttcttaaccctctcttctgtgttattggcactttttgattttctaggagctctggggtttgcaagtttctgagccttgagtattcctgctttaaccagcgggatggcagccattttgccctgtgttagtgccttgtccgtggg

SEQ ID NO: 706430 - DNA, 279 bp, Homo sapiens
cagactagatggtattttagagaaaaatatattgcttcaaatatggttttttgttgtttgttttattgagacagagtctcactctggtcacccaggctggagtgcagtggcgtgatctcggctcacagcaacctccacctcccacattcaagtgattctcctatctcagcctcccaagtagctgggattacaggtgcacgccaccacacaaggctaatttttatatggttagtagagacagggtttggctatgttgagcaggctggtcttgaactcctg

SEQ ID NO: 706431 - DNA, 309 bp, Homo sapiens
  misc_feature (260)..(261): n is a, c, g, or t
caagtacggatgtgggaatggagagatgaggagtgactgcgccaatgggtagaaggtttctttttggagcgatgaaatgttctaaaattgactgtggtgacagttgcagaactctgtgaatatactaaaaatgactgaattgtatgctttaaatgggtgaactgtatggcatatgaactatatctcagtaaagcattttttttttggtttttttttaaaccccgattaggggtttcccactggcactggcattatacaanngcaaaacctggctgggtgatccaacccgggcctctctctctatgccac

SEQ ID NO: 706432 - DNA, 754 bp, Homo sapiens
gcgcagtggctcatgcctgtaatcccaacacttgggaggctgaagcaggcagattgcttgaggccaggagttcgagaacagtctggccaacatggcgaaacctcatctctactaaaattacaaaaattagccgggcatggtggcacatgcctgtaatcccagctacgtcaggaggctgaggcacaggaattgcttgaacccaagaggcagaggatgcaatgagccaagatcacaccactgcactccagccttggcgacagagggagactctgtctcaaaaaaaaaaaaaaaagggtgtgtggcccgggcccttaagcctttggccttggtggcccagccagagagccaatttaaaaggggctgggtttccttatatcacacagatataatttggctagtggctaacgccaaatggtatccctttggggtttttaacgtgcgttatcagcaacatatcagtgggtgggtcccttttggggctcaatttcccccagtggactctcttggtttccttaaaagcaagcctctttatccctagagggggagggaaccccaaaggggggccatagagggttatagagaaccctatattgtagcaagtgtggttttgttccataagtctcctcgggcagcagttccgtggaaacggtgtgctcaacatttttcaccagagtttcccaaccccttgggggcaagtgggcctctgcgcggggcaacatggggggacccaagggctctggcggtcaccgaacat

SEQ ID NO: 706433 - DNA, 714 bp, Homo sapiens
  misc_feature (45)..(45): n is a, c, g, or t
cgcgagtgtctttcaacaggaggggggcacccattacagggcaanaggtttgattcctttttgcttgaggccggcagccatataactccaagggggtttaaaaatcctccccccaccatttttgttgaaataacatgggagggaggtaccaaggggcgtttttccccaaaaggcacccgtcccttttgggaacagcactctttagggccagggttaacacctgagatttttccccggtaaacccgagggtccgcgtgtgtaaaatatctttaagtaggattgaaggcctctgtggggaatataatgttccccaagcctataaaaataaattttccaggttcttttttatgccagagagcagcccgggttcggttattttttaaaatgaataacggatttcttgacgggggtttgggatttcttccctcccggctgattttgggatagaacccattctttaaatttgataggcggttttcagaaaacttttatcaccaaggggccaatggttatctaaaacgggccatttagaagggggcggttttatactagatttcagaaatttgaaaaatagcaaagaaggcgggatttggaaggcagggtctccaattgctggtcaattttgaagctatgaagaataaaggtttcggctttggattatgaacccccgtttatgatttttaaaacccccttgaaataaaaatggttggacta

SEQ ID NO: 706434 - DNA, 199 bp, Homo sapiens
  misc_feature (82)..(82): n is a, c, g, or t
  misc_feature (117)..(117): n is a, c, g, or t
  misc_feature (193)..(193): n is a, c, g, or t
cttagaggatcctgggatgaggaacgtcactgggatgaggaacgtcactggggatgaggaacgtcactccagggactgcaancggcccttccagcactgagaagcacaggcacacanccaaaggtaacagcgttacacccatcccctcttcctccctgggcaccacctggacccggctatcacagaacaacanaaccaa

SEQ ID NO: 706435 - DNA, 245 bp, Homo sapiens
actgcactccagcctggacgacagagcgagactccatctcacaaaaaaaaaggaaaagaaacgggccatgtgacaaagggacaattccgtgtacgatcccacttctgtggggtccccagaagagacgatttatagagccaaggtagaacagaggttctcacaggccgggaaagggaggaagcggaagtgagtggtgatgggtccagagctggtgtaaggggtgtgggacggcacaggggttcacg

SEQ ID NO: 706436 - DNA, 111 bp, Homo sapiens
gtcggaccatgtatcctcttggagaagcatggcgatgggcaggactcagccctgagcactgccttctctctgactctcactggacaggagaggcagagagaaggcagggac

SEQ ID NO: 706437 - DNA, 729 bp, Homo sapiens
  misc_feature (407)..(407): n is a, c, g, or t
ggctgaggcaagagaatcgctggaaacccaggaggcggaggttgcagtgagccgagatcgtgccactgcactccagcctaagcaacagagcaagacttcgtctcaaaaaaaaaaaaaaaaaaaaaaaaagaaaaaaacctgtgatgtacttttttggtaattgtggggggaacaaaaattgggaaaaaggtgtgggcttaattggtaaattctcattcttgccattacaattgcaaagtcacgtgcattaatgggtctcaaattgtgattaagcccagtgaaaatattccattaagcggcatatacgtgtttaagacacacgaatagtttgaattcccgagaagaaaaaacacgttataaaaaccaaagtaaaacacaaagagtttggctcccgtggggcagttagnattcttcacaagggtggtaaggagaattattcttcttccattctattaagccccgtgtagccaccaaccttgtacccttttaagcctttcatgtgcattacctattttgaaattaagcaaaaaaatacgtgtcaagggacaattggggaagaaggggtacgcaacgtacccattcggtgaattctagaacaggacttgtcctccacacaaattttggacccacctaccgggcacgagacattattatctgatacatagtgtcgccttaccatagcgctagggtaccatcctgaacgcttacggtatataactgcttcccccg

SEQ ID NO: 706438 - DNA, 611 bp, Homo sapiens
gccgtgtggccctgggaccctgggcccagaaaggactgatgaactaccctgcagtggtgatggcctgaggcctggggttgaccactaactggctcctgacagggaagagcgctggcatgaggctgtgctccctcctcaggtggcctctggctggctgtgggggactcctgtttactaccacagggagacagaggcgaggtaagccatcccctctgtgtgatgaacttgctgcctgaccatccataggctgggctggccccaacactcatccgacagccccagggttgccactgaggccccaggaagttgctgccctccactatcgatgcctcctttgaattgcacacttgaggactgagacttgggcgttagagctccattgtccttggggttactggtcggccatttcggggtagctgggcgaaggcgtggtgcaaaaatgcacccccctataggtatgcttagttcaccaaggcaggacctggacgttccgtgaagtagcagcaggggaatagcccccttaccattgctacacccgaagggggaacggggatcgagaccctggtctactgtgcatggaatggggtacgtacactaatatcacatacccc

SEQ ID NO: 706439 - DNA, 153 bp, Homo sapiens
  misc_feature (77)..(77): n is a, c, g, or t
tgaggatccattgatatgcatgatcagccatggccactacccttcacagccggtgtttgccccatgcttcagagcanaccacgcatgctgacgtcgggcagccatccccaggccatcgtgtcatcctctaccccctcatacgcttatacaatg

SEQ ID NO: 706440 - DNA, 902 bp, Homo sapiens
cagtttccctatgggccccgcggcccatttgagtcccaatgctgggactgtaatcttgcgcccgacaactcggtttccatccccgagggaaactcgccattggtaacaccggccttccataattagggatttctcttcactggtcgcccactagatggtggcccattgggtcagacactcggagtcgcttgtcccaagaccttcacgcggcgacagtgttatgctacattctacacggctcgggtaatgtgtgacgcgcttgaatgttggcgcgtcccgcccaaatgaagtgctaggtcctcttgctgacgttgaacatcgttatacgcattgccggtaccatcaccgcgaggtgttacctggtcccctccccgtccaggaaatcccaggtgcccccccatgtaggctgtactcttcgggaatcaatctagctagctgtgcgcggacttatttttccagttcctcgcatgtcatttccccaccttactttcatcgaaatcccggcgcaactgaagaactcccgtaagggacgccatccggtgtgagatcatctcctcgatatgaccagcccactctcgtgagataataagatgcgactgcacgaagacactcagtgactaatcactgagcatgtcattcccacccatacagcggttttatacccccgcatgccaatttccccggatacgttattaacccgaactccacattttctaccgaatccactgacgccgggaggtctatacaccgactccaagagcgatcctagaataacagttgtggaccacaaaaacaacaggttgtcgaatcaccgatcagttcaaaaataatttcccttaaaatttttggaatagggccccccttttccctatgtcaacccccatttaccccctcatggcctc

SEQ ID NO: 706441 - DNA, 188 bp, Homo sapiens
agccggaccacgtgggtgtcatgcaccgtggtgtgaagaatttgctcttgtgtgcaggcgtagtgcaatggtgtgttcttggctcacgcaacctccacctccgggttcaagtgattctcctgcctcagcctcctgagtagctgggattacaaggcacctgccatcatgcccagccaggttttcttata

SEQ ID NO: 706442 - DNA, 235 bp, Homo sapiens
ggaccacacgaagtgaagcctgcacaggagactgctgataaatcttaagcatcaacagccaaatcgaccaagcagaagaaaggatataagagttgaagaccaccttactgaaataagacatgcagacaagaatagagaaaaaagaatggaaaggaatgaaaaaagcctccaagaaatatgggactatgtgaaaagaccaaacctatgattgattggagtaccagtgtggagagag

SEQ ID NO: 706443 - DNA, 753 bp, Homo sapiens
  misc_feature (25)..(25): n is a, c, g, or t
  misc_feature (40)..(40): n is a, c, g, or t
  misc_feature (99)..(99): n is a, c, g, or t
  misc_feature (136)..(136): n is a, c, g, or t
  misc_feature (141)..(141): n is a, c, g, or t
  misc_feature (215)..(215): n is a, c, g, or t
  misc_feature (223)..(223): n is a, c, g, or t
  misc_feature (232)..(233): n is a, c, g, or t
  misc_feature (242)..(242): n is a, c, g, or t
  misc_feature (261)..(261): n is a, c, g, or t
  misc_feature (303)..(303): n is a, c, g, or t
  misc_feature (311)..(311): n is a, c, g, or t
  misc_feature (315)..(315): n is a, c, g, or t
  misc_feature (319)..(319): n is a, c, g, or t
  misc_feature (327)..(327): n is a, c, g, or t
  misc_feature (390)..(390): n is a, c, g, or t
  misc_feature (392)..(392): n is a, c, g, or t
  misc_feature (537)..(538): n is a, c, g, or t
  misc_feature (555)..(555): n is a, c, g, or t
  misc_feature (708)..(708): n is a, c, g, or t
ggtactgtctgctcatagaagtcgnttagtgaataaagtnacatattgtgggcgattcagtccatctgtgtgagtatcagtaaagctgaaagtgactcntcatcaaataggatcttcatagctatgagagctgcanaatcnatctgtatgatcaaagttcttctgtggggagtcatcttgactataatcagctgtgatgctggtagccgtctatntggtctcntgctgtagnnaatagactngatgtaattggtgaaggtntgctgaagcctgactgaatgatgggtgacatctgttggttgntgtagacnaagnaagnatgtgatntgaatcggtctcgctccaatgtcgacacaggtgtaataaattggttctgattccacccatccntnttataatgctccggaaggtcccgatattgccataatgtattcaagacctgggctgctgccttcaccactttcagagatgatctgtcgcccctgcctttggttatgttcaccagcttctctatgcctcctgagtcggcagggcttnntgcgttctccatgtttntgctggtgacctcgtgcagagcacagcagatggctgccatggtctcatcagacaagacactggggccattgccgccggggagccggttgacaggttctcgccgttagatctttctggatcttaatgtatgaactgggtacagttacacatttntgtgtatagagctgaggtgtacagcaactcatctgacactcgtgc

SEQ ID NO: 706444 - DNA, 354 bp, Homo sapiens
  misc_feature (19)..(19): n is a, c, g, or t
  misc_feature (41)..(41): n is a, c, g, or t
  misc_feature (103)..(103): n is a, c, g, or t
  misc_feature (302)..(302): n is a, c, g, or t
  misc_feature (330)..(330): n is a, c, g, or t
gacttcccatccaagatcnccaaagaaatgccagacaccgncttacccgccgaagaacgcccacccagcagcacgacgaacgagttgaacgcaaccttccctnccgagcaggtcgcgctcctgttcggacagcgccctcggtgcgttcgagaaacaggaatgcgatgccgatcggattgatgatgccgatcaggccggtgaagccgaacaggatctcggagataagacggttgacgatcatcgggcgaagcatcggtcggggctgggcggcagcgcgccggaggtcacgcattgtagagcanagcgccggcccgagacgcaaacttgcgncgggtccggctcgccgtcgatcgt

SEQ ID NO: 706445 - DNA, 406 bp, Homo sapiens
  misc_feature (183)..(183): n is a, c, g, or t
  misc_feature (294)..(296): n is a, c, g, or t
  misc_feature (310)..(310): n is a, c, g, or t
gtggtgtggatgggggatgtattgtgcatgatggagggttttatatgatgatttgtaatattagaagggtaaaaaataaaaaagaataagggagaaagaaattttggtgttattttaataggggtgaatgtaactttgttacgggaaaactttgtgggattatgcggaatggggtggggttanttggtctggaaggatgaatacggtaaatgaaagatcctatgatgtgtagggtcatttttttctctggcagcagtaatattaataattttcatgatttgagaagctttgttnnngaagtgaaaagtcntaatagtagaagaaccctccataaacgtggagtgactatatggatgccccccaccctaccacatgtgtgaagaacccgtatacataaaatctagac

SEQ ID NO: 706446 - DNA, 303 bp, Homo sapiens
ggcactggaccggtcgacgactgcatacctggtggtagcagccaatgacggcccatgcccagacccgagagcactcattactggccagacagtttggggtggggcatgtggtggtgtatgtgaacaagtctgacgctgtccaggatctctagagatgtgtggaactgtgtggaactgagagatccgggagctgctcaccgagtttggctataaagggggaggagaccccagtcatcggaggctcttctctctgtccccttgagggtcggcacctgagttagtcttgaagtttttacaagagta

SEQ ID NO: 706447 - DNA, 452 bp, Homo sapiens
  misc_feature (11)..(11): n is a, c, g, or t
  misc_feature (120)..(120): n is a, c, g, or t
  misc_feature (304)..(304): n is a, c, g, or t
gcccgcagccntgggaggtacgtactactggccccctttcaacggctgggaaaactgagacccagaaaggggaagggacttgctcagagtcatactgtgaatgtggacgaggaccagctntcaactccaaggtgcagccacccacgtcttaaccagagcaggaaggcgtcagtaacctcggtggcccaacctcagaacctgactctgctgtcaagggggaagataatcccaaaccccgacaagtagctggagaatcataactgacctccaaccaagtgtgactttgggcaaagcgctaacactntgagcctcagtttcaacgtctattaaatggggataattgtagttccgccttttagggaatccctgagaggatgaacctcagaaggcatttagcagaaagcctggctgattttgccatgcctccttattaaatgggatgcgctataaaa

SEQ ID NO: 706448 - DNA, 116 bp, Homo sapiens
tgtggcagacggtttctcaccatgtggtcgggctggtctcgaacctcctgatctccagtgatctgcttgccttgatctcccacatgtgctggtgattacatggctgtgacgccacc

SEQ ID NO: 706449 - DNA, 367 bp, Homo sapiens
  misc_feature (18)..(18): n is a, c, g, or t
  misc_feature (100)..(100): n is a, c, g, or t
  misc_feature (153)..(153): n is a, c, g, or t
gatggagtttcgctcttnttgcccaggctggagtgcagtggtatgatcttggctcaatgcaacctcagcctcctgggttcaagcaattctcatgcctcancctcctgagtagctgggactataggcacccaccaccacctccagctaattttnatatttttagtagagactgggtttcaccatgttggccagactggtcttgaactcctgacctcaggtgatctgcccaccttggcctcctacagtgccaggattacaggcatgagcaaccatacccggccatcaggtatttcttcatagcagtaggaaaatggactaatacagtcaaatggtaccagtagagtggagtactgctattaaggatacc

SEQ ID NO: 706450 - DNA, 153 bp, Homo sapiens
ctcttgaacggtttctgcactgtatgtcgcaaccaattttgatctgatgtcaccaagtggcaagggtaatggaagtgtaactgttctggtagttcaataaggacctccttgcctttttaatagaaacatacataaaatatgaccaaccccgga

SEQ ID NO: 706451 - DNA, 137 bp, Homo sapiens
tgggtcagtggtgactgtgtgggtgcagtggtgatgtttaacgataattagagcttggcaggtagacaagggcagccgtggcagacagtccccacagcataacaggggcggccgccctcctcatcagccgagagccg

SEQ ID NO: 706452 - DNA, 1693 bp, Homo sapiens
tgggaaaaaacccttggtttatcccctctgtgggacccttttcccgtaaaaggcccctcccacccttggggtggggaacatgtggggggcgttgggacttcccagggaagctctccggggaggcggtgcgttggccctccagtgttattttggctcttctcccacactttttcccagggcggctccccttgccaggggttcaacgccacataattattgctgcgttgaagcgcagacaaccaggcgtcggggagctcccttataggggtctgcgtcgagaagggtttgtttaccccccaaaaaacccaccttctccaagagacaccaagataaactccttgtaaaataaaggacagaatctagaactataaacggccccgagggggcgccatcttatatgaagaaaatgagggactcacactataaaaatatgtgggacagtgcgtcgcaataggaacacaatatgtgatgatatgtcccacaaccaaattgctattcaacggacacccagataaacactacaacccacacaacagatgagagaagagacgcgacaacacaacggtgagagcacacagcgaacaacaaacgaatcagaacaacaaaaatcaacaaaatgccacacaaagaacaacaaagagagataagatgcaaaaacagacagaggaagaaacaaaacactcacaacaacgaagaggcgccacacaccacaaaatcaagaaagacagcgaagcaacgaccatgcgaaacaacgagcgaatcaaaccaccgtagcaccgagactaagtagagaaatagtcatatatcattgaacacatgccatagtgcggcgagtgatggtatacaaacacgagtcgagtagacttagactagatcgcctactaaaatatcgagtcagtagtatgtacacccaaacatatagtatgcaggcaccaacaatcgagaagagcaaaaatctatcgtaacatccgcacgttaaaataatagtgcagacgacatacactcaacaaaaacaaccaagcatatcgattatcaacacaagtgatgtgagtaaaacacacaccccgtgataatatatcaatatatcgatatgcaaaacaaacatcttctgcacgagcgtcagaagataatacaatagcgcagtgcacccacgacacatgacacatcaaagaaataccaccagcacaatgaacgcaatcgagacagaaaagagagacaaatgacattcaccaacccacacaccgacacaagaacatccatgactaagatccaactcgactacacgcacagcagcatccccacaagcgaatacacacacaacaaccacaccgaacaaaccacatcgcgaatacacaaaaaagcaactgagagaatgacacacacatgatgagacgacgagacaacgccagcggccaacagtcgagagagccgaatcgaagaccaacgcggtgatgagaatcagaaggaatagacacaatcgaagcatgacagaaaacatacaagccgatgataatgaaatgagcgacagtgcgagcaaccaacgtggaagaaaacgaatacgaacggacgggaatatgattcagatagacgaggacaagagaatcataagccaggagaagagaagcgaaagcaaaatgagaaaagaaataacgaaaatgcacgcacacaacctatcgagatcaatatcgagata

SEQ ID NO: 706453 - DNA, 866 bp, Homo sapiens
gaagaaactgccttcatccacgtctggtgtcttctccttcttgtgtcctcctgcccacagacgcctcagtctctggagaatcgcaggtatatggttctggtcccctcccatgctccacacttgagaccactggaggaatgggctgtgtccttctgagactacctgaactgagagagagtactgtaatgtgcgttcctatggagttgtgctcagggtgacaataggtagccatcgttcatctgagcctgagacggcggagagatgacggtattccacgtctgatcgcacttcgcgtgtctcacatggtcttcagtcctattgactgaggctaaatgtcctctcacggttcctgtgtgatagtgtccaattccaatgaacttagtgaagggggagccatagaggactggtgtaggaaccgattgacatgtcgtggtccttggtctcagacgggacacgctcacatctacgaaccaatggcgtgacatgtgcaaatttcagtgatcgtcttcgatggcatgtagacttctcacccccatgaatgagtagattcgcattagtatacattcaaggatcccgggtggacatcgtatcgcacccagggagagtgtccgcgaagagggtggcctcaatgcatgttcttgtgccctggtatcatagacctgccaggtctcctacaaggggtggtacgaggacatgggggaagcagacacctataccggggggcatttgctcccattggaagacaggacgtgccagaaatccactggagctgagacgttctggtgggatacatggaggggcctcactgaggcgctgggaacatgaggcagtcggcaggctggggggcaccagactctgggaccctg

SEQ ID NO: 706454 - DNA, 224 bp, Homo sapiens
gaggggtctcgctcgttcccagctggggtgcgtggggtgactggctcacgcccctccatctccgggttctgcgattctccgccttgcctcccgggtgctggaattaaaggcaaaaaccaccaaaacctgtaatttcagcactttgggaggcttaggcgggtgggatcacgaggtcaggagttcgagagcagcctggccaatatggttaaacccagtctcctacc

SEQ ID NO: 706455 - DNA, 396 bp, Homo sapiens
  misc_feature (81)..(81): n is a, c, g, or t
caatcgagccggtaccaggagtgtcgtctttggtttctcactcctcagcccaagttccttgcccggccgtgcattcgtgcnttagctgctcggtcgacgcagatttcctacaattcgtgccgtgatcgcatctcatctgcactagtgctccggactcgctctgcaatcgcacccggcaggtgtctggatctgctcagtcttgaagctgggatggtgagctctatcacccgtgtggtcatcatttacattgctatcaggatctgccccctcctggttgacgaagtccttcacactctgtgattgttcttgaagttcctggttggcctgttccacctgtcccctggaagcattagccttgtccagggctgcctgggcccgctgctgtgcctcgcttgc

SEQ ID NO: 706456 - DNA, 141 bp, Homo sapiens
gtaccgaggccaggacagcagtgatcaaaactggagcagctctcaggctcctgctgcttatgcacaagggtagaaagaagacagaacacaggccctgggaaaatggccagcatcaccaagtgctccaggacctggagatct

SEQ ID NO: 706457 - DNA, 180 bp, Homo sapiens
  misc_feature (110)..(110): n is a, c, g, or t
ttatcgtgcgagtgtctcggcatgggagctctgagctgtgttggggctcgtctctcctcctgagctctgagctgctgtcgatgctctgcctcacctgtgtaggagcgcgncctggctgcggtacgagctcgatcgtatctggctgctttccggtaatgttccgctacccccgccgcgcgc

SEQ ID NO: 706458 - DNA, 475 bp, Homo sapiens
  misc_feature (57)..(57): n is a, c, g, or t
tgaacgaaggtcactcaggtgaagttctcctgggcatttttctactaaggtttggcncaactttctcaaaacataataaacagacattactgcactttggccctccagaaagtcaacgagcaaaatgtcttggcatcccaaaacactgttgccatgacctttgctcttgactggtccactttcgccttaatgggaccacttcggcctcttggtagccattgctttgattgtgcttagtcttcagtattgtactggtgaagccatggtttatctcctgttacaattctttcaagaaatgcttcaggatcttaatctcacttgtttaaaatttccattgaaacctctgctcttgtctgcagctgatctgggcatgagggtttcgacactcattgagtggaaagtttgctcaactttaactttcagtcagaattgagtaagctgaaccagttgagatgtctatgatgttggcggccgc

SEQ ID NO: 706459 - DNA, 167 bp, Homo sapiens
  misc_feature (105)..(105): n is a, c, g, or t
aagccgagctaacacagcatataatgctggatcaagctaagttgcaagctacactacagctcacagcaacactggatccttaacccaatgagcaaggccaagatngaaccagcaacctaatggataccagtcagcttcattaacaactgatgcacgacaggcactcc

SEQ ID NO: 706460 - DNA, 210 bp, Homo sapiens
catgaaagggctcaagtgctgtggcttcaacaactatacggattttgaggactcaccctacttcacagagaacagtgcctttcccccattctgtggcaatgacaacgtcaccaacacagccaatgaaagctgcaccaagcaaaaggctcacgagcaaaaagtagagggttgcttcaatcagcttttgtatgacatccgaactcatgcagt

SEQ ID NO: 706461 - DNA, 108 bp, Homo sapiens
aaccattgaatgtcaacataaaatattaaaagtactcagagattaaaagacaaattacatatattgggattagttttagactgacattagagtgcttataagtgacgg

SEQ ID NO: 706462 - DNA, 363 bp, Homo sapiens
  misc_feature (361)..(361): n is a, c, g, or t
gatcctatacaccatagatagaattatgatacatgctcctaccaagtaaatgggttaaataaatgaatagggatactcttccttacaaatcagtagaatgagagaactattggaattagaaaatcactttttgacctggggttgttggtggctcacacctgttaaatccctggcaactttggggagggctgaggcaggaagggaacctgcttgagcccaatgatgcttgagaccagtctggcaactagtgagactcggcttccttaccggaaattggggttgggtaattaagggggggtaacccggaaggccttccgaaaatttccggtaaattccattggggtccataaggcttgttttncc

SEQ ID NO: 706463 - DNA, 328 bp, Homo sapiens
agagtagatgaacatgaccttaatttctttcaattttgtaaagaaacccagccatcccattactgggtatatacccaaaggattataaatcatgctgccataaagacacacacacacgtatgtttattgtggcactattcacaatagcaaagactaggaaccaatctaaatgtccaacaatgatagactggattaagaaaatgtggcacatagacaccatggaatactatgcagccataaaaaatgatgaggttcatgtcctttgtagggacatggatgaagctggaaaccatcattctcagcaaactatcgcaaggacaaaaaacaa

SEQ ID NO: 706464 - DNA, 634 bp, Homo sapiens
gaagagacatatttctatctttattgccggatgtgattttgccagcaggcaaataaatacaagtggggagagggggaaggagggggatcctgtataaattagaacacaatctcaggtggggggaaggtgggtgggctggcaggggaggtggcaggcagggagcccactgctgggcacggtggctcgtgggcgttagtcacccctgtgtccccgcgagggctctggcgcaggcttcgcccctcagtggctgggtcggattcgggggctcataaggcgcgtgcggatgttggtggaatccggactttgctgctgtctgagccacgagctcacaggtcgaggtcactttgttgttgccaccaggggcggcggaacgtgcatgcgaggtcggcaaggaccaggcatgcagctttctggcccatcatgggtcctcctccagggcactgataatctgatcatagtacctgtggatgttggttgtagagttcttgcagagccttccagagagtggggagcagagagtgtagtgcccggagagctcagccaaaagagagttcatcgtacctggtagcgcgccggacgagctgtggcgaatgtgcgcatagtacctctccgcatctgctttggtaggtggtgt

SEQ ID NO: 706465 - DNA, 128 bp, Homo sapiens
tgctgatcacgcatggggaggggaatacacggattcaggtggtcaggtgcaggcctgaggcagggagacccgctgctgctgagacaggcaggctggggacagaacctacatgctgcccaatgctgctg

SEQ ID NO: 706466 - DNA, 332 bp, Homo sapiens
tgatgattccatgagattccatttgatgatgattccattcgtttgcattcgatgatgattccatttaggtccattcaaagattccattcgattccattctatgatgattgcattcgagttcgtttgatgattccattcgactccattcaatgatgattccgttcgttgatattcaatgattccattcgattccatttgctgatgattccatttgactccattcaatgattccattcgattccattcaatgaggattccattcgagtccatttgatgattctgttcaattccattcgatgatgattcctctcaaatccatttggtcgacgcgg

SEQ ID NO: 706467 - DNA, 360 bp, Homo sapiens
gaggacctgttaactactgagtgtgcctggaaactgttaaagttagggctgttgttcgtcttgtcaaataattcataggcgagggacaacctgtgtgcaaggctgtttgtacagtgtggttcgtgtattgaggttgacctagaaggttgtttggttggctgtggtgcgagtggtagtttggcaggttgccacatcaagactaacactgggctgaggggaaaagtggctgttagggtcatgcaggaaaaagaaagtattgggttgtgtacccaaagaagggtgtagggggaagccatgttaacaattctccctgcagaggccaggtctgtaggctcaagagtatttgtcctcccaccggga

SEQ ID NO: 706468 - DNA, 319 bp, Homo sapiens
cctgattctgtggttgatctagaggatccctggcaggaatagtgcctactccagccggacagcagaccatgcgggatgtctggtgaggaccaggtgcaccctcccctctgccactttccccagatgagcctgcagcaccagctccctcagcctggagctcagcgtcttgccacgaggggctatcccatggcaggacatgacagctgcaagtgtgtaccgactgcctccgcggggcacctgtgtggtcctgacgcgtgctgctagactgtgtccatcaatgatggagacaggactctgcggtgtgacgggtgctgcagac

SEQ ID NO: 706469 - DNA, 203 bp, Homo sapiens
tatggaccatctctcatcagacgtctgtgaatgcggaccccgtctcccacgagatctggacgtcagaaactctgctccaggtacttgtagaactgtggcttcatcactattcctatggagatgtatcaacacaatgcagtacccttcatgccaaagctggaaggtactgcaactaaccgactcaggtgactcccagcggtgct

SEQ ID NO: 706470 - DNA, 242 bp, Homo sapiens
tgtgggcatgggctgagcatgtaggtgctgtgctgcatcggcagttctcacctgacttcggcgtggattcgtgacgacttttacggctggtacctgctgcagattttcggtcagccgatggccgtgttgccgctgctgatgctgtccaccggcagtatccagcggcaatcgacccagcgcaggttgcacagcgccgccaccagcggcagcgcaatcaactgcggcagcgactgaggtatcga

SEQ ID NO: 706471 - DNA, 155 bp, Homo sapiens
tagaggctacctatatcacgcactacgagaataacagggagtcattcaggcaatcatatgtcagatttggtacaggattaaatatactaacatttttaagtgtccttgggtttcaatattaactaaatagcaacaaacaagtataaagaatatac

SEQ ID NO: 706472 - DNA, 917 bp, Homo sapiens
  misc_feature (8)..(8): n is a, c, g, or t
  misc_feature (13)..(13): n is a, c, g, or t
  misc_feature (22)..(22): n is a, c, g, or t
  misc_feature (25)..(25): n is a, c, g, or t
  misc_feature (87)..(87): n is a, c, g, or t
  misc_feature (147)..(147): n is a, c, g, or t
  misc_feature (423)..(423): n is a, c, g, or t
  misc_feature (458)..(458): n is a, c, g, or t
  misc_feature (461)..(461): n is a, c, g, or t
  misc_feature (521)..(521): n is a, c, g, or t
  misc_feature (523)..(523): n is a, c, g, or t
  misc_feature (547)..(547): n is a, c, g, or t
  misc_feature (573)..(573): n is a, c, g, or t
  misc_feature (575)..(575): n is a, c, g, or t
  misc_feature (583)..(583): n is a, c, g, or t
  misc_feature (594)..(594): n is a, c, g, or t
  misc_feature (603)..(604): n is a, c, g, or t
  misc_feature (606)..(606): n is a, c, g, or t
  misc_feature (613)..(613): n is a, c, g, or t
  misc_feature (709)..(709): n is a, c, g, or t
  misc_feature (713)..(713): n is a, c, g, or t
  misc_feature (740)..(740): n is a, c, g, or t
  misc_feature (761)..(762): n is a, c, g, or t
  misc_feature (772)..(772): n is a, c, g, or t
  misc_feature (778)..(778): n is a, c, g, or t
  misc_feature (783)..(783): n is a, c, g, or t
  misc_feature (787)..(788): n is a, c, g, or t
  misc_feature (795)..(795): n is a, c, g, or t
  misc_feature (799)..(799): n is a, c, g, or t
  misc_feature (803)..(803): n is a, c, g, or t
  misc_feature (819)..(819): n is a, c, g, or t
  misc_feature (838)..(838): n is a, c, g, or t
ggtttggncctgnggctgctancgntcgccgcggagaaattgttggatctggcagtctaggaatgaatctcctctcagcctttaagnctcacctggtcagaatccttggatgagcctgtgggaccgttcctcctagcccggtggttnggaaccagtggctttgggactgataagaggatggacaaagattctcagggtgctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaacaggncgctgttcggggagtgaaccctcctccagtgagangangaaggtatccaaagcccccggcactcctgtgccacccagacccagaccccagaccccggnanacaccaagagtgtgaaaaaaaatnaaacaaccactttcagtgaaccaagntntggggcgntgggaacctgncaaagaacnncnggctcanaaagctgtgttgcagaccaacgacctgactccgtccacctgggcgtgaaattcagctgccgcttcacccttcgggaggtccaggagcgttggttancccngcctctacgatcctgttcatctccaantttggcctgtcaggccatganngcagctgcgncccaangctantgcnnccatccnagancaangccctgttttagcaangctgtaggagcagctgctngagcaaagtggggatcgaccagccagcccaccttgcgagaccttccaggacctgctgcacagacaccctgatgccttct

SEQ ID NO: 706473 - DNA, 278 bp, Homo sapiens
  misc_feature (70)..(71): n is a, c, g, or t
  misc_feature (132)..(132): n is a, c, g, or t
  misc_feature (240)..(240): n is a, c, g, or t
gtcgaccgtttttgggtttgagatgttctcacttattgtccaggctagagtgcagtggctattcacagannaacataggactctccagcctctcaccgcactcattggggttgaatttgcacaaatatgagnggaacaaaagttactaattttacaaaacctaccatcgattttagctaaccttgataagtgaaatttcaaagcaagtaagtgctaattcagaaaaattaggcgtaaaanatcgttacaaatgcaacaactcagagatttgaaacgat

SEQ ID NO: 706474 - DNA, 428 bp, Homo sapiens
agattagacatatttaaaagccactatggtttctgtatagagaatggatgcatagagtagatgaggaagccaattacaagactgtggtagaaagaataaggatcatgaagatgtacagtggtgatgaagaaagctggatggatgcattccagagacgtttaggagacagaaagactaggacatatcaatattagccttgaatgtcaatgggctaaatgccccacttaaaaggcacacaatgtcaagctggataaaaaagcaagacccaatggtatgctgtcttcaaaagactcatcttacatgtaatgacacacataggctcaaaataaaagaaatggaggaaaatataccaagcaaatggaaatcagaaaaaaagcagaagttgcaatcttaatttcagacaaaacagactttaaaccaacaaagat

SEQ ID NO: 706475 - DNA, 1431 bp, Homo sapiens
  misc_feature (1431)..(1431): n is a, c, g, or t
tgcgagacagagtctggctcggtcgccagggtggggtgcaagggtgcaatctgggctcactgcaacctccaccaccgggggtcaagcgagttctccgtggcctcagcctcccaagttagcgtgggactacgaggcacgtgtgccaccacacacagctaattttgggtattttatagtagaagagtggggtttcaccatatgtggccaggagtggtctcgatctcgtgtgaccccggtgtatccaccgtggcctcagacctcccaaaggtggcgtgggatttacagggcgttgagccactgggtgcccagaagcgattttatactaagactttaaaggcttatagttctagggcacacagaattcacaactttcttttccccgagttatatataaacttcccagaagtgtggttctcaaaatccccaaatgtggggaagttccgtgaaaataatcaagtgcgtggtagaaaatctccatagtgttctatagcctctcgtgcgaggtggtattctcgtgcaaaggggggccaggatgtgacccccagacatcccgtggtctttcacttcctcagaagcgtggttacacaaatttagtggctattcacaagtggtattctcgtggtgaacaaagcattcgtggtaccaaagtttagcgaatgtgtcttctggggccctcttccgtgagagggcgctctcccggagaataatagggggggattgacgcagtgttcatataaggagaatccatttcatttccacccacggtgaacatgttggctccggggtgtttcccaagaggcactatcccgaatttccataagaataaaactttctggaggccaattcatttttccaaagggccagcaggtaacaaccacattaattgaggccccaataaattgtggtggccacacggacattgtgggagtgatgaatggtttcatacgtcctattcccacacaaactggggggaacacagacatatggattctccaatataattcttgggccccacaaaggaagtttgatcctttggagacaaggtttagggttgtgggcgcaagaggaatccatttgggacgagaaaacttgtgttgtggtttgaaggagcaccacgaatcccatggtcatcagaagagagattcaaacacaacgatggagagcgagccgagcgacgctacaacggatgatacaagacacacaccagaatccgggaggtggggagtaaaccacgagagaatcataacaccactggtggaaggaacccagatgaaacccccaaggaaatgaagagaaaaagcacaaaccggccgacgacggaagacagctttgtgaccaggacgcaagcatcaaacatgaatcgacgagacaggaggagcgagccgaacaaacaacacaacgaacgtgccgcgcgggcgccgctcagacagn

SEQ ID NO: 706476 - DNA, 233 bp, Homo sapiens
tgagatctgaagtgcaggaatcagcaatgctgaacaaatcctgcaagaagtaaggctaacccatgaccactcctcagagaccttccgtggtgccctccctccatcccttcctctcttttatgattcatggaaaaggagataattgtattcccatggaatgataggtagtctataatgggaaggactgtcaatattctaatgcatcatggtgatgataattattctgtgtttca

SEQ ID NO: 706477 - DNA, 221 bp, Homo sapiens
  misc_feature (70)..(70): n is a, c, g, or t
  misc_feature (84)..(84): n is a, c, g, or t
  misc_feature (105)..(105): n is a, c, g, or t
agcttcattatggacttgaactttcctaaagtttatctgttctttaatgaaatcgaggcatttgtaagtnctcagaagtttttnttgcctctcaatatgaataanacaagcttttggattgctttcccatgtactagcagcccccaagtatacactgagatcaggacacttattttgctgagaagggaagatttaatgtatttagcctgatctgcctactc

SEQ ID NO: 706478 - DNA, 429 bp, Homo sapiens
  misc_feature (225)..(225): n is a, c, g, or t
  misc_feature (346)..(346): n is a, c, g, or t
  misc_feature (423)..(423): n is a, c, g, or t
agcagtacaaggaggcagtaaaggactgcacagaagccctcaagctggatgggaagaatgtaaaggcgttttacagacgggctcaagctacaaggcactcaaggactataagtcaagcctttcggatatcagcagcctcctacaaattgaacccaggaatggccctgcacagaagttacggcaggaagttaaccagaacatgaactaaaccgtagagggcaacangggaccctgaacttgaccttcccaagaagaagccaagggcctcccttgcatctgccccaatgcccagcatgccgccaagggagtgcaaaatcaaccccactttgactccttggagaggtangcagcctttcaccttgacacattttactttgttcagattaagtccattacagacaagcacaggactctttttttttntttctt

SEQ ID NO: 706479 - DNA, 244 bp, Homo sapiens
ggattttatataaaataagagagagagtggtcagtttcatctttctgcagatggctatccaattttctcagcaccatttactgaataggttgtcctttcccagtgtacgtttttgtctactttgccaaagatcagttggctgtagatttgtggctttatttctagtttctgcattctgttccattgatctatgtgtctatttttataccagtttccttaaaatgaatcccaacggggaggaacg

SEQ ID NO: 706480 - DNA, 314 bp, Homo sapiens
  misc_feature (9)..(9): n is a, c, g, or t
  misc_feature (34)..(34): n is a, c, g, or t
  misc_feature (60)..(60): n is a, c, g, or t
  misc_feature (63)..(63): n is a, c, g, or t
  misc_feature (66)..(66): n is a, c, g, or t
  misc_feature (68)..(68): n is a, c, g, or t
  misc_feature (84)..(85): n is a, c, g, or t
  misc_feature (94)..(94): n is a, c, g, or t
  misc_feature (105)..(105): n is a, c, g, or t
  misc_feature (129)..(130): n is a, c, g, or t
  misc_feature (133)..(133): n is a, c, g, or t
  misc_feature (139)..(139): n is a, c, g, or t
  misc_feature (151)..(151): n is a, c, g, or t
  misc_feature (241)..(241): n is a, c, g, or t
acagtattntgaatgagagaacaatgggaagaanttttcgtacaggcatataggtcgtgntcnttncnctataatattgccccnnctacctacnttcgattcgtnccattcttcgcaaccgctgaatcnnctnttcttngctctgactgtnagaatcccctagcgagtcttcagcctcgctatccatatcagagggtggatcaaaactggcagtagaactgtccaggtcaagtcgattcanggattctctggaagatgttcgtaccatagactctttagaagaagaccggaatagagattcctttatcggactt

SEQ ID NO: 706481 - DNA, 553 bp, Homo sapiens
gtggagaggaagtggctcacttcaggtcttagagcgaggtgctaagaaggacctggagttgaattcaagggctcagaagggggtcaggggactgccttcaatgggtgcttcctgggcatactctgcccaggactggttttgaggtgggggtctggtggtggggttgggttgggaccccacatagtggaatgtcttccggaagctggtgactgtgagttacgagagatgcacagacatggcctctctgccgactctgaatggccttgaagaccctcaagggcagagacccaggctatgctccacgtctgggtccacaagggtgcccggtctcagctcagaacaccaaagagagtagacagagcccaggaagcatccggagcagtggcgcagcttcaggtcacttaggaaaacccagttctttgaaagctgcttctctgaaaattgacttgccagaagcttagttctgcaaatggtaaacgtgctggtatttcccaacttactaaaaagttttttttaaaggatacttaataaagatcacagaaattcatattgg

SEQ ID NO: 706482 - DNA, 130 bp, Homo sapiens
tgtgacaatgttcctgctcttgttgcccaggcatgaagtgcagcggcattgacttctggctcactgtaacctccacctcctgggttcaggtggttctcctgcctcagactcccgagtagctgcgattaca

SEQ ID NO: 706483 - DNA, 450 bp, Homo sapiens
ggtgaagggtgcgcggggttgaaagcaggccgctccgaccccgttccccactcccagaccagacagaggcaggcagccggagtcagccgcagtcgctgtgccctctgcagtgggtagttttgtactacatgctgtcggcacacttggggtcatgcaggctggtatgcgtaaagggggcctcgtctagactaatacatctagcatagggtccaaccagactatggacccttgaaggagtagctggaactttgtcgttgaagacggatgtatggatctagctggattgagtaccgcggcgaggtggaccatcgctagtgataagacacataacatcgataaccgtggactggatagaaagaagcctgaattcacaggccatgaaacaaacactacaccatagatcataaataacaaagctcccattaggagaaccatattcaaataaagtat

SEQ ID NO: 706484 - DNA, 1217 bp, Homo sapiens
gcgcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcaagtggctgtcgggcatcgggtatactccttcgggggttactgctctggctgaagactactgagacagctgcggtcagagtagatgtgcacattttcaaatgcagttgtccttgcgtatggacaaaggctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtgggttcacaccccggagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagcctgcacagctggagggactttccactcaggcacaatgctgggaagtcacatgtcatgtcttcgggggccgtgccgaccgcttcgggccattccattcaacaatgagattaactgcaaccgattcgagtctatgacaccagaaatgaggctggtggactggtccccccgatccagttgctgcctgaggggcgccggagcacttccgcctttggatacaaatgggggagcttgaagcatcattttgggggatcataactgcaggcttggaacggcccttcacatgagctctgcagtttaatccctgtgtcctttaacctgcacacaagaatgaccccgcagggcaaggaggcatgtccccgcggctgacagtgtggtgaattgtaggggcaagatggctcgttgggggtaccagccatctcctcgggaagccggggatactttcgcttatagcactccacttacacctttggattacctactgatcttgcctatgcggcacttctaccaacagctggccagaacgggagatcagcacaccatt

SEQ ID NO: 706485 - DNA, 1273 bp, Homo sapiens
gctccgaggccctgcccaggtcagtgcgcaggtcagggcagtgtggcgggggcaggcatgcgccagagtgcagcattgcccagatccccatgttctgtcccctcacaggttcctacctcgctcggtttcttctcccgagccaccgcaggtgtgttgccgggcgacccttcactctgggggtccgccgagaggccagggcttgtaccccctgcgtggcacgtcggttgtctggagcggtcagggtactactcgcttcgggtcgttttacgtggcgtcttagcgtgaagcgacgtattaggaccactgcgtcagagtaggaacgtagccctagttcttcattagagctccggggtcgctattgctgtttgggagcaacaggctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtgggttcacaccccggagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagcctgcacagctggagggactttccactcaggcacaatgctgggaagtcacatgtcatgtcttcgggggccgtgccgaccgcttcgggccattccattcaacaatgagattaactgcaaccgattcgagtctatgacaccagaaatgaggctggtggactggtccccccgatccagttgctgcctgaggggcgccggagcacttccgcctttggatacaaatgggggagcttgaagcatcattttgggggatcataactgcaggcttggaacggcccttcacatgagctctgcagtttaatccctgtgtcctttaacctgcacacaagaatgaccccgcagggcaaggaggcatgtccccgcggctgacagtgtggtgaattgtaggggcaagatggctcgttgggggtaccagccatctcctcgggaagccggggatactttcgcttatagcactccacttacacctttggattacctactgatcttgcctatgcggcacttctaccaacagctggccagaacgggagatcagcacaccatt

SEQ ID NO: 706486 - DNA, 125 bp, Homo sapiens
cagaacctaaccttcgagcagtacatgctaagacttcaccagtcaaagcgtaactactatactcaattgatcccataacttgaccaacgggacaagttaccctaggggttaacagcggcaattct

SEQ ID NO: 706487 - DNA, 101 bp, Homo sapiens
ggattgatacagaaacgccttaggctggactatgcgtgtgctcagctcctcatcctgcagagcttcttggggggctgtgcgtaagcagtgtatacgaagtg

SEQ ID NO: 706488 - DNA, 284 bp, Homo sapiens
ccccccgggggaatgaacatataggattagttcttggttcatcccaaaggtctactggcggtccacagggggcaaaaacagcttctttccagggatgatcaatcccagtatacacggtctttcctaatatggtatgtaagggctcttcctcgtctccatagccgggcccatccattttccacggcttcacagtttggtcatcaccaacagtgaaaaaagaagtcccacaaaagcgagtacatattcctcgtacaaagccttcaggtgctggtatggtacggata

SEQ ID NO: 706489 - DNA, 445 bp, Homo sapiens
  misc_feature (20)..(20): n is a, c, g, or t
  misc_feature (59)..(59): n is a, c, g, or t
  misc_feature (307)..(307): n is a, c, g, or t
  misc_feature (441)..(443): n is a, c, g, or t
gaacacatcagtcccttcanaaaaccctgaggcttctcgaaaaaggctctccctctgtncccaggagaaggaagggacagatgaaaagtcacttcaagttcccagaatactcaggagctgaacttgtcaaggtttagatgtggcaaagcaggcccaggcatggtgactcatgcatgtaatcccagcattttgggaggccaaggcaggaggatcacttgagcccaggagtttgaaagcagcccgggcaacatagtgaaacctcatctctagaaaaaatacaaaaaattagccaggcgtgttggtgtanacccgtggtcccagctactcaggaggttgaggtcagaggattgcttgagcccaggagttcacggctgctgtgagccatgatcgcaccactatactgtagcctgggtgacagaatgagatggtgtctcaaattannnaa

SEQ ID NO: 706490 - DNA, 1317 bp, Homo sapiens
  misc_feature (425)..(425): n is a, c, g, or t
ggattccagaaaattcggaggcgaaatggaggcgcctggtgccccggccaggaccctgacgtggtgaagccatggagcagatacggtggcatttttcaacatccgggtggacacacagtggcccaggagagacgcaaatggaatggtgctggcagtgctccatggactcacctcagatggcctcgatcccagtaacgatagccaggaagcatcaggtggccagaccctaggggaactgtggggacatgtacaatcaaggcagtatgggatgccgagggcgtacagtagccgacaatgatgccgggcgaccgggggagggcatgggcatggcagaatcgtcaggcgtgtgccccaggaccggcggtgagagagaatgaatgggtactcatgacaatagacaacatggttaaatgcattcatgggcncgagaatggacgtccccacaagcgatttacgcgcagactggattaaggggcgtcacgggcgagttcgaagcaaggacgcaggtcccctttttggggccccctgaaggggattggccaagggaacacgattagccttggaagcccaacgcttaaaggaaacctcgccaattcaatttgtggtattcgaggtctccagagagatctgttgaactttttcccgtacaagtgtggttcagggaagagttaacatggaaagagaatcagaaacggtacttactattgtttctggggggggctttcaaatgaaaaggaaaattaacgaaaacacacgaaaagggattattaaagagtggacattgctttataagttagaagacgagaggggtatttaccgggtgtaacaaaaaatgcggaagaggggccttaaatagctggctacagcaattttgtggggggtaacaaacgtactgtggggtgacgtggatcactaatttaggcccatgtgggttttggtaatcgcgctttgtgtgagtaaaactcccgcatgaaaagcagtagctgttgggttcctatgtactgacgtgattgatgaaacaccacgaagaatgagtgggctgaggggcagtattaagagaagaaagatatttttggttagaaccgcgccgaggtagtaaattactatcacacgcgaggttaatatagatagagagactgcgagcaggatgagaggacgtgcgcatgagaaatggaatgaattgacgaaagactagtttttataatgcagggaatgataagtttagagaagtgaggcgccacgaaagcgagggaagttttctcaaaaaaacgcgacctagttggtggagcgagagtattatgcaaacgtatgtcaaaa

SEQ ID NO: 706491 - DNA, 160 bp, Homo sapiens
  misc_feature (93)..(93): n is a, c, g, or t
actcctgggctgtatgggcaaccctaagggatgctcatgcaagaaatgctcgggcctttagggatgtcctggctcacctggacaacctcaagngcacctttgccacactgagggagctgcactgggacaagctgcacgtggatcctgagaacttcaggct

SEQ ID NO: 706492 - DNA, 403 bp, Homo sapiens
  misc_feature (403)..(403): n is a, c, g, or t
agcaaattcactagcaagaataaagcggccgtatataagcgttttatgatatcctactagactttactgattccaaagaaatgtgtattaatgaatatggatcaggccgcgtactggcttattaccctggtcagaatgtcactccctatggattaaccaagatggctaaagatgcaccgactgctgttgataaacccacgtggaattgacacgctctgggtagttatgaaaccggatacccatgctcttggatgtactgggacatgggatacagaggtccaaatactacatacattcgagctggtgcagtcgaagttgacactgaagacatatctgtttcattgcgttcctgcgttatacaccctagatactacgctcttcaagatgaagatgctcgtgcccn

SEQ ID NO: 706493 - DNA, 348 bp, Homo sapiens
agtgggaccccatctctacaaaaaataaaaaaaaattagctggcaggtaacatttttattctaaatcacaatcacttttatcaaactccaaagaatcaatgagctttccttaatagattaagataatgtactacaagatgctaacacgtggttaatcctaatacttgcctgagatgtgctaaatattgtaattatgaagaaaaggctatctcaaattcctactgtttctatttgtgtctgatgggaacaataggagaatcactgctccaatcagcaagctgcatggaggtgtcttctttaacttcaataaatataatttcttacatttcctgatctgtctgtagcagt

SEQ ID NO: 706494 - DNA, 728 bp, Homo sapiens
agattgagcaaccattttttcccacgatccctcgacacaattaccacaaaagttgcttcccctggggcagaccttgtgtgaccaaacatggcataggagtaccagtccaagacccctctgtcaacccttcccgacatcatccactcactaaaggagtcagggcaactctggctagatgcctatcttcacccattaccacagccaccctgccccaatctggaagaagtaggaggaagactctggaccacaggcagaggggagcttgagggacaatggcccactatagtgttaatactcagagggggtttggtttggggacataaagcctctgactccaactcctcccttttatcttctagccacagttctaagaccccaagatggggggtggacacagaagtccctatggagggaaaggaggcttttgggccacaggggtgtaaattatttccctttctctagtgttggcacaagcaggtagttggtgaaccacgagagaacccacggagggtatacagaagaggagggacctactgaacccacgagtcaggaagagatttcacactggaattccacctcatgccgggcgtggtggcacgcgcctgtaatcccagctaccccggaggctgaggcaggagaatcgcttgaaccggggaggtggaggttcagtgagctgagatcacgcccttgtactccagcctgggcgacagagccagactccctttcca

SEQ ID NO: 706495 - DNA, 756 bp, Homo sapiens
tgtcagcagcgcttcttttttcctccgtggcggcccccccctgtggggttggggccgtgctcgtttcatctctccgtcgtcccttcgttttcgtgggtgctctttgtccccaggttggccacccctccggttgttcctccccccggcggggcctgtcttggacggtccttctccggaggcccccctccggcgacgatctgtttgttccccccccgcccccctgcggcggcgtggttttctcctccgcccaccgagagacccctctctttcttctccgcctcctgctctttttttcctcccctccccctcgctagtggtcgtccccaccctcttcgctctccctccgcacaagaggtactttcgccgcgggtctgtcgcggcgagatcccccgccccccgctgtaatcactcccggcgcggtgggtgtgggcgcgccccacacccgcgcgctgggttgctcgcctccccccccccccccgtcggggaggatgtgcgccctctgtcgtgcgtcgtcgccgtctctctttcgctcctgctgactgcccccgccagaagacgccgcgcgccccccccgcgccccctcttttttttgctctgctggagacgacccccccccccctccctccttcacacctccttgttgcggtgtgttgggtgcgcccccccctgtgggggggctgtgttcgttagaggggggggggggggggcccagggttcccccccccccccccccggaaaaagttggggttttcctca

SEQ ID NO: 706496 - DNA, 307 bp, Homo sapiens
ctggcgtccatgcaaagctggagtacgtgtatcactaagtacttcaaaaaatagaagggtctccttgagagcaaatctgtatagacgtcaggatgagtaagacagtatgaaataatgagatacactagagtagaaattaggaagtgacatactgatgagttctgggatagtgtaaagggtgaggggtacagatcttcccttaagacctggcaggaaaggagagactcggaaccaggagtggcagggccacccaggctggaggaggtgggtctgctcagtcctatgcagcgcaggctcagagcaccac

SEQ ID NO: 706497 - DNA, 110 bp, Homo sapiens
cagggggatcgcttgagtctgggagttcaagaccagcctgggcaacattgtgagacccaaactaaaaaaattagcttggcatggtgagagtgtgcctcgtcgtcccagac

SEQ ID NO: 706498 - DNA, 247 bp, Homo sapiens
ttccagagtgctagggttacaggtgtgagccactgcgtcgcttgtccccatgtttgaaatgaactgtgctaagataacgttttagatttatagaatagttgcaaagattaatagagctcctgtatactccacatctagtttctttttttttaccttaagttttgaaatggaggcttgctctgtcgcccaggctggagtgcaatggtgcgatcttggcccaccgcgccctgtcatataaatgcacatt

SEQ ID NO: 706499 - DNA, 926 bp, Homo sapiens
  misc_feature (19)..(19): n is a, c, g, or t
  misc_feature (92)..(92): n is a, c, g, or t
  misc_feature (105)..(105): n is a, c, g, or t
  misc_feature (114)..(114): n is a, c, g, or t
  misc_feature (126)..(126): n is a, c, g, or t
  misc_feature (158)..(158): n is a, c, g, or t
  misc_feature (162)..(162): n is a, c, g, or t
  misc_feature (180)..(180): n is a, c, g, or t
  misc_feature (217)..(217): n is a, c, g, or t
  misc_feature (226)..(226): n is a, c, g, or t
  misc_feature (243)..(243): n is a, c, g, or t
  misc_feature (247)..(247): n is a, c, g, or t
  misc_feature (298)..(298): n is a, c, g, or t
  misc_feature (319)..(319): n is a, c, g, or t
  misc_feature (346)..(346): n is a, c, g, or t
  misc_feature (364)..(364): n is a, c, g, or t
  misc_feature (378)..(378): n is a, c, g, or t
  misc_feature (400)..(400): n is a, c, g, or t
  misc_feature (402)..(402): n is a, c, g, or t
  misc_feature (436)..(436): n is a, c, g, or t
  misc_feature (464)..(464): n is a, c, g, or t
  misc_feature (467)..(467): n is a, c, g, or t
  misc_feature (496)..(496): n is a, c, g, or t
  misc_feature (501)..(501): n is a, c, g, or t
  misc_feature (506)..(506): n is a, c, g, or t
  misc_feature (563)..(563): n is a, c, g, or t
  misc_feature (566)..(566): n is a, c, g, or t
  misc_feature (578)..(578): n is a, c, g, or t
  misc_feature (587)..(587): n is a, c, g, or t
  misc_feature (595)..(595): n is a, c, g, or t
  misc_feature (606)..(606): n is a, c, g, or t
  misc_feature (611)..(612): n is a, c, g, or t
  misc_feature (616)..(616): n is a, c, g, or t
  misc_feature (628)..(628): n is a, c, g, or t
  misc_feature (646)..(646): n is a, c, g, or t
  misc_feature (648)..(648): n is a, c, g, or t
  misc_feature (659)..(660): n is a, c, g, or t
  misc_feature (670)..(670): n is a, c, g, or t
  misc_feature (701)..(701): n is a, c, g, or t
  misc_feature (707)..(707): n is a, c, g, or t
  misc_feature (710)..(710): n is a, c, g, or t
  misc_feature (722)..(722): n is a, c, g, or t
  misc_feature (743)..(743): n is a, c, g, or t
  misc_feature (763)..(763): n is a, c, g, or t
  misc_feature (773)..(773): n is a, c, g, or t
  misc_feature (775)..(775): n is a, c, g, or t
  misc_feature (814)..(814): n is a, c, g, or t
  misc_feature (825)..(825): n is a, c, g, or t
  misc_feature (905)..(905): n is a, c, g, or t
gttagttgtgatgaaagantggtgtccattgagagccctttcaacctgctgagcaggctgggcagaaaggagcaggacttgggacagacgantgaagatgcaganaccccatgnaccccacccctngaccttcctcccatgtggttgcagagccatcntctntgttcactgctgggttgnttcctggttaaagggccagaaggtgaaggagatgggnttttcaggnatcaaaatgaggttgantgtngtgcccacatcgctgaggtgttggatttcaactctgaagttctccagcatnttgatgaggaagatggtcatntctagctcagccatccgccgtcccccnccctgccgcacaccccanccaaagcccaagtnccggaagtaggtgttgttcttntntttgttcaaccatagggttgggttattttttttngggttgttgattgaagagtgggattttngcncagagcatagttggtcacttgttccagtnttttngttgnttttttgtttttttgaagaaccatgttttttttttgttttttttgttgggttttggnganggggtgaagtcntagtgtcancatggggnaggcttttttntgggnnacanatgtaaaaacgnggccatgtctccctgggncnggagccgcgcnncaaagacctntgcccgcagcatatcctgcaccttcaggtancatganatntcatacaagtgncactgcagggtcatggacgtngtgtccacccctcctgacancatctctgtnangttggccttgatgtcctcgaaggacatcttgctgtctcncaggagtctgnagaggatgccaaggtaatcgtggtagaaaaatccttttctgtctcaattcccagtagaagttctagggtgtatatgtcanatataaaaaaaaacaaatcca

SEQ ID NO: 706500 - DNA, 300 bp, Homo sapiens
gctacctgtacacctttagaccagattgcgctctgaggctgagaagcagcgaactcaggagcgggcgcagcccattcacgctgaaactcctcctcggacactgccttctcagcagcagcctgctcttctttttcaatctctgtcaggacctctgtagatgtacagatcacacatgacctaccatgtgcgttcacgggacatggtgccacgcatgcgcagaacttcccgagccaacatccaccacatcaaacccactgagtgagctcccttgttgttgcatgagatggctgtgtccacata

SEQ ID NO: 706501 - DNA, 219 bp, Homo sapiens
  misc_feature (20)..(20): n is a, c, g, or t
  misc_feature (29)..(29): n is a, c, g, or t
  misc_feature (45)..(45): n is a, c, g, or t
  misc_feature (67)..(67): n is a, c, g, or t
  misc_feature (105)..(105): n is a, c, g, or t
  misc_feature (158)..(158): n is a, c, g, or t
  misc_feature (206)..(206): n is a, c, g, or t
cccgcctcggcctcccagantgctgggantacaggcgtgagccancgtgcccggccccctcctctcnttttatctctctgctctttagttagctggcctcatgantcccatttttattttgtttaccttttatgttaaagaaatttttgcccaggctnccctttaggcagggaggagaacttccccctacctcttctttcaaagcnacaacatcaaaaa

SEQ ID NO: 706502 - DNA, 447 bp, Homo sapiens
taccctagcaccaggacatccctgcgaagcggagctctgcagatgccgcagtggcagctgtgggggaccccggggcccctccacaccacagggccaggtctcctgaggtatcattagattttctgaattagactaaaatatttcctaaggagttacgcttctcctttctttgcctttcctaccatagggagaatatttgactatccgatccacgctcccttgccactccaaatctgttagaaaggtaagtcagaattgagccctttcatagtggctcacatctataatcctaggggctatgggaggctgaggcttgagccttggttgaacccgggttcgaaagtagacgcagccatataggcgagatctcgtccctatttcaaatatgaagagaaacctcaggaagccttgccccttatggtatggacccccgggttccccacttgg

SEQ ID NO: 706503 - DNA, 335 bp, Homo sapiens
ggcatggggtctgtatgtccgtgtctattctgcatgtctgtgtctgtacatctgtgcatgtgtatgtgtagtgttgtaaaatacctaagttggaagaactgaatcaggaaaatctgcaagggccccagaatgagcggacaccgtatggccacagtgtgtctatggctggcatacccacaggcagaaggcagaccagtgtgcatgcccccagcattgttctttccccgaactcctctgctgagcataatggggcgttctggcccaagccccagacagtgacctgaagtctcctcccgactcctccagacccttgtcctgcccttctcacacctact

SEQ ID NO: 706504 - DNA, 143 bp, Homo sapiens
tacattcaaataaaacataatccagaagcaaggaaacccaagaggcattttctgccactataaaagtgcctggatgctcaacaagcaagccacaggacaaggcgcaaacaacgttcgcaaaaacgaaatatttgtgcatcact

SEQ ID NO: 706505 - DNA, 163 bp, Homo sapiens
tcacacgaactggaaataaaatccactgatgggaaccagaaactcagagacataagaaggaacagttatcttgtcagatgcgctttatggcatcttgattggcctcactcagggtctttgaagcccaaggtctgttgtagggatccagtgtacttgtcatggt

SEQ ID NO: 706506 - DNA, 332 bp, Homo sapiens
  misc_feature (4)..(4): n is a, c, g, or t
gctncgacctgacccaaaaataagtataaagtaaaatcagttaaggccaggcacggcgtctcacacctgtaatcctggcactttcggaggccgaggcaggcagatcatgagtcaggaaattgagaccatcctcgccaacatggtgaaaccccgtctctactaaaaatataaaaattagccgggcatggtggcgcgtgcctgtagtcccagctacacaggaggctgaggcaggagaatggcgtgaacccgggaggcggacgttgcagtgagtcgagatcgcgccactgcactccagcctgggcgacagagcgaaactccgtctcaaaaaaaaa

SEQ ID NO: 706507 - DNA, 746 bp, Homo sapiens
gacactttgtcaccaactgctgccaactcgccaccactgctgccgacctcgcaaccactgcttgtgtctctgaagcagaactgggcttgacctcctcggctcaagtgatcctcccacctcggctcggaactacaggtgagactgctcctggtgccatgaacggagacgacacctttgcaaagagacccaggatgatgctaaagcatcagagaagagaagcaaggcctttgatgatattgccacatacttctctaagaaagagtggaaaaagatgaaatactcggagaaaatcagctatgtgtatatgaagagaaacctataaggccatgacctaaactaggtttcaaagtcaccctcccacctttcatgtgtaataaacaggccacagacttccagggaatgatttgataatgaccataaccgcaggattcaggttgaacatcctcagatgacttgcggcaggctccacagaatcatcccgaagatcatgcgcaagaaagcagcagaggaccgaaaatgattcgaaggcgagtgtcagaagcatctggcccacaaaaacgatgggaacaactgcacgcccaggaaaagcaaatatttctgagaggattactacgagatctggcccaaaggggcaactgctggacccacagacgggtgagaagaagccgcggcgattctggacagaccgggacccgggaaattgcaagacccccggggtaccaccatgcctgttaagcaaacggggc

SEQ ID NO: 706508 - DNA, 329 bp, Homo sapiens
aactcaggtgcgagctcgggaggagcggctacggcatgtacgctggagaacaaggccaagaagcctgcactggtggccatgtcctccatcctgctggatgtctagccttgggatgatgagacggacatggcccagcttgaggcctgtgtgcgctctatccagctggacggtctggtctggggggcttccaagctggtgcccgtgcggctacggtttccggaagctacagatttcagtgtgtggtggaggacgacaaggtggggacagacttgctggacggacggagatcaccaggtttgaggagcacgtgcagagtgtccatatcgcag

SEQ ID NO: 706509 - DNA, 970 bp, Homo sapiens
ccagaggatcgtgcctggataatagaggatgtgtttcagccctgctcatgttacagttgaagagcttaggagctcaatcgagcatgactctattggccagttagtccccgaaattgctatgtattatatagtctgggggagaagtgaggtgtgcccagtttatggttaatctaacaactactggtggggacattgcccacagtctcgtgggattggaatggggatagtatcccattttactgtcttttaggtttacatatgttaccacgtttctcttctctgctccccttgcccactggggactccgtcttggctccttgaagttagtgcttagagttggcagtgcagcaggcaggtgatcatgctgctaagttctttctggacctctggcaaagggagtggtcagtgagaggccatcgttgccttgggatctgccaggctggggtgttagtcggtatctgctgtacacagctctccactgtgaatccgaatacttagccagtgcacgtaatctcttggagataaaattcattgaggtgttactaaatgttaatttgtctttgcggaggcatacagtaccggtccgtgaattaattagttcatattgagcaatacttcattccttaatcgtccctcatttgtttggccacagctattcagtccttggtcggaaggattctgccagactgtgtctcacccactactgagatgtcagcctgatgttttggattgaatgctccggggtagccgtctgaatggggtgcacgcacgctttatgctacacaagtgggtgtggggctgggtggatcgaggaaaccccatacggttaagatccaaacgtcgtatccttgtaagaagcggggaaccgggcgctaaatggcccaaacgcgggggcaaaccgggtggggagaacagacaaatggaaaaacaggggacgcgacaaaaaaagacagaacaccgagacatatac

SEQ ID NO: 706510 - DNA, 497 bp, Homo sapiens
gcgtcgactttgctttgcctgtcaggtcgttgtgctgccatcaaaagtgaaacgccactcccgtggttacgttgaacgcatcccccacatagaagttggccgagtcctggcccttggcgtcgtacgcggtgttggtggccgtgcgtacgtcttgttggtcaggttgcgcgcatcgacaaacacctcccacttcttgctcggggcctcgtagcccaccttggccccccacaaggtataggacggcgcactcagggagttggcaaaatccacgtaatagctggacgccgaccgggcattgacctgcgcgtagaaaccgctgccctggcgatactccagctccgcctggtagacctgacgcggcaagccggcaactggttgttgccgaacacaccatcattgcggtagtggaagttgttgaaggtgtaagcctggcgcaacgtacaggtgtcgccattggcgccgtccaaagttgcgattcaagcggcctcgatgcctgg

SEQ ID NO: 706511 - DNA, 264 bp, Homo sapiens
catttcactaaaagtctccaaaacatttctaagactactaaggccttttatgtaatttctttaaatgtgtatttcttaagaattcaaatttttatacaaatagttttattacaaatttgaattcttaagaaatacacatttgtaataaaactatttgtataaaaattaagcttttattaatttgttgctagtattgccacagacgcattaaaagaaacttactgcacaagctgctaataaatttgtaagctttgcataccttaa

SEQ ID NO: 706512 - DNA, 852 bp, Homo sapiens
gcgagaacaagatgtacctgactcccagtgagaaacatatgctcctcaaggtgatgggcttcggcctctacctaatggatggaaatgtcagtgacatttacaaactgggatgccaagaagagaattaatcttacccaaaagttgatacagtgtctttaagcgagcgtgcaggatggctgccaccgttgttgcggacgactcagtagcaggataggagactcgcgccaggataccattaagagccagtgcttcacgtatggaagagaacagagtccaagtggacgtgcagcccatgagcagcatcagcccccaagtacaatatctgcgagcagattggttcagatccgggatgaccacatccgcttcatctccgagctcgctcgctacagcaacatgtgaggtggtgacgggctcagggctggacagccagaaagtcagacgaggagtatcgcgagctcttcgacctaccctgcggggtctgcagcttctatccaagtggagcgcccacgtcatggaggtgtactcttggaagctggttcatcccacagacaagttctgcgaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcatttgcaggacttcgcccaggtgacgctgcgtgagccctgcggcaggcggtacggaagaagaagaatgtcctcatcaggtcctacaggcaattcgaaagaccatctgtgactggag

SEQ ID NO: 706513 - DNA, 389 bp, Homo sapiens
tgtaccgtaggatgcctgtactggcacttgttttagcgatctctctctactagacttcgtattacagctacacgtactacgcttgtggctctcttccactatctcctatcatttggagctgtatttgccatctttggacgcttcattctctgatttcccctattctcaggctacagtcctataccagagcctacgccagaaaatctcagtttcactatcattattcatcgcccttaattactacttttttcccatccatcatttttctcagcttattccaggaattgcccccaacgttactacggactacccctaatgcaattctccacattgaaacattcgtatcattctgtaggctctcttcactttctcctacagcccctttttgt

SEQ ID NO: 706514 - DNA, 1119 bp, Homo sapiens
gatattagcagcggttatccggtgagcggtggtggtctctcattcttgcgtggagttaagggctccgatggacatctcaaggtcttcgagggctcgtccatctggagactatataaaatgttcgagaacaacatgtctcgaagatagtgactccaggacctactatgattgttctcgcagaaggtcagcgttgatgaccgaagtgagaactactgccactggaaaggtctactgtggatcactgcaggtcgcccgtgctagtgggaacttgtgtagcaacatgacgtaggctggtgtcttgctctgcagccacgaagagactgacataggcatccatacaaggtgctcctttgaatgatagatcctgtcttgttatcctgataaaacatttctataagactactaaatgtagggaccacttgtgtctttgaccaggctgtgggaaaaggccaatacactgtactggaatgctagactggttgctgagctacattggacaactaacgggctcatctggctgcaaagggtattaaagttactagctaatcccaggatgctcgagatagcctttgtggacgccagtttggttgacgagacgcgtcgtgtcgagatcgaaagcaagctgtataacacgaatttgggagggaaaagcggtcccttttggggtgccagtagcgtgtagcatgggctggggattaatgcacttatggcttttcagctcctatcagagtgacccctaagtggaacacttcaccggggggatggacagtggccacagtgcattgggacaatgaattagcggctggcaaagctggtggttcaaacggtccgaaaacacctggactcataaaggacggagaaatggaccttgaaagttcagcacttggctcttaagtatccaacagttcacttagataaagaggccagggaatgcccaggtaaaactcgtctgcgtgaacaaaggggggaatcgcgagaactgaaccaggaggaagcacgggaacggaccggcacatccggaggtccgcgaaacaaagagaaaggggagccactggatcacaagacaggagaggggaaaaagaagcacaagggcggcgggagaaggacggaccaggcacg

SEQ ID NO: 706515 - DNA, 386 bp, Homo sapiens
accggctgttgcggtcatctcagccacgggcctcttcttgtgtggcttctgttgctcccttgaagcaggccacagcgggcaacctatgcacttagtagcgtgtctgggagctgggctccgtggagcggccgtgcaggatgcaggccccggtgagcacatcatcccccatacaacctgatgctgagcctgtgtcctacatgactgatcccgtgagagtgcaggggcctccccttcttcctgaaggacttgggcccttgcgcgtggcaagcttgagaaaatcacaaccctggggggcttcttgggacgggacatggactcccagggccccacatccttccaagggtgagtctttcttgccaggccagaaccctggcgggggactcccg

SEQ ID NO: 706516 - DNA, 182 bp, Homo sapiens
cggtaccgacagcatagaatgtgctgatatgagtagtgtagatttggatattagtccttgtcagatgtatgatgtgaagattttctcccactcggggctgtctgtttactctactgacgttcctttgccggcaaaagctctttgtttaattaagtcccaactatttatccttgtttttattg

SEQ ID NO: 706517 - DNA, 119 bp, Homo sapiens
tcccccccccccttgggggcggaaacccccggcccctttggggttgtttcccctcttccccccgggttggcggcgcccccctcccctttgttttaaaccttcccacccctttccggaga

SEQ ID NO: 706518 - DNA, 121 bp, Homo sapiens
cagctcggacccttcctgcgtgcttccgcatgtcggctagccattcttctgctgctgctcccagttgagctctgtgcttgcggaaaccttcttttccacctccaccacctagaactctgcg

SEQ ID NO: 706519 - DNA, 147 bp, Homo sapiens
ggggagagatgacacatggtaaccagagcataatgtagcgaaggactaaacccgtatagccttcggcataatgagagttaacgtagaaagtaacgttggcaaggagaaccaaggcgtaagacccccgtaagccagacgagctaccta

SEQ ID NO: 706520 - DNA, 117 bp, Homo sapiens
tccccaatatataggaattaatttaaccaaataagtgaaagatctctacagagaaaatcacatatcactgttaaagaaactgacgaggatatattaaaggagaaagcgcattccatg

SEQ ID NO: 706521 - DNA, 236 bp, Homo sapiens
acgaagatccccggaaacctgtggctacaaaaaaagtttagccccaaatgccctcggaaatggggaagggggactctaagtactcttaggcttttgggagggggaaatatagaccccctaaaattgtgttaaacacagcttgaattatttgggttcgggggtgttctattaaactatggggagctcaggggattgatactcctgatgcgagaaatacaatgtgtttaggagtggga

SEQ ID NO: 706522 - DNA, 168 bp, Homo sapiens
caaaaccgggcttcttcctgcgcactccacccctgatggtctgagcttgacgcggctcacggagaccgcgcgaccctcagatcaagctacaacttcaagcagaagcgagaggcgttgtgtctatcaaaggcgtgtgtgctacactgttacctggctatgacaggcaag

SEQ ID NO: 706523 - DNA, 235 bp, Homo sapiens
ctttgagcagtgagtcagtcagagttcaagccagcctggccacatgctaacctacctctactaaaatcaaaaattagctggcatggtgcacatgcctgtaatcccagctacttgggaggctgaggcaggagaatcgcttgaacccgggaggcggaggttgcagtgagccaagacagtgccagtgcactccagcctcggtgacaggcaaggctccgtctcataattaaaaaaaaaa

SEQ ID NO: 706524 - DNA, 658 bp, Homo sapiens
taggtgaaaaagccagctgacttaatggctcggggggcagggggctcaggagctctgtgggggggcgggtccgattcctcttcaccatcacaggcttctggctgcccaggagtggcgctggccctggggaatgggctgccattgcgcaggtcgggggcggactgggttctgggcggatcagggtgtctgagtgctgctgagcgtggcgcagagcattctgtgtgagtgggggctccgcacattaggaggggtgcagagcttccgcgtggcgcgagatctcccgcttaatgtgaccacacaggaacactcttgtggccgatcggtgtgccggctccagcgcccacagtctttggcgggagaatcaggtcccgttgtacgcggagaggaattgggcgggccttcagagttattggggctcaagtgctgatagagtctgcttattcctctgtgatcagcgaaactgtgagcagttccgacagcgacgcatccattggcgagatgcgcagaacagtgggggggagctcccttcgacagggggagaccgtgaaccttcagaggcctgcggctcccagggccagggcggccgctccagggaagtcctcccgtgggggggaacactgggaacgatgacacggggcggaagcaagagtctggggga

SEQ ID NO: 706525 - DNA, 378 bp, Homo sapiens
accgcctactcaagcttcagtaatggtggacgcttctcctgccacaaagctccaacgtcccaggtcgaccccagactgctgtgctcgcggtgccactggggtatgaaaaaaactcctgcagctagcaggaccagatgtattcacagctgaattctaccagaggtacaaagaggagccggtactgttccttctgaaactatttcaaacaatagaaaaaaagggactcctccctaatgcattttatgaggccagcatcatcctgataccaaaacctggcagagacacaaaaaaaaagaaaacttcaagccaatgtccctgataaatattgatgcgaaaatcctcaataaaatactggcacactaaatccagcagcacatc

SEQ ID NO: 706526 - DNA, 108 bp, Homo sapiens
atagtctgttgtttgcctatctcgaatactgaaagaccacaatgcgaccctgcttgttgctctgcctcttcagtgatacaccattgctgtgcccacaatgaagtaagt

SEQ ID NO: 706527 - DNA, 236 bp, Homo sapiens
cctggagcaggggggccctggccacccccccccttgtcacacaatgtgtggcagcctgtgtccccaaatatttgtcagtcctcgacagggagcctgggctccgtcctgctttaaggaggctttggcaggaggtcctctctccccatccctccatttgggggtcccccaacctttgcacagctctccaggtggttagatataatgccccagcccaataaaccttttttcaggcctga

SEQ ID NO: 706528 - DNA, 377 bp, Homo sapiens
cgggccagctacggatgtggagatcgccacctaccgcagctgctggagggcgaggagtgcaggctgaatggcgaaggcgttgagacaagtcaacgtctctgtagtacagtccaccatctccagtggctatcgcggtgccagcggtgtcggccgtggcttaggcctgggtggaggaagcagctactcctatcgcagtggtcttggcattggaggtggcttcccttccagcagtggcagagccatcgggggtggcctcagctctgttggaggcggctgttccgctcatcaagtacaccaccatctcctcctccagcaggaagagctactagcaccatcgtgctgcctccagctctcggtcccacatccgtactggtccg

SEQ ID NO: 706529 - DNA, 382 bp, Homo sapiens
tcacgtatatgtactactacagaaacactaggaaatctccagacacggtctggcaaacattcttgagtcataccccacaagcacaggcacccaagccaaaatggccaatgggattcccttcaggttacaaagctttctgcacagctgggcacgggtggctcacgccctgtaatccccagcactttagggagacagagctgggcagattacctgaagtccaggagtttgagaaccagcttgaccacattgtgaaaccccatttttactaaaaatacaaaattagccaggcatggtggcacatgcctgtaatcacagctactcaggaggctgaggcaggaaaattgtttgaacctgggaggcggaggttgcggtgagctgagat

SEQ ID NO: 706530 - DNA, 345 bp, Homo sapiens
tcggcatggagcagcgaggttgggccgaccacggtcatcaccgcgcgacttgcccgaccgcatgaacaccggcgccgacaacgcatccacgccgggcatcagcaggccatgtacaaagtgcaggccgcggctgcggatttgctcgcacacgctggcataggcctgatcgtccgccaaggtgtgagcggtgccggcttgaacctcgcgttcgcgcagctccacggtttcccgcgacggcaagtaggcgctgaacaccagcccggtggacgaactgagcagcggcaacaccgagcccaactgcgtcaccacggtgacggcgcgcactgccggctcaatctacaccag

SEQ ID NO: 706531 - DNA, 605 bp, Homo sapiens
ggtccagcagttgggaggtgtcatggaagaggctgaagtagtggacgacgtcgtcgtcgaggatgttcacataccttgacgagccgacctcgtccagccatgggaggtgtcatggaagatgctgaagttgtggcaccgatcttctcttgcatgatcaagattcagtcttgcttcaggttgacgcagaatataagccctgtgtgtcacttatagacagtgaaaacccacggtctccgatctatcattaatcaggcaaaacctggtactgccctgctatgtaaagtaacccttttaaagcttacctggtttggaagaaagtggtacattttatccaggtatagaaaaaaaagatcctatttctgggccatcttattcaagaaaattgtccagtggggggtagggggaataaatagtggcacgactaatctaataagaggctgtcccagtcgtgggttagactctcctacaatgaaagtcagttcccagtagggacttgaagctgacccttcatgcttccatggcattgcagaatggtcaaccattcccggttgcccttaaaaatgccaaagcgtaggcgggacctgatgctgcagtgctgagaaagc

SEQ ID NO: 706532 - DNA, 423 bp, Homo sapiens
  misc_feature (423)..(423): n is a, c, g, or t
cgctctagagtatccccacgcctgtaatcccaacacttcgggaggccaaggccggaggatcatttaagcccaggagttccagaccagcttgggcaacatacccagctactcaggaggctgaggcgggaggactgcccaagcccaggatgttgaggctgcagtgagccaagatcatgccatcgtacatgcctaggggacacagtgagaccagtttccaaaaaaaaaaaaaaagggaacctttttggggggccccttggaaaacatttaaaaaaacggcccatactggggtgggggggggggttcaacccttgtcctccaagcattttgggggcccggggcggcaaaataaggagttcaggggttgggccccccccggaaccgggcctgaaattcgaaaaaatggcaatggctgtttcttgaaan

SEQ ID NO: 706533 - DNA, 942 bp, Homo sapiens
ggctagaacaggcgtcgggtgcgcggtgtcactctacctataccgtgaacgtcgttcctgggctcgttgtcctacggtaacgcctcctgggtcgatgtaccctatatgcattctggaattactcatgccttcaatcacgcttcggggagctatctcgaattgcgatcgtaatacattatagatcgcaggatggtaggtaaccatgggcgctacaatcaactgtgttgctatctatacagaccattcgtagcagaagatcgggtgtctggttgactcccggacgcatgatgacccagtatcctctaccaaatgtgaatgcagcaaatattacccaccaggtcattcagtggtgccacccaccacaaaggatgaaccctcctcctcctgaagatgactgcgaacaagagaaaagcgaaccagatgatatccctgtttgggaccaagcattcctgaagagtggaccacaggaacaacttttgtgaaactcattctggctgcaaactaccttagacatcaaaggtttgcttgatgttacatgcaagactgttgccacttatgatcacaggggaaaactcctgaggagattcgcacgacctttcaattatcccaaacattgacttttaccttgaaagaaggaggaacagcccaggtactgcaaacggagaaccaggtgtgtgcagagaaagtgcacttggttgtggcctggacacttgtacacactgttacgtgatgctccaaaatactaggttgcacctgctctggttaataaatggtcactattcagaccaccgtagcacaaatgccgctcacagtccagtgtttaagccagcacattggcctcactgcgttggttgtcggcaagatcccaacttacgccaggttttcactagacggcagcttctccggcccgcatacagacggggctcacaggggcgggcccct

SEQ ID NO: 706534 - DNA, 122 bp, Homo sapiens
  misc_feature (21)..(21): n is a, c, g, or t
  misc_feature (87)..(87): n is a, c, g, or t
atactatacatatatatacgncctggttggcaagccctgctgatcagagaaagtctctgcatgtcctagtgttagtaactaattttnatatagttaatgtaggataaagtagagtgcattaa

SEQ ID NO: 706535 - DNA, 402 bp, Homo sapiens
cccgactagcccgacagggtgtgaccccccacctcctcctgggcggggtggctgccgggcggagacgctcctcacttcccagatggggtggcagccgggtggaggggctcctcacttctcagatggggcggttgccaggcggagggtctcctcacttctcagatggggcggccgggcagagacgctcctcacctcccagacggggtcgtggccgggccgaggtgctcctcacatcccagacggggcggcggggcagaggcgctccccagatctcagacgatgggcagccgggcagagatgctcctcacttcctagatgggatggcggccgggcagagaccctcctcactttccagactgtgcagccaggcagaggggctcctcactgtcgggctagtcgggg

SEQ ID NO: 706536 - DNA, 380 bp, Homo sapiens
actatgtgatggtccatcgtctcagagccttactcccaaagtaccggctcagcgttccgtgtagaacaactgccggtgtttcctctcttcatcggtttccatgagtaccgcttatatttcacaactttctgttcatagagttatagtgacatagctctttggtaaaaatgcctgcttgccaatactttgattgcatattagacattcttaacagagcggcagtctagtgtagaaagttttattttgccatttttcttttaagtaaatttgttttaaaaaattctgatgtagggctaggtgtggtggctcaggcctgtaatcctggcacttggggaggccaaggtgggaagatcgcttgaggccaggagttcaagaccgag

SEQ ID NO: 706537 - DNA, 112 bp, Homo sapiens
  misc_feature (47)..(48): n is a, c, g, or t
  misc_feature (54)..(54): n is a, c, g, or t
  misc_feature (109)..(109): n is a, c, g, or t
tcctcgagatggtaagcagattacttccatcagtatgagccaggagnngagggngaagtcaccatggcagatgcttaagtcaactattttaataaatggatgaccagtngtt

SEQ ID NO: 706538 - DNA, 113 bp, Homo sapiens
ggctcaacaaattttctgtttgtcaaggaaaagtaaaagtggaatattaatccctttccgtttagttctggaaagtcaggaatttttccaaaaaattaaaaaatgggctggga

SEQ ID NO: 706539 - DNA, 130 bp, Homo sapiens
ccaagaacctgcctgcccatgtgctctctagtagctctcctaggcttggtgttcctagctcggggcccaccaaggatccataagcccattaaactacctccgaccagggaggcccaactcacgaaaaaca

SEQ ID NO: 706540 - DNA, 133 bp, Homo sapiens
tacataaattcaagaaaggagatgagtatgatgtatgtgccatttgttgggatgagtatgaagatggagacacactcagaaatcttcctgttccatgcttatcacgcaagtgtgtagaccttggttaataaaa

SEQ ID NO: 706541 - DNA, 312 bp, Homo sapiens
cacgaggaggatagcactagtccaattgttcccacatgagtagaggtgtggcctctattggcaatacatgtgtcttttgttcgattttacgtccatgacttggtttgctgtcccaactgcacagaaatgtcccttttttgtttgacttcctgaatgtgtgtgttttcctttttgcagaaaaactatctccatttaatccagaagctcttgctttatccggatgatcggaaggtacacagggcatccgcctcatttcccgtcggctgcagtatacgctgacttgggaagagtctactcctcgcccacaggaga

SEQ ID NO: 706542 - DNA, 830 bp, Homo sapiens
atctctttctgcctccctcgcgcggggggaggggctagttaaaaaacagacccgctccgtttgttggttggctgctcctgcctttctctcctgcgtgaggtacgtcgcacataccaccacccgcttgttgttggttgcctctccccatctctgagttaataccacccgcggcgtcccggatgttacctatcctcccgcgatgcttttactgcttatttcggcttcctcgcgtgcgcgcgcggtgtgatcacatttctttacacaccacgcggcgtcactcgagctctttggcttccttcgctatggtcactcattctgtatggggatggcccaccacatacatgtaacactcacgctctgggttctctccatacacagaccaccggcgtgggtggttgccgctccgccgagaattttcctcgcgaggtgttgtttctagtcgccgacgccgtctcgctgttcctgcacactgctcgtgttgtaccacttcattatctgggtggtgtctatttgttatcccctcgcccgccgcaccctcgctcgctgtttgttttgcgagtctctcctctccacccactattcgctgggcgcggacttgttcggtgtccgacccacttctttggtgtgcaccccgccgtttcccgcggctgttacactcctccttatttgggtgcacacttttctttccttctttttttttctcccccccccaaattttctctttaccccccaccacacccttgtggtttgaacccccccccccatttggcctttttttataatgggtttgtgttttttttttttttccctttttttttggggggttttta

SEQ ID NO: 706543 - DNA, 1296 bp, Homo sapiens
  misc_feature (1060)..(1060): n is a, c, g, or t
tctgggtgggggctaattatcaagaggggggggggccccccgaccaccattgtcgctcttctgtgtgggttggggaggagagaggcaccccctcttgtgctctggggggggaagactacaacgactgcgggcttggccgccgacagccagctcttgtggtaggtggttcctgctgccactgcttgttgtggggcgggatgaaagatgattaattcactcgcgcagcagcaggcgagcttgtttatataaccacaatactcacctgcctccttcgttcgtgtggttggttatcgccatcaacacttggtatcagcgacgcttcgacatcaacatgggctggtgggccccccaccgcaagacaacacgcggtgtgtttgtctctcccctccgggagagcagttgcctcacaacagcaaattagtagagcgtcaacacgacacacaacggccgcgctgtggcgagaggagcaaaaatcacggcgcggcgttctttctacggcggagaagaccactctggtgtgcaccacgaggaggcctctttggtggggcaacaacaacccgacagcgggggcgtatctctgttgttggtctaccccggggggtctctctatcctggagttgtgtgggcgcctcgcatctcttgccagtaatggtgcggagaggggtggacgacacacaacacgggttgcaactagcacgacctgcttttcttccaccgcaccacaccccctctagttggggggcgcacacacacacacacacgctcgtctccgccgtgtggagagaacttgtggtagcgactctcgacagcaacaacacacacacgtggcgcaactcgagtggggggaaacaccacgcggccactttcctcgtgcacacactgtcggtgtgagaggaagcgctctctcgcgccacacaccgcgggtgtagtccctctcctcggagacacacacgcggggtcctctgtaaccagacactcttatactgcgtttgtgagaggagataggaaggacccgcggttcacggctcctctgagagagaagagcacacatccacttccnctctaagggtgcatatcttcctcgagggcggttttctcatcgcttatgctatcttcccctggagaggagccggccctctcgagaggcaaaccactcggggcgccacaccaagcccctcgcacacatggtttcctccccggatattctagggttgtaaaaagaacgctcagatccccttattttttgcccggaaatttttgggcaccttatataatccttaaacccttttttggcca

SEQ ID NO: 706544 - DNA, 401 bp, Homo sapiens
attcaagaaggtacattcaacaaaatgaactaataaaaattccatgcaaaaactttgcttgaaaaaactataagcctcagattgtttttggtgaaatgtgctatctcttcaactgcaaattcctagtgtcagcattctaaagtaattgagttatgaaattaaattggattaagaaagaaataagtaaaataataaattcagatggcttttgatataattatttataacatgttgtaattgttatggaaatcttaatttaaaaaagaagtcttatttttgagggtcagtggtggtacctgtgttaatcttacagtgccatgtttttggaacctctcatttatgtttctcatctatcagccttatgctatatccagacttctttgatgtatccaaggacaatg

SEQ ID NO: 706545 - DNA, 125 bp, Homo sapiens
  misc_feature (29)..(29): n is a, c, g, or t
  misc_feature (120)..(120): n is a, c, g, or t
aacccatcacaaactactggggtgacaancgtgacaacctacgctacttcaagcctctgtggatcaggattggaggtgacaatcgtgacaacttcaagcctctgaggttcaggattggantgtca

SEQ ID NO: 706546 - DNA, 1055 bp, Homo sapiens
gcagatatggtgtttaggagggtagtatatgatatataggattggtgttagtgttgtggtgtgtgtgatgtgtggatgtattagtatgtgtgtggtatgtgtgtttgattgggtggtgaaagatgagtgtgtatgttgtgaggtagatgtttggttgaaaaggtgagggttgtcagtagtaatattttgtattggggtgttgctgtgatgttttaagatgatgagatggggagttgtgtttgagtgtatacggattgggggtggcacatatgtgtgtgatacgaattatgattggagaggtgtgagtggagtatttgatgatgtagttgaaagtgggagtgaggtcagttgtttgtgaggggtaggggatggttgaatttgtgggtgagatatggtgggtaggtgggtttggtcggcatagtttgtgtttttgttgagcgtcagttcttgtgtatatgggtggtgtgtgagtttggttggggtgcgatgtactctcttgactgtgtcttgggtgatggttgctacgaatgccaactgacctaagcgctggtgttctcagccccaatagtgcgcaaaaaaagattctcaatatgggggtcgcacagtgtgtcaccacgcatataggatgggcgacacaaaatagccacacccccagaaggggtatgaatgctcttgtgttcacagaatataggtcaataaggctcacaggtggagaggcacattgttgtgtggggagaacaccaagagatagcgggggtgcttcaacccctcccgcacaaggtccctgtgtcttgtgtgcacagacgaaagcggcgggcttctggaagaaagagttgagccttaaagttcacttgagcacccaccctccacaagtttggccacatggccggtttccacgagccactggaaggaagaaagaaaagcacatttcaatgggaaccacctgaaagaaagaacccgatattgccaaaggaagaaaagagactttaataagcccaggacaccagaatatttgccacattggtggggtctccaataaaaaagtattttccccg

SEQ ID NO: 706547 - DNA, 225 bp, Homo sapiens
tagatcatacttagatattactaagagtgctcaagcagatagctagatggagcgcttatggtacaaataatctcccttctaccccagttttgacactgttgagaagttataaaggactgttaaattctttaagactactttcaaaaaacgactaccgaactgacagacgtaattctgctggacaccgactagggccgctttcccgtctgcaaagtaactaatcta

SEQ ID NO: 706548 - DNA, 750 bp, Homo sapiens
cccgcttacctaaccgcggaccataattggcaaacaaaaaacaaaggggccctcaacatggggtcccggaccagacaagaaccacacgaagcatcgggggagtgacgccccacccccgtcggggttcgcgaggggtgcaccctcccagactacaacatatgaccgatcgcgccgcaagtgcggtgcccccggcgactgcaacatgtgtcggcgtcaacgcccagccgccaaggggggactacctccccaccccttggggggcaccacatcattctagggcgcaaccttcttcgccagtccacctcccggcttttcaagcccgcccacaaatgccccgaacgtggcccttgcccccgcctcccttacggggagaccacccccccggggggtgccccctgtagctagaacacgaaaacgccgctatcgtgggcaaaaaaggcccctcacctccacgggatgctcctgcgagaaacttccccgccctgcaggcctccacgccctggttcaatatcttcccgcggacaagcaattggggccgccaggaggcgctccgtctcgatggatcccacgacgccactcatggagcaatctgtgactcgtattacccacggggcgttgttcgcacgcaattaagaccgtggggccgtccaccggggtcatcccagtgcgagcgtcatcataaccgatgattgctgctttgttagaaaaacaccctggctttctgctgtaatgcgggcacaaaaaaaaaca

SEQ ID NO: 706549 - DNA, 512 bp, Homo sapiens
ctatatgttccattatagcctatgtttttctgattcttcgatctgcccattgcgcataatgctgtctccccccgtggcaggcctcctagggagatggcaccccggatgtcccttccacccccgctctccgtcctctgtagcgctcgttctccacgcccgctacgactcgtatgtttggcctccatggggcctcgcgatgtcttagagagtgacctcccaggaacacggtacctaacttttacgcacccaacactcattatagcctcccacttcaacccctctctttatccccactgctttctctcgcataccctcttgaccttattatcgcctccccactcgtcacctacattccacccacactattgctaaacaacttataacataaactactaccctcttctcctaaacaacaccatccctcccccccctcttttcgctcccaccagtttgcccctacgagagtgcttacctttattcccctttagtattagataacccgacataaagac

SEQ ID NO: 706550 - DNA, 148 bp, Homo sapiens
tagtacacccaggagacaggcacccactgtggagaactgcacgcttggtcaataggcttcttgtaataaacttaatgggttacatcaacaccattattgaccagtgagaggtcatagtagtgagcgtactgtctgcggatggcctcag

SEQ ID NO: 706551 - DNA, 257 bp, Homo sapiens
ccatctcagcctcccgagtagctgggattacacatgtgagccactgtgcccagcccagtgattgagactcgactggacatgaagcagtataatgtagcagtataacatagtattctggaagcagactaccgggggttgcatttcggctccatcactttctaaggtgtacttgaacaagtggcttaacctctcagtgttttcacgtactctcacatacatctagggattcaataagttaatgcatgataggagggggg

SEQ ID NO: 706552 - DNA, 172 bp, Homo sapiens
gttggactacgaggatgctacttcccctatcatagaagagcttatcaccttacagtgatcacgcttctcatgatcattttccttatctgctatcctagtcctgtatgccgctatatcctacacactgcacgaatatagactaactaaatactatacatctcaggacgctcag

SEQ ID NO: 706553 - DNA, 143 bp, Homo sapiens
  misc_feature (12)..(12): n is a, c, g, or t
ttgaaaaattangaaaaatgtgtactttgttctagagtgatgatggttgtacaactgtgaatattgtaacaaatcactgaatggtacactttaaagggtgattttatggtatttgaattatatttcaataaaataattatttt

SEQ ID NO: 706554 - DNA, 501 bp, Homo sapiens
gaaaacattcagtaaaatattattctgcagtaacttgtggaatgactgctgtacacacagctctgggctgggtacctggaagctcacgagcttgtttggcctcccctcctggacacaggaggtgtcaaggctgtggtcagcagaatctacccagctggacactgagtggacgccctgtggggtggctgtgaaatgggtccactttgtagtggcagcatccctgatagtacttctgaaagggacaagatagaaaagcaaaccaaactgaaactgagaagtcgtggatgataccaggggcgcacagtggctgacaggaagagactgcctggggggactcggagccagtggctggagtggagttagtttgaccgagtcctggactagggaggggacccccaaagcatgcccagcatggcgctagtggggcccaggcaccccatgtcccaacgactagaaccaataatcaggttaacactcattaaataagaagtgtctgtgaaa

SEQ ID NO: 706555 - DNA, 358 bp, Homo sapiens
cccgtctcgtgagactgtatgttgacatcagcattagttcctaaaaagataaactgctaaatatcactctatcattgaataacaaaaatgatacttgataatcctgtacctgaaactctgctcagagttgggagcatagcatttaggtggcagccatggaaaacaaagccagagaagaaagcagactttctgccctgcctgccctgtgttgaacattccccaggacaaaaaatccacaagccagtaaatgggagcagaaaagtgggaaatgtggatcaacatctccaaaattatcccatgtcgaatctacttatagttcaaaccgctgaccagcttcctgcaatgtgctgttctgtgg

SEQ ID NO: 706556 - DNA, 153 bp, Homo sapiens
tgaggttagaggatccccgtaggtttttgaagttgatagcaggcatgtgtggactgtttgagagcaatggcacaaaggggatgtactcccttttcataaagtcatcagagaaccaggggtatgaagtcttccagagaaatgcaaaatatagat

SEQ ID NO: 706557 - DNA, 1288 bp, Homo sapiens
ggatatttttgatgactgtattgtaaatactacagggatagcactatagtattgtagtcatgagacttaacagtggcaaatcaagcactcataatttgcaccaaaagcatgcccattaacaattattcagcactgtagcagccaccatttacacatacctccaggctcaattactgttaattttggggttgcaacttattatttttgaccagtgcaagggtggcattcattggcattgtccattagcaggcacaggtctagcatttcctgctcttcaatcaaacattacattgcacattgattcttctcagcaggtcacatgcaaacactttcactttactgcagcacagttcagtgtcccaacggtcctatgcgcacaatgtgcaacgacatggtcaatgtaggtagcctatcaccatttcacttcgtcccctgaaggaaatcttgaacaacatgttcacgtcacctggtaacagtccacttgtacagccaacagttaattagaatacagacttagtacgaatccatgacaaatgtcagtccaaccaagttgacattttcccctaattggctctcgtgtacttcacaggcagcaaccatacactgtgccctactacaataagcaacacagccaagtaacagaccacgagagaacatgccacacgcccgacaacgtgcgcccagaaccatgtgtcaacacaaggcgaacaccatcgacccacggaccccggacacgacccgccccaaattaataacctaccatgggcacacccagaaaaaaaaacaagagagcacaccaacagagcacacaaagcattcacgagacaagtcgaccgcaagaagagcagagacacacaatcgcgcgcgacgcaatggagcgcgacgaccacggacatgacaaacggggcatgccacgaagaccaagaacagccaaaacggaaccgatgtagatcacacacttaacacgaggaacaaacacaagaagacaaggaacacagacacgagcacaccactcagaccactccaagcaaccaacaagccacgaagaaaagactaccagaagccgagacaccgaccacacagccgcacaaacgcaacaccccaggagatcagcacaccagagttgccccacagacagaagcaatacccacaaagaccaacgatcgcccagacagaaacaacatagtgacaggaacacagaagaaacaacagtgaaacaaacacacaacgaaacgacagacacatatggagacactcaaacagcacgaaacaagaaaaaccacaacac

SEQ ID NO: 706558 - DNA, 288 bp, Homo sapiens
aagcttgcaccatctgtccttcgtactctgctgcttctgctcgtctgatcccagctgtcgcagcccacggacctatccatgctcgtggggtccatcgtcagactggtctgcgcctagatggtgtctgatctgtgcttgcagtcgcttgacgtcgcacgtcagagtgcgaggacgcgtgggcagtccgacgcagtcgtcgtcgacctggatcagggtcgatgtgtcagccggtctatcgtcctgttcagtggctagggtacatgcgttgtgttcaggctggtcaggctg

SEQ ID NO: 706559 - DNA, 304 bp, Homo sapiens
aatttttaaaaccaaaaaaaattttttccctttttttttgggccccaatttcccccttggggattttgggcccgaaaaaataaggtccctttttttaaaaaaccgggggtttttgggccccaaaagggcccccctgaaggaattattgtgtttataataaaaaccctttaaagggttaaaaccccccaaggggggccccaggttttggggcttttttaggggggggaaggggcccccccttttttaaaggtgccctcccccccccaaagggcccccaataaaaaaaaacctgttgaatggtcca

SEQ ID NO: 706560 - DNA, 160 bp, Homo sapiens
gagtagactgacggtgcgcttgcgctaagtgcacagacagggggtagtgtagacatgaagtgagagagatcacaatacgcgcgttgactacgagagagctgttgtatgtgtgtgaggatccaggagccacgaggctagctcctacgagtatagtcagccc

SEQ ID NO: 706561 - DNA, 199 bp, Homo sapiens
  misc_feature (125)..(125): n is a, c, g, or t
  misc_feature (156)..(156): n is a, c, g, or t
tagggcccaggacgtgcttgtcgtcctcatcaccctcgttgtttctgctggcactcttccagtctccctgctcggttgaccaggagtccgttcatgagatttacctgtgtttaaaatctagaccnagcaccccaatctcagatgctaacatccacnagcttccccacatttcctagcttgccagttaaagccttctgat

SEQ ID NO: 706562 - DNA, 275 bp, Homo sapiens
gcatggagcattaattcttaattattcagtatcttaattatccagtgttcatcccaaaggagatggaaaaaatattcaacagggcccattgtggtctttttactgggtttatagtcccagcatgaatttccttctgtggagcagatgctaaacccaatcatggagtgactggttacccatataacttccgtaccactgttgctctagtgggcgaatcttgacctggcagatcaatactgtggcattcagtagacgcgcccgcgaatttagtagta

SEQ ID NO: 706563 - DNA, 617 bp, Homo sapiens
  misc_feature (593)..(593): n is a, c, g, or t
ttgtcgcctataatcgaagttcctcagaaggcttcggcagcagaatggcttaaaccggggaggtgaaagttgaggaaccttgaaatggtgccattgaattcaaccttgggtaacacgattgagattttatttcaaaaaaaaaaaaaggccacgaaaaaaaaccaggccgcccgcttgggccaaggcgactttggattctaccaggtttatgcttgcgcccgaaatttaacttaattgggcaaattcgccttatattgagccgattaccatttaatggcccgtggtttagcatcgtaaggattggaaaaaccttgcggttaccaagttaaatcgctttgactaaaatccccttttggcacggtgtcgaattgccaaaaagccctgaactgacggcctttccaaccagtggcgcaccctgaatgcccatgggaattcgcaactgttaatatttggtgaaaatccgggtgaaatttaggttaactaagttaatgtttaacccattgggccgaaatggaatccctaataattgaaaggaattgacggagattggattgagtgttgttcattttgaaccaggtgcccctttggacttngactccgtcaggttttggggccgg

SEQ ID NO: 706564 - DNA, 329 bp, Homo sapiens
  misc_feature (195)..(195): n is a, c, g, or t
  misc_feature (211)..(211): n is a, c, g, or t
  misc_feature (221)..(221): n is a, c, g, or t
  misc_feature (239)..(239): n is a, c, g, or t
  misc_feature (283)..(283): n is a, c, g, or t
cccctgataaacctatcagattctgtgagacttattcattgtcattaagaatagcaggggaaagactggcccccatgattcaattacctccccctgcatccttcccacaacatgtgggaattgtgggagatacaattcaagttgaaatttgggaggcggcacagctgaaccatatcagtctgtattatctctccntttttctgctttaagngactatacgnaggtgttgttttcagggnttatacataggtattctgaaagatggggttattttctgtttcanactttgactaagtggcttcttttgtcccctatgtgccagaatagcc

SEQ ID NO: 706565 - DNA, 156 bp, Homo sapiens
cgcacgtcttgtggctggggctcgaggctgacagcaggggtgctaaacagattatttgccaaagtcatcagctgaagccagcaacttcccatcatgtagtagcgggccacagcgttgatatcagtgccgtccgccccttcagtacttctacaggga

SEQ ID NO: 706566 - DNA, 299 bp, Homo sapiens
  misc_feature (2)..(2): n is a, c, g, or t
  misc_feature (33)..(33): n is a, c, g, or t
  misc_feature (143)..(143): n is a, c, g, or t
  misc_feature (156)..(156): n is a, c, g, or t
  misc_feature (182)..(182): n is a, c, g, or t
  misc_feature (269)..(269): n is a, c, g, or t
  misc_feature (289)..(289): n is a, c, g, or t
ancctgtagcaccagggctttgggaggccaacnttagtgcatcatgaggtcaggagattgagaccatcctggctaacatggtgaaaccccgtctctaccaaaaatacaaaaaattagctgggtgaggtggctggagcctgtantcccatctactcnggaggcttaggcgggagagtggtgtnaacccacgatgcggagcttgcactgagctaaaattgcgccactgcactccagcctgggcaacagagtgagactccgtctcatttaanaaatacccaggataaacaanatccgtgtcg

SEQ ID NO: 706567 - DNA, 1543 bp, Homo sapiens
gtctacaaaacttgtgtgcgtactttggtacttgttcctgcttggcctgagtggatgacttggtgtatctcaaaccctggtatggatggtcacctattgctccaggtcaactgttacaactgtgaaggtacaaatccttgtcgaaaatgcacccattgaaggccttttgatgcttgaatgcctcttcccttggtggacaatttgttgcggctttcaattgctcaacgaatgctgtcctgctcacagggcactgctgtcgctcgcctggcaaaccgcctctgcctgcggctgaccagccaacaacactgacccccacccaactggcaagccagcctggccttttcacctgcctcaagggctgaatttacttcccttagagagcgcgagtcccaagtgccccaaaacatacaccggcggccggtggccataattgtcccctctttgcataacttttgcgactttttggcgcaagtcaacctggtgctctccacaagttttgccacttgccacaccgctccttgtgcccttggagggccctttggcacaacgcgggacaaaccacgccaactctgggcattcccggcctccgactatctccctagggcgcttacacacaccaccatgccccttgtggtcacaacgcgaaattggtgcgcccctcttaacacaagagttctccttttgggcaacaaggcttccttggggcccttgaacttggccctttgagcccccgagtatgtggtgtctgtcgacgctaacgtttgggggttctccccgtttgggcgccaaagaagtgtgccgcgcaaacttggttttgtattggcttctctgcgcctgaatgggccgttctccgttcacaatggtaaaccgcttaagttttccgacacccccatttttcttggggagacttccccgccacgttttctgcggccgttcgcgttaccccgcggttggacctaacttttgaaactgaagccacatgtaagcccacagggcttttgcgcccggggctagcagcctccttttgcgcttacatttttccatacaccattgcgcccactgcagtgtgtgggcactcccagaagcgcaaaacatgcgtgcgctcttgtgtcctttggcacagacaagcgcccttttgtactccgccccaagcgcggggttacccacaccccgcacagaacgctattctcttagtggtcccccccactatggtacatacagcggcccttacaatctgaagaaccgggggccttccacacaccgcttttgaagacatctacactattcaaattttccccccttatacagactaaacccctttttgtgtccaaagatcacccgcagaacacttttccctttacaacctctcacgcgattgggggttggcgacacagtactaacctggtgtggtgcctactcacacgacaaacccgccttgttgttatacggtgagtctatcccaaacacttttgtgtggggccacacttctatttacaacacgcgcgtctactacaggcgcataccggctatacacaacagccgg

SEQ ID NO: 706568 - DNA, 137 bp, Homo sapiens
gcgaggtggcagctcgcagtgagccacgatctatgccactaacactccaaacctggtgcgacacggcggagatcctaatctttataaaccacaagaaacaaaatctccaagtcacaaggtattcgaacataggtatt

SEQ ID NO: 706569 - DNA, 118 bp, Homo sapiens
gcattaccagattctgcggctagtggagaccaatggactccatcggagtatagaggaccctgttcacatgctaagcttgaggctttgatgcaatggtggctcatgagttctgtgccag

SEQ ID NO: 706570 - DNA, 254 bp, Homo sapiens
aacgggtgatgcggttgccatattaatcgacaaagagctctgctagaggatgatccagcggagagcaccgaaacttgtagcgatgatgcgcgcgcgcagaggcctttgtatcgctgaagggctcacgctgaagcctgtggagttaggcatgcctaacactccgtgctgactgggcagtgatctcttcacacccatgctgacagagaactggcagcatcattccgttcatgtgaaaggatacgcacctactattg

SEQ ID NO: 706571 - DNA, 200 bp, Homo sapiens
aaagccattatgctcagcaaactaatacaagaatagaaaaccaaacaccacatgttctaacttatcaagtgggagttgattgatgaggaaccaaatggacaaaaggttggggcaccacacacacttgagggtcccatggggtggaagggttaaggaagggttggagagatgtgagagtatcaggaggattagctaatgga

SEQ ID NO: 706572 - DNA, 282 bp, Homo sapiens
  misc_feature (159)..(161): n is a, c, g, or t
  misc_feature (201)..(202): n is a, c, g, or t
caaccgtctgtattcgtgggactaccccgtctcactacgccctaatacaactctctgtgatacagcttcctcagaactccataacgttactagttctgattatccatcttcataagatgtgcattctgtcgcgcgaacgctccacttaccggttctctnnntcgtccgacctccattacgtcctcggtcacctgtcgtacnnataacaaattacactggacaacatttggaatcgactatgctcgtcctttcgtcgtgctatgtctcgtaatatccgttaca

SEQ ID NO: 706573 - DNA, 192 bp, Homo sapiens
ccaccatcgaaagggaatccggttaagattccggaacctggatatggattcttcacggtaacgtaactgaatgtggagacgtcggcgcgagccctgggaggagttatcttttcttcttaacagcttatcaccccggaattggtttatccggagatggggtcttatggctggaagaggccagcacctttgctg

SEQ ID NO: 706574 - DNA, 618 bp, Homo sapiens
gtgtatgtcttagcttgggatatgtggtagtaagaacatgtcaagagtgctttcttcaaacctgtcagctcaactgagaagacaggtacttcattgcttattttttcccttggtttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcacctttttttttttctttttcctaaaaagccattaaaatggtcactgctaacatttattaaacttcattgtagttgatgaaacacgctgaagggagcttccacatttcctaactaagcagcctgacttccttgttgggaaacacagggattttgctttagaattgataagatgaatgagcttggagctttgaattttttttggttcccggcgggaaactttttttaatggttaaaggggggccaaagggttcccaaaccacttgggggcttattaaaaatatgccggttggaaaaaaccacccgggataatttttttatt

SEQ ID NO: 706575 - DNA, 229 bp, Homo sapiens
ccccctagaggagggagagagggttgtgaacaaacggccctggagtgatgtaattcccatgtagggagactctcttggctgtgtgactgatgtgggggcctgggctgggcactgcttatgattatcatctaatttgttaagtgacattgttgaggaaagaatctgaagacccatggttggcgggttgccactgaaaaatgaatcacattttggtaattccttaaaaaaa

SEQ ID NO: 706576 - DNA, 876 bp, Homo sapiens
  misc_feature (660)..(660): n is a, c, g, or t
gtgagatgaagacgtaaaaccaaatggagtaagactattgtaaaatcatattaaaccttaggctgtctggcacagcatgaaagcaaatgtatgagcatgcccttatgaatatattctgatgtgttgactggcaggatactggacaagagcatggttttattattaatatatatataaatgagatcatctgtaaggtagcgcagtttaagtctgaagatacatcttgattagaggttctccagacttgattatcgcgcaatgtacagcaggtagcgcgagtcgtccctaagtggtatagggtagtcgtaggtgtataggtagtaggagggtagtcgcgtagttgagaaaatttggagatcaagcagatgtatagacttcattgctgtaagcttttgtgtgtaagaaggaatagggcgtgtgtagcacaaatcgaatatggtgagatcttgatgataagggttgtaatatacaaacatgcgatgaagagtatgggtgtgcaggtcgcgacaatgtatgggggaactctcgtagaggattagggaacccacggtggtggtgaaacatacgggatcacatcctatggcgttggagacacggagaaggggcttcgaaataggtcactctttttgaggagcgtcgcggttgttggggtcgcatgcncctgggtatctcgatgccctttggtaaactcgccatgggatcttctgggatggctcaccgtgtgggctctgaattgacttctgagagccactggcgctgttcagacccttggcccgggcgagcgctgggtgaaaaccttggtttcgttttcccaatattcttgggcggtggaggctatgccccgtgttgccagctgcttgcgaggtcaccttgccg

SEQ ID NO: 706577 - DNA, 424 bp, Homo sapiens
agtgcgtagcagaatacacaggtgtcgcagccctagcctattaggcatcccggactcaggctcttctctgtgagcatccatggactgatgctttccacatctcccctctgagctggggcctctgcaccacttctccgtctgttcattgctctcaccggttcaacaacgagtacaggttatgggctccatggtacgtgtccagaaaagtctcacgggccttttgatcctctaaaatgcaaagatttttgctgatcacttctcattcttggcagagtcttctctgaagagtgttgaatatgtgctgccctttacttcacatcatgggccaatcccattgcaaaccaggcactggccatagggcacaacatgcacaaaaggtcagcagctgtcaaagtgcttacctcttatttagttcagttgggag

SEQ ID NO: 706578 - DNA, 123 bp, Homo sapiens
ctggagaatgttccatcttcacgaatgacaagactgtaccagttcttctcctgcatagaatgctcagtgtagagagacaaataaatgaaatggccccagcccagccaggtccccaggaggttt

SEQ ID NO: 706579 - DNA, 136 bp, Homo sapiens
gtagctccgccggggggcttccttccatccagggacctccacaatttctctggatctcacactcattctccagccgctccagttgtgcagggggtggctggcgccaaccgagctggtcggcttctggaaggaagga

SEQ ID NO: 706580 - DNA, 92 bp, Homo sapiens
  misc_feature (15)..(15): n is a, c, g, or t
  misc_feature (32)..(32): n is a, c, g, or t
taggaagaagtgacncagagacagaaaggaanccaggcaacacagatttcacagaaactagataatctgttggtaccatcactctttaaaaa

SEQ ID NO: 706581 - DNA, 908 bp, Homo sapiens
gtaggcggcggcgcggggggaggcagcagcggggggagctggcggcgggaaggtggcggggtcggccagtactcccgtgcccccgccatttcggactgggagcgagcgcggccgcaagcgcactgaaggcggcgcggggccagagttctcaggcggctcccaggtgcgggaaggagaggcctgctgaaaaatgtgattgaatttataaactttgtgggacgttggacagcttggttggtggttaggcaagaattgcctttggcaggaataccagttaattccaagaactcatttgtggtgggcccgaatttatttgaattgccaacaaataagaagggaattcccttaccagggaaacgccaaacgttaggtcaacttgggcctgcgaagaaacaccctggttctcgttgggaatattcctgcggaacaaacagagcagggttcaaaagaaggaggcctacacaggtgccaaccgtgagtcggccccccagttacatttgagggactctgggcgacacgggcttcaccttgtggttgttattgcggccaatacaattaaattacctaaaattcattgtggcaggatatttcaccccattttttgagaggacacaattttagaaggacgtttaaagcgtcacttccttgaaaggaagttgtaaaccctttagtggtcccttctgtaggcgccaatcacaatggtgcatttggccctttcttagcaaccagtcggacaccaaacaccagggcctcagagcacttaagacaagaaacgttatggcaattcccttttatgtggaaaacattacagcaaaggacacagaccggcgttgtggatggatccttcctatacacttaggtcgcagacacttccgaaaccttgacgacgagcttggccagctgtgtcc

SEQ ID NO: 706582 - DNA, 538 bp, Homo sapiens
agcgagcaagtttctcatggcctttgctattaactctttcatgcctgctgacctgcaaaagaatcaggagggctggtgctggagcagatggcgcactgtgagtgatggtttagattctgcctggactcaaaccatttggttgatggcgggaaccttgattttcccccttcttatcctgagagtgtagggtttctctgaattattatttttttttttgcaaggatccctggatcctcattcctgatataagactagttctaggtaagtgcacattcatgtgatatattggttccatactaggcaatggaagtgccacattatctgtaaggagcaggagaagagccattagccccagtcctgggaacgaactttctgtaactttaagaaacataaaactttaaatgcaactgaaagattatattctgtcacctccaactactcacccataaatacaataggcaccacggaggctaggataaagtgcaaatttaagattataagtgtgcttataataaatattgacaacatcaaaaaaaaa

SEQ ID NO: 706583 - DNA, 167 bp, Homo sapiens
tcgcgcctcaaaatctaagtcgtgtgaggaaactacaaatgagaaaatcagtacaattacctgactctataacaaaaagaaaaatttcgatttgtatctcgtgacaaaccctctactaagttagagaagggcagttaatttatcttggtcccctcttaggctgctac

SEQ ID NO: 706584 - DNA, 594 bp, Homo sapiens
gaactcgcacctccgtcacacagcaatccaggcactccctgtagcagttgtacatgctagatacctcataacaacatagcgcctgagcataaaggaagtgcacatgtgagtaggttcctattcactgtcaaccagaggctaaaatgtgatgggtgactatcatcatcggtactagatgattagcaccagcacctcggtatgccatagccatcatttgccatggctaaccaaagctagcacaagtggccccgcgtataacccagagcaatcggactttaccaacaaagactctgtacccacgaatcaaaggcagataatacaccttgaaaccgagtatatcctagagtttctcgcccggaaactcttgtaatattttactccataaactataattggtcgtctaagaatatttgccagatacaaatatgtgcgtctgctccaagcttgctcgcgaggctgactagcatgagagagtataaatgcccagtcttctggccattgttcttctctcaaggaaaagtgtaaaccatagctctgagaataccatgattcccaatctttccaggcgtgtgtatgaccaatgtgaacagtcat

SEQ ID NO: 706585 - DNA, 894 bp, Homo sapiens
  misc_feature (663)..(663): n is a, c, g, or t
  misc_feature (894)..(894): n is a, c, g, or t
agcgggccggaagcgtgaagttcgctgtaggggtggttgaatgcgggtggggaaccatgtgtcggtatatcttcgcaccccttgcgttcttgccgcggcgatgcctggagcctgtaaagcgcgattgcgagagctcggaaggcctgacccgactcacgaccggaacccggctcccgtgcccgatagggggcgtgggtgtcctggttgctcctaactccttccgcagggctccttgcgtaacccgcgggtatccggagaaggtccctctgtcttcacgcggtctcgctttgctcgtgcacgcttgacgtgcgtcgctgtccgttctctcctcttgttgggtcctcacccggccatgggtacctcgccacccagtctattggggggacgaaattagccgaagccaatggggagactgacagacccgaagacatagcggatgacgaggcgaatgtgctgtggcacagtcagacgtacagacctcgcgtgcagggggaaactagtctacggcggggacaaccaaatggaacgtgggatcaggcccatagtatcctgaatgtgacaatgaccccgtaagtcgaaggagacttggtgcggtcagtgaatgcgataggactccaggggaagcacttagtcacgtcctacttcatggtcgtcctgcacgtngccatagctaattcccgcgaagcagggatatatggagcttgtatacagttcgctcctaatttcaaactactttctttccaaggaaaggaccatttttcaattaagcctgtctcccttgggtccctgctttgaaacggggtttgtgtacccagtggaagatgcaaaggtcacttgacatgcggcccttcgggtctgtatgtactcgtcccttccctaaagtaactcccccan

SEQ ID NO: 706586 - DNA, 600 bp, Homo sapiens
ttttattttatgcctttttttccctccccccaacattttttttttctcatgtctctttttaaattgcctcttttttatgatgctgttttagttatttttcttagactggcggggaattcttggaatatgggaggaagaggcccccccaaacaagggggggaaattaatcccccattgaccccggggtgggcatggcccccaggggggggaatggcaaaacttttcccctacgacggggggattattctccgcaggaataataacctacgagaaccccaaagcccggttttttggggaactaatccaaaaggaggcggccccccccaaaagcaggggaactcctcccccccctaagaaaaaggttggggtgcctggacaaaatgaaaaaaacccctccaaaaaaaccccaaaaaagggcgctccttttatagggggacacggggtggtccaaagggtgtcaacaaaaaagaaaggggccccccaaaaaatttgggttggccaaagggtttttagagacccccccccccccttcccccgggggtggggggggggcacataatattgccccccccaaaaacccccccccaaacacccccgggg

SEQ ID NO: 706587 - DNA, 460 bp, Homo sapiens
ggtgagccaaagggtgccccctgggtgaatttgttcccgcccttctttgaggaggttaaagccccaaaggcccccttggggggttttataagtgacttttacccgggaaccgggaaagtgggttggaaggaaaaaaaaagccccgtcaagggggggggggggcccccccccccctccaaaaaaagaaacaaaaagtagggggccagcagttatttgagcctgaggcctgagaaggggaagtcccccagaagttaaagttgccgggttaggcataaagggggccccgtggaaaaaacaggggcccctacaaaatgttttaaggtttttaaaccctccccccccccccggggagaataaaggggggggatcccagggggggggtttttcttccccccccaagggataaagcccttttcccgggactcaaaaaacccccaaaaaaaattttttttgtcaatca

SEQ ID NO: 706588 - DNA, 259 bp, Homo sapiens
gcatcttcctctctcacgctaatgtaacatatcccgaagtggaaggacagttcatgctcattccccccagcgcaacttctacaagatatctctctcttcttgagggagaagccagacaggggaaaggggagacttgggaaggtcctttaatggcaacaactgtggagtcctagcaggtgtgtgtgtcaagggcaggtgtctgcgatgctagtggccgagagggtgcagggctagcgctaggcatgggctgacggagtta

SEQ ID NO: 706589 - DNA, 251 bp, Homo sapiens
  misc_feature (3)..(3): n is a, c, g, or t
  misc_feature (153)..(154): n is a, c, g, or t
  misc_feature (162)..(162): n is a, c, g, or t
  misc_feature (164)..(164): n is a, c, g, or t
  misc_feature (179)..(179): n is a, c, g, or t
  misc_feature (201)..(202): n is a, c, g, or t
  misc_feature (209)..(209): n is a, c, g, or t
  misc_feature (213)..(213): n is a, c, g, or t
  misc_feature (218)..(218): n is a, c, g, or t
  misc_feature (235)..(235): n is a, c, g, or t
  misc_feature (240)..(240): n is a, c, g, or t
  misc_feature (242)..(242): n is a, c, g, or t
gangattttaacagaaacaaaaccgcagcagcgggtaggaggggagctggaggttggaatcacaccaacattatagcattattactctaaaaaaaattacttttttggctgggtgctgtggctcacacctataattggggggccaaggcgttnnggttttcntntaggtcgggatttcnagaacagcctttctaaaatggnnttttttntgtntctantaaaaataaaaattagntgggngnggtggaaaa

SEQ ID NO: 706590 - DNA, 169 bp, Homo sapiens
aagtagagatggggtttcaccatattggccaggctggtcttgaactcctgacctcaagtgatccacccacctcagccttacaaagtgctagggttacaggtgtgagccactgcgcctggccccttccctcttctttaacaccaccttccatcccttctgtcgtcttctc

SEQ ID NO: 706591 - DNA, 260 bp, Homo sapiens
tcgacttcatagaacacacttggtagtatttccattttttttttgttttgagacagggtttcgctcttgttgcccaggctggagtgcaatggtgcgatcttggctcactgtaatctcggcctcctggattcaagcgattctcctacctcagcctcctgagtagctggcattacaggcacctgccaccacacctggctaatttttgtatttttagtagagatggggtttcaccatgttggccaggcgtcgacgcggccgca

SEQ ID NO: 706592 - DNA, 788 bp, Homo sapiens
  misc_feature (403)..(403): n is a, c, g, or t
aaggtagtatgcggcagtacttcgttatgtagtacgtccggggttacatgatttagtggccgtcgttgacacggcgcggtagcgcgcggccctcgggctgcgtagggagggggcttccgcccctgtgtcattgctcctgcagccttatcgctgggactgcgcgacaccgacccccagacgggtgcccgctgtgtgccatagccggatgctgggcacgagtcccgcgattgccctataaggactgccaggcaataatgaaggttcttatactgaaaggatagcgaattgaagatgagtgtggccaggatccgtatatcagggaattaggattatatgagacttgaagccactattgatccctagtatatcagtttgagtttatgtctcttcccagtttctctgngaagctttctcatcctgaagattacgggggactcatttataccagccccagagcagtggaagcagcagagttatgtttggagcaaaacaataaaactgaagtctgggaaaggtctctgaaagaaaaatggacatgccaagtcagtgtatgtggttggaaagtgctactgctatctctagtgagtaaaattggcctaggatacagaatggagaaacctgtggaaattgcagaaacagcttgcagaatatatttgttccagggagtcctcatgcatagcctcttctatttccctgtggaaacctcaaaagagaaatccttgccaaaagcgctcaaggacaagggattgccatggaaagcataactgtgtatcagacagttgcacacc

SEQ ID NO: 706593 - DNA, 859 bp, Homo sapiens
cctggtgccatgagcagggctcctcgtgcccctggcccagggtctcttcccctgccccctcagttttccacttttcgggggtcctttattgttattaaaactgaatgggacttttcaacaaaaacaaaacaaaaaccaagaaaaaaaaaaactcttttgcggccgcggcctgggcccctggaagaaagccttctaagaaccaatcgcgttgtggcggccgcgggggcccccgagaagcggctacggggtgaaaccgtgtgggcccatcacccgtgttctccctaaggggagaaactccggggcccgacctagcaccacacgcggctggggaaggcagtcctctcacccaaccatataacaaaaccacccccgcgggcggcgggcaccaccgggaacccgacgttctcccgagacaccacaccctccccaacagatgtgagacgactgaccagaaggcagggcacaatcaccggggcgccatctatactcacaacagcaacgggggatgccaccaggagaaggagcgctccgagaactcctcaaaccattaacaccggccccaggtcccaggagatggtacacccacacaaacaacacacacccccgaacaacagacacacccaagaccgcaacccaaccccacccaacacacagccaaccacacaccaccaggacaaccacaacaccaacataaacacgcacgaccacaccaacaacactgacacacacccgacacagccacaccagcccccagcaacaacgcacaaacctagaccacaacaacacccaaacgaaactgcagccgacacagagcaaacaactacacgcgacactacaagcaagacaacaccaacacaat

SEQ ID NO: 706594 - DNA, 568 bp, Homo sapiens
ctcatctgtaacatccaagggatctgagaacagacgaggcagtctgactgtcctttctacttgaaagattagaatatgtatctaagtgacacgtgaatgccatttggatacatattctaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaaagaatgtgtgaacaagtacatgacacagtagttgcttgataatagttactagtaagtagtattcttactagagaaccccaagtagcaaaatgggacttatttttaaagcccagacacaggcgacgcgaagcagaggcagcacaccaacacacaagacaaaagcaccaaaagtgggg

SEQ ID NO: 706595 - DNA, 842 bp, Homo sapiens
gaaccatggatggtgtagaagagaagaagaaggacgttccgtgctgtgccagaatacccttgaggaaacacagcgaaggaatttcgcagagcttgaagatcaaggcgcctgagaacagaagtttgcccacaagatgcttcgaaaggcaaggaggaagcttatctatgaaagaagcgaacgcactatcacgaaggaatatacggcagatgtacatgaagctgaatattcgaatggcgatggatggtcaagatacccgtctggcgacttctatgtacctgcagaacccataattggcgtcttgtcatcatgagatcagaggtcatcaatggcatgtgatgcccagaatggttcggaaaggtgttgctgcttcttcgccttcgtcaacatcttcaatggaacctttgtgaacgctcgaactaaggcttcgattaacatgctgaggatcgtagagccatatattgcatgggggtaccccgaatctgaacgtcagtaaatgaactaatctacaagcgtggttatggcaacacaatcaatcacaggaagcgaatagcttagagagataacgctttgattgctcgatctcttggtacaatacgggatcatctgccatggaggattctgattccgtgagatctatatctgttgggaacacacgcttcacaaggaggcagaattacgttccctgtgggccccttcaagacttgtctttgtccacagaggtgtgcattgaactagataagacctacccattgtggtcagaaggtggcagaatgctgtggcaacaggggaaggacgagaatcaacggggttattacgaagaatgaactaatgtgtttaccatg

SEQ ID NO: 706596 - DNA, 911 bp, Homo sapiens
cagccataataactcctcagacatgttatgctggggccgtgtcgatgtatcagtgccagccagaacctcagcacacccacgtgggtcagatgcggtacaatccagtactgccaggcaatcaggcatttttaagagcaagtttcagaatggccgtgttaaatgaaacatatccagctgatgttacaataagcataacataacgactcagactaccagacatcttcagccacttcatcatccgtcaggaagccagagctttgcctgatttgacatccagtggattcctgtaattccaagcccaattttgaccctggttttgggattaaattagtttgtgaaggattatggcaaacactaccaactgtcactgtggacgtcagcacgttcacatggaggcattgatgcatgctattcacaattattccaaaccaaatttaattttcgcttttagaacaaggccagtttcacaaatggtatcaaaattacatatactacagtcacgatacgaacagggtgctgccacggagtgggaggtaccgcctacattttcacattattctggcgcccgaaattattacaaaattttactcagggacactaagattctttaaattagaaaatattctctattgaataatttctgtcacgtaaacataactacttgagtatgagctactgagatctaatagttccccaaatacaagttgagacctaactagtttctatctgtaactctgcttattagaggtacaacacggtgggctataaaagaaacgcggtcccctcagtaccaggcccatttcccaacaacggaattcaacgacctgttaacacttggccaattgtcaacatttgagtaccgactgtggggaaaaaaccggcacggcgggcgatatagacacagactgcag

SEQ ID NO: 706597 - DNA, 113 bp, Homo sapiens
gccagtgtgcccagcatcgttgcgtggtcagtcagccacatcattccaacactgcagcaacttctgcaagtgcctgcacagttggcagcacagtggttccacatgttgcaacc

SEQ ID NO: 706598 - DNA, 118 bp, Homo sapiens
gtagcacccttcagcaggaccctataaaacttttctccaggcctttgctctttgcaggttagcccttctctgctgagcttgccactgcaacatattttcaccatttctctagtaatcg

SEQ ID NO: 706599 - DNA, 213 bp, Homo sapiens
tgaagccggaatggtacgaatgggatgaagaattgatatggcttgttgaagttaccttctatcaaaaggagttggcgatgggatctgacaagcgatagtcagagaagaaacagtttttcacgaatttcttggggattggaggagacggaatagcgtcattgtaatcgcaacagggaagaaaagaagcagaaatgaagaaggttacataaatag

SEQ ID NO: 706600 - DNA, 131 bp, Homo sapiens
caaggaggatgccggcaaggcctttgccagctaaaagcgggactgagggtgcctcacgtgttgcaagaacagttttgagccattgttaacaaagcctttttttttcacataaaggagttgattacgaggga

SEQ ID NO: 706601 - DNA, 423 bp, Homo sapiens
  misc_feature (30)..(30): n is a, c, g, or t
  misc_feature (198)..(198): n is a, c, g, or t
aaaaagaggccgggcacggtggctcacccntgtaagtagtacgggaggttgaggcaggcagatcacttgagctcatgagtttgagaccaggtgtgggcaacatggtgaaaccccatctctataaaaaattagctgggcataggctgggcatggtggctcatgcctataattccagcactttggtaggctgaggcgggnagatcatctgaggtcaggagtttgagaccagcctgaccaacatggagaaaccccatctctactgaaaatacaaaattagccaggcgtggtggcacatgcctgtaatcccagctactcgggaggctgaggcagtagaatcacttgaactgggaggcggaggttgcagtgagccgagaccacgccattgaactccagcctgggcaacaagagtgaaactacatctcg

SEQ ID NO: 706602 - DNA, 383 bp, Homo sapiens
  misc_feature (40)..(40): n is a, c, g, or t
  misc_feature (56)..(56): n is a, c, g, or t
  misc_feature (268)..(268): n is a, c, g, or t
  misc_feature (360)..(360): n is a, c, g, or t
ggaggaatctaaatactagaacggaggtcacagaagtctntgattttttcttgatngaagcctcacctccgttcaatctcagcattctgacagaagagacggtaggcagagtgtcatccagtggacaccggacggcagcgtcactccgctcctagctgggactgggaatacctagggcggtatctatatgtctctgggccacatctggctctccaagggcttgccagagaacttcacctacgagcaccaggcgagggtggtacacggnccatgggtaaccaggaaaccacggctcagcacacggctgcatcgggggtcctcggttcccaccgacacatacagcaccgcaaccagagcttntgatgcaggggggatccgcggat

SEQ ID NO: 706603 - DNA, 243 bp, Homo sapiens
agatttgggatcagatcagatgatagtgcatcattccgcatgtcctattcaagtctcaggttctcattcccaaatgaggcctaacctcatggtagcaaccgtcttagggttgaaaatttaatccttcctatcatggctcacgtacccttataattaagtttgggacctgaacctcagctatgtctaccctccatttacaggagatgaaagagtctttatatactatcaaaagacgagggtacc

SEQ ID NO: 706604 - DNA, 448 bp, Homo sapiens
agtgctacctccacaaacagcttattttttaccctctaagggtaagaggctgggtgcggtggctcatgcctgtaatctcaccactttgggaagctaaggcaagaggatcactggagcccagaagttcaggaccagcctaagcaacacagggtttctctctgttgcccaggctggagtgcagtggcaccatcatagctcactgaagcctcatactcctgagctgaggtgggaggatcacttgagcccaggatgtcaaagctatagtgagctgtaatcacgccactgcattcaagcctgaagatcctgcctcaaaaaaaaaaaaggaaaaaaaggtaggcggagaagtagggttcaaaactagggtggtatccaccctggagaaagcgggtggggagaagacaaaactagggttcaaggtaggggggtaccggttgggggaggtagcacg

SEQ ID NO: 706605 - DNA, 339 bp, Homo sapiens
tattgcagcaaaccctgtggttttgacacataatttttcttccgccaaatagctctagtaagtttatctgtctgacatttgaattttacctgcaaagcatgagactcatgctgccttttgccaccataggcattaatggtattgagaattaggccttacttttttttttttttgtagatgagattagttttgtagaccattagttcacattttgctcctacccttgtgcataaaatcatttcatcatttccgtgtgtatgatgctacttcaagctacttccttggatattctgtggaagatggacatcttaaaagtaaactacttttgttatggctaat

SEQ ID NO: 706606 - DNA, 252 bp, Homo sapiens
  misc_feature (99)..(99): n is a, c, g, or t
aattatttttatttctgtgggtacatagtaggtgtatatatttatgggatacatgagatatttaatacaagcatacaatgcataataatcacatcaggntaaatgagtatccatctcctcaagcacttttcatttctttgtgtaatagataatcccaattatacttttcttagttggtatttgtcatttatttatttttaacatttatttgttccataaagttatttgggggtcccaggtgggtaattttgg

SEQ ID NO: 706607 - DNA, 601 bp, Homo sapiens
atcaggtggtccacccgagaccccttgagcaccaaccctagtcccccgcgcggtcgccttattcgctccgacgaagatgaaatgaaacaatcatgaaccagtgaaaaactcgccaaactggcaggcacaaggtgcggcagtttggtgcggagacatggacacttgcgtctgcatggaataggaatgacaggtcgagtctcagtagaagcagcgacacagacgaggagtgagcagaagaaagcttcagatgtctccgttgaagcaagttaggggtaaagaatatctctgggtattgaagaggtgaatatgtttacaagccaaggaacagtgatccgactttaacgaaccgctaaagttcaggcgatctctggcgagcgaacacttgcaccattacaggccatgctgagacaaagcagctgacagacatgctacccagcatcttaaaccagcttggtgcggatagtctgactagttcacggagactggccgaagctctgcccaaacaatctgtggatggaaaagcaccacttgctactggagaggatgatgatgatgaagttccagatctagtggagacatatgatgaggcttccacgaatga

SEQ ID NO: 706608 - DNA, 161 bp, Homo sapiens
ttctccgcgcgtgttggcgtctgtcgtgttgttgaccgtgtgtgtcggacgtgttggggtgttgtgtgtggacggacgtgttggggtgttgtgtgtgtcggacgtgttcggggtccgtgttggggtgttactttgtgtacggacgtgttgggtactgtgtt

SEQ ID NO: 706609 - DNA, 153 bp, Homo sapiens
gtggatgtgtgtgcatgcctgagtgcgttttttggggaggggtgtttatttttagtacccccttctggggttttctgatccagtgtggatgtgaaaatatgggaccttctccagtgtagctccttccaatatagtccatgctggggaatgtta

SEQ ID NO: 706610 - DNA, 381 bp, Homo sapiens
  misc_feature (292)..(292): n is a, c, g, or t
cagcgggcacccaggcgtggcgggtaatgctcctttgggtttgacttctgatcatctccctcttctcccctcctttcacaccgaggctcctgctctcctgtgcctccgaggcccccagctggcaagtgccttgttgcctctgccctttgaagtcggcacaattcatagcacctgtcggcaggtcaagcgcaacggcaaattcaaggccagactacgacaaaaccaggatgcggatgccccatgaagaggctcacaaccctcgaaacccctgaaacttgatcgtccatatccnagaagacacaacgcctggacgatataaacatcaacgaccccacgttaaaacacaacctcccatctgtcataacacaacacccacacaac

SEQ ID NO: 706611 - DNA, 221 bp, Homo sapiens
cagacaccagaccaacttagactgtgccccaaaaaacttgtcatccctactatcttctgtctagtcaaactcctatttgccgttctcaactactcatacatgcccttctcttgtttacactgccggtttacactgtttctccaagtcatcacagctgatatctcctggtgctatccccacctgccaatagtaataaagcaatgtcacttttttaaaacatg

SEQ ID NO: 706612 - DNA, 643 bp, Homo sapiens
cagttgcaggcgagcaggcgaggaatcgccgtgggtcttggtgttctccacgctggttcgcaggtgaagagatggcgtttgtgaagagtggctggttgctgcgacagagtactatttttgaagcgctggaagaagaactggtttgatcttgtggtcggatggtcacctgatctattatgatgaccagactcggcagaatatcgaggataaggtccacatgccaatggactgcatcaacatcctgcacggggcaggaatgtcgggatactcagcccccggatggaaatgtcacaaatgactgcatgctccagattgtttgtcgagatggtgaaaacaattagtctttgggccgaaagcgcacgagtagtgatgtgctgtggtctggaaaattttaccacttccagaatcctaggacaaacacagcgtatgtgggctctgcagtcatgacctgatgagacatccgtggtttcctcacctccaccatacacggcctatgcttgcaccggccactgagggtagggagaaccctgagcctccagcaggcttatggctattgggccatacggtggtgcgtacccgccaggaactcaagttgtctacgctgcgaatgggcaggcgtatgccgtgcctaacagtaccatag

SEQ ID NO: 706613 - DNA, 922 bp, Homo sapiens
atatagcatctcacttgctaggaagtactagtatatcgctcacacctcatattctccctactatgcctagaaggaataatactatcggtgtgcattatagctactctcataggcctcaacacccactccctcttagccaatattgtgcctatggcatactagtctttgccgcctgcgagtgcatgcggtgggccgtgagcccttacgtaggtctccacatcctcctaatcgacgaatatggcctatggacatagcagtacgaagtgagcacgtgaaagcctactccaatgctaaaactaatcggccggcgaacaattgtattacatacgcacgtgacatgacgtttccaaaagacagcatagattttgaagtcaagctactaagcgccacccatcagcgctaatgtattagcatcatcccgtctactatttgttgtaacgcacaatcgtaacaacaacgcaatattatagcatgttcctcgaaccttggtcctccgaccacgcgttaagaaccgccggctcctgaatactgaatttagcatcgagtcctacccttcaaaggtctataggtaagcctaaatggccacttgatggcctaggggaaacaagtagtccatggaagaaagctctaccttctcgtgatgactaaatcttccgcgtacaagattctcgcttgagattgataatcagtgtcacaggccagcagaatctaatcatatagtagatcttcttcgacgcgacagttattccccagctgggtatcatcgcccgtattagggaagcagcagatggcctgaacgtgggggccttgtccgattgcttagccctagtagtccgttcccctaatcatcgcattatgaggctcacaagacctaggtcttagaatttttaccgtttgtgcgagcattaaatcgggcaaattg

SEQ ID NO: 706614 - DNA, 512 bp, Homo sapiens
  misc_feature (6)..(7): n is a, c, g, or t
  misc_feature (512)..(512): n is a, c, g, or t
ttctgnnggtttattgattttaaaccacttttttggaagcttttatgtttttaccaacctaccactgctatgactgtgtcataagatgcacttctttacactcagctgatgaggggttacaatcagcaattgacctttggatgcagagcctaaattgttttaacgcctattattatcttgggtgggcattctggtacatgacgtgctaaaagggttgcaaggaaactgctgcgtcaaccttgttcaggtgcatggaaaatattattatgcttcaaaaactgatttaatttgaccccttgcactaaaaagtatacatgaggtgcatttttccgaaatcacatgtaattgtgctcctacaaacaggaccagaggaaatgtagctaccttaaagacctatctctcaaagcactggaactacggtggcgggcattggaacgctctatgagaaacaccgctctttgacagcgactgggcgtgatccttaatagacgaactcgtagggacatactgan

SEQ ID NO: 706615 - DNA, 1014 bp, Homo sapiens
tacatccgggggtttttctaaagggcacttctcgaggcaattgggtgaatctccataacttctccaaagctccaaccaatttcctaaaatcttaagaaactttatatggcacgagtttcaatggcagaggtgctgtctggtagcacttaacacccgagtgaagagcccagccatctatggacaaatccttggatatggtgtctcttaaggacaaatggatggctgggtcatcggcaagttctcagaatcttccgtggtgttattgaggatggctggggttcccttcgggcttggatctcaaagttcccttgggctttgcctccctccagcccttttctcacgccctttgggcgtggtcctggtggtcacgtggattcggggtgagaagaaatatcggttggcttggaacccctttcccccacgaggaacccatctttatggagtgtcctcagaggtttcgaatttaatgcggcgaacttaaacaggtggcttaaatgcgccgggcgcatttttccccccaaagaaagacaaagaacagagaaccagacaaacgacgaaaaacacaagacactggtggtgcgcggcgcgacgcgctcagggggccgcatagagaagaaaggtgtttaaaaagaacgaaatccggccgtaggggcgacgcgggggagccccacaatgagagagcatgatgaggagaaacaaaggggggcgcaaaacaggcgtgggtttccccaagaggagaaagacacaccgcggggggaccgagaaaaacagcagcgggcggtgagaggtctcgcccacaagcagagagaaaaaaaaagacgccgccgcgggggggggaacaacacgcaggcggccgtctcgctggaaagcaaagacgaccgaaaagaggggaggcacctcgggaggacgcgcaacaaacacggggggggaacataccaacgagcggggaggggcccccaacagcgagaggcgccacaacacaaagtgaccccgggcgcgcgcggcgggggggga

SEQ ID NO: 706616 - DNA, 758 bp, Homo sapiens
  misc_feature (17)..(17): n is a, c, g, or t
  misc_feature (737)..(737): n is a, c, g, or t
  misc_feature (756)..(756): n is a, c, g, or t
cttaagtgtgtgtgttntgacatggttcatccaccagctattccctcatctccctccttctgtttaggcctctctattccctgataaacaatattgaaattaagccaattaataactcggcaatgacttctaagggtcaagtgaaaggaagagtcacatgtctttcattgtaaatcaaaaactataaatgattaagcttagtaaggtgtggcctcttgtgccaaacacttagccaaattgtgagtgccaaggaaaagttattgaaggaaattaaaagtgctactccagtgaacacacaaatgataagaaaacaaaacagccttagtactgatagggagaaagttttagtggtctggatagaagatcaaagcagccacaacatacccttaagccaaatcctaatccagagtaaggtcctaactctctttaattctgtgaatgctgagagaggtgaggaagctacagaagaaaagttgaaagctaacagagtttgtttcataaggtttaaagaaagaagccatcaccataaactaaaagtgcaaggtgtagcagcaagtgctgatgtagagcatcagcaagttatccagagatctagctaagatcattgatgaaggtggcttcctaaataacagttttcaatgaagacaaaacatccttctatcggaagaagaagcatctaggttttcacagctagagaggagatgcctggctcaaagctccaagcagaggcggctccntgttaggggtaaagcagcngg

SEQ ID NO: 706617 - DNA, 217 bp, Homo sapiens
  misc_feature (8)..(8): n is a, c, g, or t
ggggaaanctcctagcgagcatttctctcccccctacttaacctaatcacaatcattggagaacactggtaacacccaatttaaaaatggattgtaatataaaagttcatttgtaaattagtagcttagaacttgaatacttttgtctcataaaaagtttacccataatacatctgaaatagaaaaccaaatcaacattataataaaatttcaattt

SEQ ID NO: 706618 - DNA, 356 bp, Homo sapiens
gcaggcttgtgcggcagggggcatgcacctattaattgcagtgcaggggcggtcaggaatgatagagaacattcttgcaggaaaaatgaggaacatgagaggatatgcatgcaacaagaatgggggagagaggctggccgtgcatgccccacgtctgtcctcagttcgcttttctagaagacaaatccagacacttgtgcactgctgccacaggaatattccatggcatcagaaagttcccactcgatttcttaccagagtaggtcacacagacacgtgggttgtctgttcaaggtgataggaggagagagatgaaaggccaggccagcgagtaaagttccaaaacattctgtaat

SEQ ID NO: 706619 - DNA, 184 bp, Homo sapiens
cgataaacagcgtctcaatcatctttttcatgactcccaagctagaaaggcaagccctccagagggcgttatgtgacccacaaccgagcactttggtgacagaccttcggggcctgtctgaagccatagcctctaccgagagcccagtggccgactctgcactctccaccctggctggaaccag

SEQ ID NO: 706620 - DNA, 152 bp, Homo sapiens
cctgtgtgtgattagctgtctctaacaattgtacatcataattgtcattattgtctcaacttggggctctccccaacctggggacccttccttattgttgctacccacctatcattgtgaagcagaatacaccaagcgttggattgttgcta

SEQ ID NO: 706621 - DNA, 261 bp, Homo sapiens
ggagatccatattcagctctatcaaagcttagtgaaactgatccatctagacatcctctaagaagttcctgcacaatatagcaatcggtccagacgctcctgatccagctgcagcttctcctcccgccgccgggccttgcgctcctgcagacgccgcaattcctgctgccggcctttcttgtttctacctcagaggtcagcagtagctgcccaggagcttgctggaacattgggagctgcatctatgtggcacttcttctc

SEQ ID NO: 706622 - DNA, 198 bp, Homo sapiens
ctgtaatcacctgggccaggagatactggcatgccctggtagatacagtgcagaggcatgggtagaacgacagtttcgatgtagtcctcccgacatctatagtcatactcagagtagctgggtattaaaacagtgcaaagtagaaacccaacttccctccctttctcttcgtgtggaggtcctgtgctgaacctccaa

SEQ ID NO: 706623 - DNA, 670 bp, Homo sapiens
  misc_feature (49)..(49): n is a, c, g, or t
gaggggaggaagaggggcagaagaagaaagcagagaagaaaagaagcgnatctctggaaagcagagcaagtaaagcaatctgcaaaagaagaacaggagaacaggcattcacatcaagaagagtatttcaacttgtttgatactcataaaaaccccatggagaagacatagccaacatcatcatcttcactcagaaataaggaaactgaaacctagaggggctgggtgctagtagcaattccatacagagccgtcccattcagctgcagcagaaaacacccgggtctggtctggactcaaagccaggtgcagcactctgcccctgtggcctgggggaagaaggaaagacagttcatactcctccacgttacatggcttgcttgctcaggacttgtaggcaatgtaagttggggccattgagttcccatcccaggattaaagggctttcccacacccaccaggttcagagcttccaccaactgagccattctgggaaacagccaatcagggccgactgggacagttttctccctcagtggttttgcccctttaacagtttcctttggcttccattaccaatttaccccaatgggttgctttaaaccaccggaattgaattctcacaattcttgaaattggaaagtcttaaattcatggggtccacaggggc

SEQ ID NO: 706624 - DNA, 688 bp, Homo sapiens
  misc_feature (554)..(554): n is a, c, g, or t
  misc_feature (586)..(586): n is a, c, g, or t
  misc_feature (591)..(591): n is a, c, g, or t
  misc_feature (597)..(597): n is a, c, g, or t
  misc_feature (608)..(608): n is a, c, g, or t
cggaccacgcgtccgagcatatgtacaagaaatcattttacgtcttattttaaaataaatcatgtgttgaccgtacatgtctaacatttgtttttctaggatccattccgtaccgttcgttaagggatattcgtttaagactttacgtgttaattctttattcttgatgtgtacttagagaaacttaagaggtcctgtggttttatttcccctctccgtgttgccctgtctagttgcgtgtggaattatatcccttacaggcaaaactttcgaaggtgggtggatgtggctttttaaactcttaagtttactgtgcatccatctcttgtactaagcgaattgtttatcatcttgacatggttggtcatttctatgacgaatttagttcaaacgttgtgtacgtgtgtagttctatatagtttgtgttaagcatgtcattcatataaactgtttaagaatttttcagatggcctaggtttcatccctcttactggttgtctgtgaatgaactggttaaaagataagggttatagtttgtaccctcaaatgcgttngtactttcagagcaggtttaaacgttgttttnttgtncctatntccgaactgtnggcctcatggaaatccctttcccgatctttgtagcaccatctactggcaaaatggcaaagcagctgcgtttcacttccga

SEQ ID NO: 706625 - DNA, 447 bp, Homo sapiens
gagacttgccaacacttagccagcagatccctgagcatactgcgtgacacaggcctcttatggactctttacgtctgtgtaattccgactcgggatataggcctatattcgattccgtgacctcctccacatcttcaacacatttgttatactgtcgtattgtgctcacgaagttctctgtgtgactgactggagagcatgtgctctctgtcactcttgtatacgcggatgcaatctcctgagcctcctattcactgagagccgggcttcctgaagattgatgcagctgtgctatttaccgctgtacatgaagcggactgtctgctttccagcatcgcgattcgtgcgtctgaaggcctcctcccataggaacagcctctactgggaagctgtggccaccccctggcggtgtattactgggcgggtcccacttggtgccaggtgccg

SEQ ID NO: 706626 - DNA, 81 bp, Homo sapiens
tgaacttcacaatgtgtcccgttctccccagaccactctagcctcagtatattgcaataatatttcttcttatatttgcaa

SEQ ID NO: 706627 - DNA, 244 bp, Homo sapiens
tctagctgatcggatgttgcaaatcactggtgtccttgacgagcgcagtgctcgcgcccagtacttagaccgcatggatattgagcgggaacgcggaatcaccatcaagtcccaggcagtgcggatgccgtgggaggttgacggtgtcactcaccttctcaacatgatcgacactcctgggcacgtcgacttctcctacgaggtatccagatctctgcaggcctgtgaaggagcgattttgctc

SEQ ID NO: 706628 - DNA, 699 bp, Homo sapiens
  misc_feature (258)..(258): n is a, c, g, or t
  misc_feature (260)..(260): n is a, c, g, or t
gggcccaaaatgagccggtgtttttgaaaaattggcactgtgttaaaacccaggcaagttcctctttgggccaaaggaaccttcttaatggcaaaatttttcccaactctcttaagggaactctcacaagccattttgcccccactctttaaaactaaggccaatagttccaccggttcccaatttcccaagaagcgggggtcattggtgaacaatgaattggggcccataaatggggccttcattaagcctccaaancncttgttacttggaagtaatatgaataagaaggcttttttttaagaaatcacaaccaattcggtcttggaatgcttaaaacctccattaacagtaaaaatctttctcactaaaatggataaatcagttatgtcaattgacagatattaaataacagtgtgtgaccccaaaagtacttaccctaaaacatgtgttgcttgaaagcacatgtgtgtatcgcagccttgccatgtcttgttcataacacacagggcagcagggttagctcacgtgtctttagaactccagtactcacccagggactccagttcacaggccagaaatcatatgcattatgaagttcccctctactccatgcacatagtaagtctgactatggcagtcagacttacttactcccattttcccttcgatatgtgactttttctcagtaaatattaa

SEQ ID NO: 706629 - DNA, 131 bp, Homo sapiens
tggaaacacgacaaccgatacagctaaaatgggatcttgagtgtgcccgagtgtggcaacaagataccatgctcaaactcaacctggtagaccttatactactgtagtaagtagcgttacctactatatgc

SEQ ID NO: 706630 - DNA, 339 bp, Homo sapiens
atcggggcgacgtggcgacacgccgtgccccgatgacgccgaacgccccggaaatccgcgtgtttccgcggttctctgctactttgaaggcggcctgatcggccacgggggcggtcgaacgatcgtttccgagtactcatcgatagctgtaccgaaacagcggaaagtccgaggaggacattcaatggctgacaagtcgctgaacaagaccgagctcgtcgcgaagatcgctgcgtcgaccggccagagccaggccaccgtcgacgccgtgctcggcggtctcttcgacacgctcgccgagtccgtcggttcgggcaccaaggtctccatcccgggttg

SEQ ID NO: 706631 - DNA, 370 bp, Homo sapiens
ttagaggatccccccgactagccgacaggcacagtcatcgtacaatggctctttagaccagctctgctaccagcttctctcaggcctgaactttctcaagtcgacctcaacaggccagtcatggtttttggcagctctccaggcccagctcctgcatcttggtggccctccaggcccagcctctgcctcccgtcggcctctacagtcccaacatctgcctcacagcagattcttcacgcccagcatctgcctcactgtggacccccctcgccgcgcacaccgccgccttgtcctggcatcaaacacacacgcacaggtgcatacacaggcccgagctacggccctgcacaccctgtcgggctagtcgggg

SEQ ID NO: 706632 - DNA, 130 bp, Homo sapiens
agtgtggctctgtggtgcacagaaaaccgcagctcctgccgtatgtagttctgtggtatgctccagtgcccgagtgcctttggtggactcgatctatccacgtgcttattacttgtcttaagcacatgat

SEQ ID NO: 706633 - DNA, 380 bp, Homo sapiens
gggcccccccccccaaaaaacaaaccattttcggggtaaagttttttcttgccccccttttaaagccaaaggacccccccccccccccgggatttccctacccctgggcgggccaaaatttgttttttatgttttgtcttttcaaaaaggcaacaaaaagggaaccaaatttggttgttttctttcggccccaccccctttgagtttaacccaaggttttgccagggatggagggtttatcccttttttttgttgaaaagaattaaatttttatagaagggagggaacaaagggggtttaacccttcccctgttgagggcccctggggttgtttccctttccgggtttttccaaaaaaaacaactcggggggttctggta

SEQ ID NO: 706634 - DNA, 531 bp, Homo sapiens
  misc_feature (66)..(66): n is a, c, g, or t
  misc_feature (349)..(349): n is a, c, g, or t
cagtagatgcagcaaagcagcaacaacatgtggtggtgggggttcatggcccaaggacccccttcnagaagattctggttaagcacgtgggcaaccggctttacagcgtgtcctacctgctcaaggacaagggggagtacccactggtgtgtcaaatggggggacaagcccatcccaggcagcccctaccgcgttttggtgcccttagtttggggcccgtgccaaccggcagcccccaaacttgccccgctacccaaaaagccccgccctttttccctcaaccccggcccttgggcccccctggccgcccccctgtcatttcaaccgcccctgccctttgccgttttgngtttaccttccctccccaaccaaccgttgaccttttggtttttacttgggcaaaaggaaccctttggtggccctgctttttttttttggttttgggaggggtaagggatgggggtcctgtacccaacccccccctagtttttttttccacccaaaaggaataaagttttttttcctttttca

SEQ ID NO: 706635 - DNA, 144 bp, Homo sapiens
ccgaagacgacactggtgaggcgcttctacggtgcgggtctggggttacggaacaggaagctgacatctccctccactactccctgtgctgttacacagtgtcattgttgatgttaaattaaagtcatattcttgcttctctct

SEQ ID NO: 706636 - DNA, 170 bp, Homo sapiens
agcacaggggcacacgtatcagacaggaactcgtacaggaaggcatgcaccgcagtggtgaatacacgtctgaccaggctccatcttaactgatctgaggacgtcagcacggagctcacagtgtcgacggaacttgtccagggaggcatgcaccgcagtggtgaatacac

SEQ ID NO: 706637 - DNA, 283 bp, Homo sapiens
atgtgtcggttgagtaggcagtcatggatcaggtaatgcagtttgttgagccacgtcggcacttcgtaaaggactccattcggctggttaacacagatgcactaaacctgatagaaaagcaattccagcaagattgcccatggctaacagcaaatagagatttgctcataatgcggcattccattggacttcgtttcgtgcacaattgatcgggtattcctcattcaatcaacatccatctgttgcgtcggccagcaatcaccattccttggcaagcagcagt

SEQ ID NO: 706638 - DNA, 163 bp, Homo sapiens
ctctacaggatcatcatatctgctctaggctggatgtgatagagagacggagagggatagccctccctttgtgggttagaattactgagaggaattgttccattggaatgaaataagtatttacttccagagttgcattcacggtggtgaagacagcatatca

SEQ ID NO: 706639 - DNA, 137 bp, Homo sapiens
  misc_feature (52)..(52): n is a, c, g, or t
ctgccgctactactacatgtgtgatctgaaaacccgctggttctgagctgcngtctatgcatggtaaagtaataccaagggctttttatcatttccttcttccctttaagtttcactagaaattttaaaaatcatgg

SEQ ID NO: 706640 - DNA, 687 bp, Homo sapiens
tgagcaggagtctcgctctgtcgcccaggatgcagtgcattggcgcgatcttggctcactgcaacctctgcctcccggttgaagtgattctcctgcctcagcctccctagtagctgggactacagggcatgtgccaccatgcccggcataattttttttatttccttgtggcaacggggtttcaccgtgttgggtcttagatctcttgaccttgtgatccgcccaccttggcctctcaaactgctgggatacacaggcatagagccaccgtgcctggccccagaataacccttttctatgtgagagtgtaaaaaatgttgctgccgctgggtgtggaatgggggatggctgggtttgagcactggctgttgtcaccgttgcaggtgttacccctgaggttgacagtggttctgaacattcacttttccccatgtgaaggcccggagttgacctatcacgtgtgcttctcaaaattcgggaactagggtgacctctaggagaagttgcccagcgagagcttcccggcgatattctctcaacaagattccgaggtcactgacctcttctttcaagatttaaaccgcaaatatccacatccatcattcttgcgtaaagagaccatccttattttttggaacatggagtcttcgctctgtgtgcccaagctggattgccagttggctttga

SEQ ID NO: 706641 - DNA, 1207 bp, Homo sapiens
ggatcgcagctcctgacaccatgtctgtctcttagttcttcatgctatttctcattgcaaagcacccataatgttgcaagcaggcaatcacataaaggcaaatcccagcacatgtctattggtgcagcagcagacatttattgcatgatgcatcatacacaaaacattaaccagtgcatggcaaaacttccatttcatgcagcagccatgcggttaccaagccctgtgcgttggcacttggatcaatgcgcacaagcctatacgaacgatgactgtaatcgactggctaccccaggtgaaacaatggggaccaaaaccatttatccttgaaatacttggaaagggatgccacaggactcggagtttaatgcccgcaaacccccaatggacacttctagactccctttgcaaagacgcgtcagtgaccaacaggaaaatggtagccggttcactaagagagtaaccttacccaggcaccaataaggggagccagttcgggggagcccacggggggggactggtgggcaagggacaaaaggtgaacagattcagacacaaatggcggcatagaccggaacacaggccccaatacacctccggttaacacacacgtgtcatggaaaaagggaaaattcccaccggtggaaaggaaacagctggcgcaaagggaaccaagagggacgcatagacggaacggcacataacgcacgaacacgcaaaatacgagcgaaaaatcgggacacgactagggacaaccccacaaggaatgtgaggaaccgtatcaggacaaacaattgggcatgggcgacacaccaggcactccgcatagccacgccccccgacagggacacagcagatccagacacacaagggaaggaaacccaggggaaacaaccaacacttccgaaaccgacaccgggggcccggggaaccaatgacaacgacacacaaggatgaacagggaaaacgcacacagtcatcacatgacagtccaagataaagcgctaacaagaatagtagcagaaaaagctccagtaacccaagtaccgatcagtaccagaaacgtacgagcgcgcaagcaaggacacagaaacacacaaagagatgaaaaaacaaactaccacagcgatggaaccaccaccaagcggccgcacatcatcaagaacatacagagacaagtgtaaccgccatccaccataacgggcga

SEQ ID NO: 706642 - DNA, 223 bp, Homo sapiens
tagcgggtgtatgaaggggcatgttgccatattgactagttggagagggggcagaatgctaaaaattcatcggtgaacaacacaacaatacacaaagaagaactgtctcactcaaaatgccaacagcactcattttgtagaaacagtaggaaggacacacaccaaattgttaggagaggaggttatttcttgggatgtggggattgggaaagcaagcagattt

SEQ ID NO: 706643 - DNA, 304 bp, Homo sapiens
acatctgacctcgtgatctgtctgcctggctcccagcgtgctgggcttacagacgtgagccaccacccccggcctctgccactcatttctcagtctaattactgtcttgtaatgttgtccataggctaatgtttcaggattgtgggctgtggttatagtagaacatactgtctgctacctatagacttctagctacctacttacttttacacctctttctgccacctagaaattctgagtttagtatctccacactcccacgttctacggctgaggcaggtggatctcttaagcccagcctggg

SEQ ID NO: 706644 - DNA, 914 bp, Homo sapiens
  misc_feature (380)..(380): n is a, c, g, or t
ccggtgaatggggcagaacaggcaggttccctcgacccaggaccccctgttcccacgtctatggcccccagtgcccatgtagacctggcagtgccccccgtgcttgcgcaccctatttgggggtctgggtggctactggagtggccttgcaagagtggggcagagaagtgcaggaccatgacatctagtggcctctgaactttctccgtgggcgcagcgtgacggactggcatcatcatatgttggagatgagatccttaagggacacactcaggacaccaagaccttctattctgtgccggacactgcgcatcccatagagggatcccaggttaggcacgagtctcacgttgataccatgagtgaggtagcacaaccanttgcacgcatgagagtcacgtgtcttttacgtccaaagcgagttcacccagtgtgctcacaagaagggggcaatcggcacccactcatgatgatgtgaccttagaggcagtggcacagggccttaagggagactgagctgagaggccaaacgcccaaagttggaacgcagacaccaagagcgcccataaggacggggaacaggctgggaggaacgcagtaatcaatagggtgcacatccagtctgaccagagcctgacaactaatgagcaacaagaagtgcagattgagaacctaggggatcgaaaggccatgtaaccaggagtagcccgctacaggagatcgttccaggatcccggaaaaacggagtggaaagccttcttatccacacgaggcagattgccgaagaaggcgttgacatgacgaggagggggcagcgagggaaacgggagaatagacaggggaccacaatagccgaaacaagcagaacgatggaaaaaagaggcgaagcatcaagagggggcagcaacaacaag

SEQ ID NO: 706645 - DNA, 298 bp, Homo sapiens
acagtgcatgagtcgagagagacccctcactgagtattgtgtctcgaaacgagcagcctgagccgagagttataggctgtacacggtggctttaaggagactagcaccgaggtgctcatgaaaagcagtcctgaagaacgagaaaggatgatccagccggtgaaggaagaattgaggttagaagaagcaaaactcgtgttgttgaaaaagttgcggccgagtcaaatacaaaaggaagccaccgcccagaaggccacaggttctgttgggagcaccgtgagcacccctcccccgcttg

SEQ ID NO: 706646 - DNA, 282 bp, Homo sapiens
gcttcaccttaccaccagacaaccttaggcaaaccatttacccaaataaagtataggcgatagaaattgaaaccttcgcgcaatagatatagtaccgcaaagggaaagatgaaaaattataaccaagcatatatatatgcaaggactatacccctatatccttctgcatatatgaaattaactagagaataactttttcaaggagaggccaaaagctaagagcccccgcaaaccagacgagctacctaagaacagctaaaagagcacaccccctctatttag

SEQ ID NO: 706647 - DNA, 400 bp, Homo sapiens
ctgtgctattatctcatgctctaatggggagattatattttctcatatacttatgtgaaccacattaaggggtacatctgtgtgctatatttttctcacaatggaaatgtgtttttatatatataaatccatgcgtctttgaaaaattcaacctggattgagagtacactataaataccaaaatgaaaggcattttgacttccacattcccagagataatcaccatgtgacacggtaattccttgtgttcgagagaaggcgacatttgatcacagctgtgtgtgccttactctgtctggggaaggcctcgggtgaatcatggactcaaggtctctgttcacattactcaagttggtaagaattgcgcacgtagaggggggagaggtttgcattggctgtt

SEQ ID NO: 706648 - DNA, 638 bp, Homo sapiens
aaacggtatctggaactatgataatgtgacaaaacaagttctataacattcacaaaagatcacactagagcaatgaatccaaaccaagaagaaatctctgaatgccagataaacaattcagaaggttgattattaagctattcaaggaggttccagagaaaggtgaaaaccaacttaatacaatttttttaaaatacaggctatggatgaaaaagtctccagagaaatagatatcataaagaaaaaacaatcacaacttctggaaatgaaagacacacttagagaaatacaaaatacactggaaagtttcaacaataaactagaacaagtagaagaaagaacttcatagcttgaagacaaggctttctaattaacccaatccaacaaagaaaaaagaattttaaaaaatgaataaagccttcaagaaatttgggattatgttaaatgaccacacataagaataattgatattcctgaggaagaagagaaatctaaaactctggaaaacttatttgagcaaataatctaggaaaacatccccggtctagctagagatctaaacatccaaatacaagaagttcaaaaaccacacaggaaattaattgcaaaaaggtcatcatctagatacatagttccag

SEQ ID NO: 706649 - DNA, 287 bp, Homo sapiens
gctcgacataatggcgcaatgactactgttaggatgttacagaatcatgcatggaataaagatctattcaggccaggcgcagtggctcacgcctgtaatcccagcactttgggaggccaaggcaggcggatcacgaggtcaggagatcgagaccgtcctggctaacacagtgaaacccagtctctactaaaaatacaaaaaaattagccgggcatggtggtgggcgcctgtagtcccagctactcgggaggctggggcaggagaatagcgtgaacccaggaggcgga

SEQ ID NO: 706650 - DNA, 614 bp, Homo sapiens
ctgacggcagtgtaatccggaatcatgggcatatcggatgtccagggataatgagggacagatgtagtgctcgtgctcatgtgtgacagcgatcagcggatgtaggaagcagcagtgggacctgagcgagctcacatgggaatgtcactgaataagctattctatactactaaatttcagcctcagaaaatgagggagcacctggagctagttctggtctagagtagaatattcccaaggtgctaagagctagcagaacaagctcatctttgggcagaactggtagtataagtatagacaagtatgaagaatatgataatgccataattaccatgaatgaatcatccaactgatgcctggaaagaagggcaattcaaagatatcattaccaaggttgccaatgtggaactatactacagagcaatacagttctacttagaattcaagcctctgtagtaaaaatgattagctgatggtgctagtctccacggatggaatcacactcgtgcagtcaattattgcagcaaggtataacagctaccactggtgaaaccggataagcgttcagtacaggaaccataacaacaaatctgtgaatgcatcattgaacaatc

SEQ ID NO: 706651 - DNA, 451 bp, Homo sapiens
  misc_feature (34)..(34): n is a, c, g, or t
  misc_feature (76)..(76): n is a, c, g, or t
  misc_feature (79)..(79): n is a, c, g, or t
  misc_feature (90)..(90): n is a, c, g, or t
  misc_feature (116)..(116): n is a, c, g, or t
  misc_feature (120)..(120): n is a, c, g, or t
  misc_feature (134)..(134): n is a, c, g, or t
  misc_feature (236)..(236): n is a, c, g, or t
  misc_feature (255)..(255): n is a, c, g, or t
  misc_feature (315)..(315): n is a, c, g, or t
  misc_feature (382)..(382): n is a, c, g, or t
  misc_feature (417)..(417): n is a, c, g, or t
cacagctggctgccagcccgggccttggtggaanaggcccttgcccagcgattccaggtggacccaagtggagagnttntggaactggcnaaaggtgcatgtccctggaaggagcntctntaccacctggaatntgggctgtcccctccagtggccattttttttgttatttaccctgaccaggctggacagtggcgaatacagtgtgtgcccaaggagccccactcattccaaanccggctgcccctgccaaanccatggcggggttttcgggacaaggccctggaccaggtcagtgggatccctggctgcatntttgtccatgcaaacggcttcattggcggtccccgcacccgaaagggtgccttgagcatggcccgtncccccttggcccagcgctcatacctcccccaaatntcctagtttaataaaaccttccctttcatactta

SEQ ID NO: 706652 - DNA, 409 bp, Homo sapiens
  misc_feature (276)..(277): n is a, c, g, or t
atcttccagatggacagacagtctgtggtcgtcgccaaacccctgaatctggccctgcccgcagtcagagggatggcaatttgtaagctacagactattgcgaatcattcacttggagactgaactaagactactggcaccaggctccgtagaccctcgggaagagcatggtctggcaggcagactggatgtggccacagataacactccctaaggggagagcgtgagcctgcaggccagaatgccaccactttctcctgtgtcgttccagagagnncctgtggctatgcacgcttgctgctacagagggtagtgctgtatacctcctgggctcacttactgacttttcagtctaagggcttattgcaattggtacataacgatcatactttgtaatggttaagtaaaa

SEQ ID NO: 706653 - DNA, 938 bp, Homo sapiens
  misc_feature (22)..(22): n is a, c, g, or t
  misc_feature (145)..(145): n is a, c, g, or t
  misc_feature (281)..(281): n is a, c, g, or t
  misc_feature (359)..(359): n is a, c, g, or t
  misc_feature (413)..(413): n is a, c, g, or t
  misc_feature (430)..(430): n is a, c, g, or t
  misc_feature (451)..(451): n is a, c, g, or t
  misc_feature (521)..(521): n is a, c, g, or t
  misc_feature (560)..(560): n is a, c, g, or t
  misc_feature (562)..(562): n is a, c, g, or t
  misc_feature (566)..(566): n is a, c, g, or t
  misc_feature (576)..(576): n is a, c, g, or t
  misc_feature (590)..(590): n is a, c, g, or t
  misc_feature (596)..(596): n is a, c, g, or t
  misc_feature (610)..(610): n is a, c, g, or t
  misc_feature (663)..(663): n is a, c, g, or t
  misc_feature (705)..(705): n is a, c, g, or t
  misc_feature (754)..(754): n is a, c, g, or t
  misc_feature (756)..(756): n is a, c, g, or t
  misc_feature (791)..(791): n is a, c, g, or t
  misc_feature (805)..(805): n is a, c, g, or t
  misc_feature (823)..(823): n is a, c, g, or t
  misc_feature (831)..(831): n is a, c, g, or t
  misc_feature (867)..(867): n is a, c, g, or t
  misc_feature (907)..(907): n is a, c, g, or t
gcgtggcttagtgctaggctcntgttctcctcttcgtccttcttgttcttcgtgtcgccctctttctgctcgggcttggcgttgttctgcatggctttggcaaacgcttccacatcgcccttgttggcggcctccacagcctctncaggcagatcgaactggcacatgagggggcccagctgccccgaggccaaggctgcgctgaacatgcccagggcctgctggtactggggcgaggtcagggtattctggatctcatccgcggtctgcggcagcgactncccagagggcaagttgggaagcaggcgctcctggacatccgcgttggcgagggtgggagccattttctccggcgttantcactggccaggtccacttgctggccgcctgctggcccggctggtacgttcatngtggccaggatgctctngaggtcgctcagctggatggnctgggtcgggctggctgctgttctggctccatttccggaactgggcgcggggctcgggctagttgctgangcagccgctggagcagaaggggctggggtggcacgggtngnagangtggtggatnatggggtgaccgcngccgantggctccgggagcnggaggaggagctgctccctggaggcccactgctccccagttagctggccaggncagggccagttagggcccccagcccacccagttctccgaggncggctggtccgatgaactgcatgaaccggctgttgctcatgtttcccancngggtctgcagggcaccctcaccgcctagcgcaganagttcgtggccgcngcttccgctggcccccanttccccangcatcgggggggttgttcaaaaactcgttgactttncggcaatgctcctcaacctggtctgtttggggttcctgcntccagaagaaaagccgcttggaccctgcctt

SEQ ID NO: 706654 - DNA, 109 bp, Homo sapiens
ccatcttcgtcccatcagcggattctatacattgatctcttgtttggtatatcacaaccagcagtaacgacgtgtcaacaatgagtggtctgatgggagcaagatgcgc

SEQ ID NO: 706655 - DNA, 474 bp, Homo sapiens
ggctgatctctatgaggatcccccacgcgcaccgagcgagcacacggcttcgtagacgtggagataagatcccgagcaaaattgagaaaattcgagcaagtatatttaacaagtaagtgacttgatggtagtcaagtttggatggtgaagatgaatcgatggaaatgtcaacagaagagattctaaccgtgtctgtagtaaatcagagtctctttgatactcaagggagcccagggttagaagattatttcaatgataagtcaattaaaggggagaagctggtgcccggagccagagaggttctgacggagatatttaagagtttgcccattcagagcagacgcttgagcctgacaccagcgaagcacatcagagtctctgacatttatcttagcaaagagccgatcaattcccagaccccaggtaaaactcctccacctctttttcaccaatgtccggccgccaaaaaaggtg

SEQ ID NO: 706656 - DNA, 154 bp, Homo sapiens
ggtaatgttgatagttgggaaggtgcggtgttgcgtcggaagagctctccctccggtcctatgagtgaacttctcaaagttccaggccactattgagcggcgcatcagtgtctccaatctgatgagcttgggatcagtcagggcccgatgggtt

SEQ ID NO: 706657 - DNA, 194 bp, Homo sapiens
ccagttacacagctcccacgaaacttttagttaagcagctaaacaccctaatcaactggcttcaatctacttctcccgccgcaggcagaaataggcgggagaggtcccggcagaaatggacgctgcttcttgtgaatttgcaattcgaacatgacattcacctcgggacgtgggaaaacagagggctcaacctc

SEQ ID NO: 706658 - DNA, 1021 bp, Homo sapiens
gggcacagcgatggcgctagggggaactgctggcctctgaaactagctctgggaccggtggtctgcgtgctggccctagctggcccctgtctcccatccccagaatgggtattcactggtggattctgagctttgtgctactccatgtttcccacgacacgatgttccctttctacatgctgctggaggactggactgctactactactcctggctgtggcagtgagagaatcctggcagacatgaagaaaaaacttgcgacttggtaggagaaccagggtaaagagtcagagaaagacgttggctctagtgcacgaggctgacaagcactgtttaatagacagctttgaggagcactgtgggccagggttcagacacatacatctacatcttcagggtgtgccgggaacgcttggaaaccagcacttcttggggcagtgcctgggtgcaaatcaaagcagaagtaatgggaaggagacagtggtagggagactccagcgagagtcacatgccttcaacggaagtaattggatcatgctgatctatcaagggggtgatgacatatgacccaccagctgtggcccacggagccagcgctcgcgcagtgctgactgactctccctgcaccccgacccaccctaccggaccactccaacccctgtcgcctgaggacccgtggcacaagtcccccgacagcctatcatacacccccccttctgagcaatgggattacgcaagcactgcgcccttgctccaaaccaggcagaaactatatccccacgccacatgtgaggcactcatcccagcctgcttaacaccctgacgcacggctacctgggacatcccccatccgactcgaatggatcgaaaatgatttggtatggggaggggatccccctacgcagcgcacaggcacctgtgcaagctcgggcaggcccaacaggcgaccctggccgcgacagctggcccccgactcaccggccccctctcgcgagccatctggcgcagacgccggcccgcc

SEQ ID NO: 706659 - DNA, 1378 bp, Homo sapiens
  misc_feature (373)..(373): n is a, c, g, or t
  misc_feature (1057)..(1057): n is a, c, g, or t
agcggaagaaataagtccatgctagtggaagggctgctttgtcaggaggttgtggaattccttacttctccccttcttccctcccataatatgcttagctatgtataacagtgccacagtaatcggaccatcagcttgtttccatttactcacagagcaaagcaacttgctccatcatcatctatatttggcttcctagctttgtataacgataaccatccgttcgttttctgaactaccagatgtgtgtactggcgctttctgcgaggagggcgacgttagcgcaggtaaatgagtggccctctacctcaatctttctttactccatgctttttcatgctcacggtaacgttaatctggaggcaaaagaaantcccacgtattcgacggcctctttataggaaatcgagctttggagaatactagtgcactagcctggacttgtgtcttaggagctaaacgcattttcctttgtgacctaaataccgcatggtgtgaagtgcgtgaagaattcaggtcctaagacaaacacaaatttgcacattattctcgaatagtgtggtcctgcccaagtcagttagcggataccacaatgacacgaaaggtcatttcatgggaatcttactctttccctttctaccaactaaggttgaatagagcggcattggactacaggcgttcgggttgcacgttgtgcgctatagtaacacccttcctggttcaatttctttactaagcgattaaggccccttaactttttactcaaattcctgggatgctcagggggtgttactttttactttccttcccgttggtgataagagcaatacgcctgaactgtatttcgctggataaagcgaaaattcctctatgctccatatgcttgaggccaagaaccccgaaaggctgaacagacacctccatggggaaatcggtgtgtctggccactcacatttatagacgtgaaaccatgcacccgattggcggcgcactcttacgtctggtcacggacttactctctcaagcacaggtcaatctttggggcacctacatggcntttccctgcgtccctttacacttggccccttgattgccctccgtagtttataagtgaccgcgcttttcccgtcctacccatcttcagatagggctaggaaaatcgccagttggtagtggcttgcataactggcatactatgggcttattccacccttgccaacagcggaagaagggttcctaaggttagagaggacccgggcctctgtggctgtaacagcgggttcggccagcaaacaagcattcttttcccccaaaaaagaacttctggatatggaagctttaaagagagtttagtatcatatcctcgaaaaggttccta

SEQ ID NO: 706660 - DNA, 955 bp, Homo sapiens
gaccttcagcgtgagccccttggaaggtccaaacgtggggggtcaaactaggcgtcccccttgcccggcacccttgtggacccaaaccaatttcgtgaacttaaacgtaaataggtacttttcaacattggttcaataatgccgtgaaaaccttgttcaaggtctattatgcactcggagtaatgttttttctagacgcgcgctgaccggccgcccaatatctacttaagggcgcacaccacataaatctctctcagctgtggcggcgaccacttttttgatctctcggggcgaaaccctggtgacaacaaaaaacgcccccaattttccaggggaatgaataaatctcgggtgcgccccctccataatcaggaggttgctgtgccaagtgccacacaccctgttgggaggcaaacaaaatatcatcttttcagaggaggggtttcacatcaccccgccccgcccctccgcaggttttaatgggttgtagtatctcccctctcgctccctcttatcctgttggatggtaggtggccctgaaaagatgcgcatctctatctcgaggttagagtctccccagagccgggagtgggctaagaacgccccctgggagaatttttaataccagcgcgccttctgcttatatcacaggttctctcccccggcacacaaaatctgttctttttctaaccctcgccccaagcagaagatacattcactttcctcccctagcatccggcgacctcataattattcccagcagcgtgccccaaaaaattgcaaaaagattcttgtccccccatgaaactgcccacaacccttcctgtcgtgcatagatgcgacgccaacacccaactctgatttatagagaaagtcacccattccactccctttttttcccccctaaaaaacgaaaaaaaaacccccacatgacaaaaaaaaccgaacataaaaa

SEQ ID NO: 706661 - DNA, 1610 bp, Homo sapiens
acgtcgctgtcgacgaatcaggtggtgtgggtgcatagtctgtcgtgttacgagccgcgcgttctctggacgcagtgtcgctctctgcttggaacgactcgcttgggggcagcggctgtttctgctcacacttctcttgggatgtgggtggccccacttgttggcggcccccgttgggtgttgggtgccaccaggcgtcgcatagagtcgccccacgtgttctccctcgcagcgtcgtcccgggcggtagtgtttcccgacggtgtacggccgggtcacagacagtttggggtttgcttttcccgggggggtgtggggtacttaacgccggccccgccagtttggtgacgctctttggcctgggaagatggctttctctgttgtgccccccgtcgcccccaacaggggatgccctcgggtggagccccccaacgcagtacggtgtgagtacggtttcctccggggaaggcctgcctttggtgcgccggccgttttgcccgtggtatgtcccgggggggctcctgggcaccagcgcccccgtgtgggcgccccgcaggttgtgcgttccccccgtttttcggctccctttttttcccccgttggggggcgcccgctccttgagttagacagcacgcacaccgcccgggttgtgagatttggggggtgataagtcattgggccgcctttggggcactcctcgggggccaaccccccgctgtttaatttgcccccgtcggcgacaacacacgggggcacccacgaggccaacatcccccgttgtttctcccccctcccgcgtgtagaaacacacacttgggccgttttctctcgttaaataaattgggccccccgcggttcttttatacgcgccctcgtatattgagagagtggagaaattaaatggtcgaaatgttttgtcttgtctcaaaaagtggttatgacactttcccctgctctatgggagtgtgctggttgcacacccacacggggagaatattttgagagagggagagaaagttttcgggccccagcgctataggagatgaaaaccaccacggccacaaattgagcctggccgccacgagagctgtgagattataaggggcccacataagagagaggaaagagattccaccgcgaaagggggccgggggagagaatagccctcgggtgtgtctccacgacaattcgctctcccacgcgaggctgttcccccgcttctgttctctcgcgggtctggagagcttgcgccgcggagaccacgctttggcgggtgtttgtgcgtctctttctataattgtaagagatgagacaatctcacagagtataaccctataaaatatcacatctacactttgtagacaagtgagaccacacttcacgccggcacatttatgtaacacatccacgagaaaggttgtgtatggcacccacccttctgtcaccgcttttggagacacttctgtcatcacaccccgctgaagcacatcactttcccctcccgcttttcctcctcccctggcacaactggctgatcgactttgtgttctctgttgtttaaaaataggttttccctgttttggacatttcatataaatgggatcacccca

SEQ ID NO: 706662 - DNA, 141 bp, Homo sapiens
cggacggtgatcatagtcgcacgtaaggattataagagaacgcagaggggtagtaaggagggagtggacatctgtacgttgaatagatgaacagattaaaagccatcagtccaataaaatatgattcagcctcacatttct

SEQ ID NO: 706663 - DNA, 285 bp, Homo sapiens
  misc_feature (31)..(31): n is a, c, g, or t
  misc_feature (50)..(50): n is a, c, g, or t
  misc_feature (73)..(73): n is a, c, g, or t
  misc_feature (75)..(75): n is a, c, g, or t
  misc_feature (94)..(94): n is a, c, g, or t
  misc_feature (99)..(99): n is a, c, g, or t
  misc_feature (109)..(109): n is a, c, g, or t
  misc_feature (121)..(121): n is a, c, g, or t
  misc_feature (141)..(141): n is a, c, g, or t
  misc_feature (171)..(171): n is a, c, g, or t
  misc_feature (181)..(181): n is a, c, g, or t
  misc_feature (189)..(189): n is a, c, g, or t
  misc_feature (235)..(235): n is a, c, g, or t
  misc_feature (237)..(237): n is a, c, g, or t
atttctcgtcagcgttgaaaagggttacccngggcactggcctagagccncaccgccgaatagacttagcccngngagtttgccgtgttgagcnggacnatttctggcncttgcaagtccngtgatttcgtcggtaattcngagggtggggggagggacgtgaaatcgtcntagcttagcnttctgtcngtgaatgtcgatatagtgtattgtgtgttttaacgaatgatttacncngacggttgcggtaaaagtgaatttggaaataaagttattacgcggatt

SEQ ID NO: 706664 - DNA, 361 bp, Homo sapiens
ccatccagcctaagcaacaagagcgaaactccgtctcaaaataaaaataaaaatagacctaaaaatagcagggagtgggctgccagtagtggctcacgcctgtaatcccagcattttgagacgctgaggtgggggttttgagatctggagttcgagcccagcctgggtaccaggctgtgaaactctgtctctactaaaaacccaaaaattagctgggcatggtggcacgtcccctgtgatcccagctactttggaggctgaggcccaagaatggcttgaccctgggagatggaggttccagtgagccaagatcgcccccccgcccttcagcctggaggccagagcgagactctgtcttcca

SEQ ID NO: 706665 - DNA, 577 bp, Homo sapiens
acagagaatggagaatgtaaataccaatgccttgaaaggggccatggtgcggcgtgtgagagataagaaacagtcaattactcacagttggaccactctgaccagtgatgatgatctcgtttctgcaactgtacctttaaccaagaaatccagaacagcaccaaaggagttaaaacaagataaaccaaaacctaacttgaacaaatctccggacagaaaatcccagtacaagagaaaacccctaaacacacggctggctttagatgacaagctctaccagagagacttagaagtggcactagctttatcagtgaaggaacttccaaacagtcaccactaatgtgcagacatctcaagataaaagcttgtgaaaaacatggcagtagtaaaatagaaacaatgaataagtctcctcatatctctaatggcagtgtagccagtgatcattagatccggataagattactgtggcaagatgatgtcggggtgtcaagggaacagaaaagcagcatctaaagctgcagacagcagacggacgattcttctgtcaggcagtgatggtgatagtgtaatgaat

SEQ ID NO: 706666 - DNA, 844 bp, Homo sapiens
  misc_feature (16)..(16): n is a, c, g, or t
  misc_feature (166)..(166): n is a, c, g, or t
  misc_feature (178)..(178): n is a, c, g, or t
  misc_feature (218)..(218): n is a, c, g, or t
  misc_feature (223)..(223): n is a, c, g, or t
  misc_feature (228)..(228): n is a, c, g, or t
  misc_feature (232)..(233): n is a, c, g, or t
  misc_feature (236)..(236): n is a, c, g, or t
  misc_feature (242)..(242): n is a, c, g, or t
  misc_feature (256)..(256): n is a, c, g, or t
  misc_feature (259)..(259): n is a, c, g, or t
  misc_feature (262)..(262): n is a, c, g, or t
  misc_feature (269)..(269): n is a, c, g, or t
  misc_feature (272)..(272): n is a, c, g, or t
  misc_feature (282)..(282): n is a, c, g, or t
  misc_feature (284)..(284): n is a, c, g, or t
  misc_feature (292)..(293): n is a, c, g, or t
  misc_feature (302)..(302): n is a, c, g, or t
  misc_feature (313)..(313): n is a, c, g, or t
  misc_feature (323)..(323): n is a, c, g, or t
  misc_feature (397)..(397): n is a, c, g, or t
  misc_feature (404)..(405): n is a, c, g, or t
  misc_feature (407)..(407): n is a, c, g, or t
  misc_feature (410)..(410): n is a, c, g, or t
  misc_feature (413)..(413): n is a, c, g, or t
  misc_feature (419)..(421): n is a, c, g, or t
  misc_feature (423)..(423): n is a, c, g, or t
  misc_feature (425)..(425): n is a, c, g, or t
  misc_feature (427)..(427): n is a, c, g, or t
  misc_feature (440)..(441): n is a, c, g, or t
  misc_feature (446)..(446): n is a, c, g, or t
  misc_feature (450)..(450): n is a, c, g, or t
  misc_feature (454)..(454): n is a, c, g, or t
  misc_feature (456)..(456): n is a, c, g, or t
  misc_feature (489)..(489): n is a, c, g, or t
  misc_feature (492)..(492): n is a, c, g, or t
  misc_feature (506)..(506): n is a, c, g, or t
  misc_feature (510)..(510): n is a, c, g, or t
  misc_feature (512)..(512): n is a, c, g, or t
  misc_feature (548)..(548): n is a, c, g, or t
  misc_feature (731)..(731): n is a, c, g, or t
  misc_feature (822)..(822): n is a, c, g, or t
cgctggcttgtgcgcngtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccaaaaagtgaagcnattccgggccancgagccgatcctcagcgtcctgatgtggggggtgaaccanacgancaaanaacnnaanaaagtncctgttcctgtcangcnaangccaaanganttcaaagccnanagcaaaannaaggtgganaaacaactctncaaaaagganaacctgcccagccgctttaagtttaaggagtattgccccatggtgttccgaaaccttcgggagaggtttggaantgaagannangantancaaaannnantnangcgcagcccccannaaaantganaacnanggtcggtgtggcacgcgtttcctcaccacctangancggcgctttgtcancaanantgtgtccagcgaggacgtggcggagatgcacaacancttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccanagaagcgagcgacaaggagaaggccaaggacttgccaacattcaaagacaatgacttcctcaatgaagggcagaagctgcatgtgggagangagagtaaaaaaacttcctgga

SEQ ID NO: 706667 - DNA, 105 bp, Homo sapiens
cattatagtgtcaagatgctgcaacctgtggggcccacgtatcaagcaaatctcctgccccagactcctgagtagctgagactacagacgcgtgccaccatgccc

SEQ ID NO: 706668 - DNA, 476 bp, Homo sapiens
tcgctggggtggtgaatctgtcagacggcaggagtactaggaccaggtaggagatatagtgagatctctagtctctacaaaaaattttacaactgagcaaagtatagtggcttgcccctatggtcccagttgcttggagagagaggtgtagtgatcagatgaataaagagtgggatggcatggagctttgattgtgccagtgcactacagacggtggggactgagatgagacctgtaagtctaaaaaaaaataaataggccgggcccggcgtagtggctcacatttgtaatctcagcacttggggaggccgaagtgggcggatcacctgacgtcaggagttcgagaccaggctgaccaacatggagaaatcccatctctcctaaaaatacaaaattagccaggcgtggtggtgcacgcctgtattcccagctattgaggaggctgaggcaggagaagcacttgaacctgggaggcg

SEQ ID NO: 706669 - DNA, 247 bp, Homo sapiens
  misc_feature (186)..(186): n is a, c, g, or t
gcatggcacctttagcaaatcccctccagtccttcctgagatccttcaccagcatcccagactccacagttatttatgaatgatgtcgtgattctccctccacctgcattttaagagtgaaaggcatctaacctgatgctcttggagagagataacctgtctgtcataacttaaggatgagaaaancatttgttcttttgctgactttggttacagtcagaaaaaataaactagatgtttgtgtcta

SEQ ID NO: 706670 - DNA, 326 bp, Homo sapiens
  misc_feature (13)..(13): n is a, c, g, or t
cgacactcttggnttgagtgcggtggctcatgcctgtaatctcagcactttgcggggccgaggcgggcagatcacccgaggtcaggagtttgagaccagcctggccaacatggagaaactccgtctctgcaaaaaataaaaaaattagccgggcatggtggtgtgtgcctgcagtcccagttacttgggaggctgaggtgggaagttcactagggtccgggagttcaaggctgcagtgaggtatgattgtgccactgcactctagactgggcaatataggaagatgccatctctaaaaaaaaaaatttagccaaccaagagtgtcg

SEQ ID NO: 706671 - DNA, 299 bp, Homo sapiens
ccctatgaggtccctgtgtgctctgagacagcatcaacggccgcctctttgcgctatccacttagcatgactacagtcattaccagagctctcccttttctctcacggtggcagagagtaaaagaattccgcaatcaccctaagcactacattgtaaactacattcagggctctaagcaggactgtccagccctgaggctccccctccatgctcttcaaagcccgggtgggtgtcagggtgtctggcagagtgcgagtggaggctggccggcttgctgggccaccctacccgagggagg

SEQ ID NO: 706672 - DNA, 332 bp, Homo sapiens
cccctgcgggtcacatatataggtaaagctctcaagactcctgagccaactttatatgtaactggctttcctaggctgggggcttgacctaagtaaagaagccaaggagtcagatctagatagcagagaagtacgtctcatactacaacatagcaactacggttagagtccaccccatgaagctgtatcagatggtgtatctaggactgaattctataagtatatatggtccagactaaaacaaatgtggctagctaggtgggctgtgctgtctcagtaggacatggacagactccagcttacaccctcaggaagacttggacctacagtgc

SEQ ID NO: 706673 - DNA, 435 bp, Homo sapiens
acagcgcagctcctacgtgtacttgtgagggctgctgcctcaatatgcagccgcgtgctccaagctgagggctggtgggctgcactgtacgttcagcaacaagagtgctggtgctggatgagaccaccacatccacgggcagtgcagtgcatgcgactggtgctgcggtgtgtggtgtgctgctgtgtgactgtgcgagggatacaccttcacgctcactggtgctggtgcctgctctggcgaggagtgagggttgtgcccccatccgcctgtaccccaaccgaccgccgtatgggtgtgcctcttgcctgcctcttcccactgggctgcttgttgcaacttgccctcaccaccaaggtgcacttcgacttgacgtggtgagttgcaggccttgcttgggtgttatgcagcgggatcccccgactctgtgactgt

SEQ ID NO: 706674 - DNA, 839 bp, Homo sapiens
  misc_feature (17)..(17): n is a, c, g, or t
  misc_feature (61)..(61): n is a, c, g, or t
  misc_feature (96)..(99): n is a, c, g, or t
  misc_feature (126)..(126): n is a, c, g, or t
  misc_feature (128)..(128): n is a, c, g, or t
  misc_feature (144)..(144): n is a, c, g, or t
  misc_feature (148)..(148): n is a, c, g, or t
  misc_feature (152)..(152): n is a, c, g, or t
  misc_feature (164)..(164): n is a, c, g, or t
  misc_feature (167)..(167): n is a, c, g, or t
  misc_feature (188)..(188): n is a, c, g, or t
  misc_feature (191)..(191): n is a, c, g, or t
  misc_feature (226)..(226): n is a, c, g, or t
  misc_feature (233)..(233): n is a, c, g, or t
  misc_feature (237)..(237): n is a, c, g, or t
  misc_feature (239)..(239): n is a, c, g, or t
  misc_feature (264)..(264): n is a, c, g, or t
  misc_feature (271)..(271): n is a, c, g, or t
  misc_feature (288)..(288): n is a, c, g, or t
  misc_feature (293)..(294): n is a, c, g, or t
  misc_feature (296)..(296): n is a, c, g, or t
  misc_feature (302)..(302): n is a, c, g, or t
  misc_feature (304)..(304): n is a, c, g, or t
  misc_feature (331)..(331): n is a, c, g, or t
  misc_feature (375)..(375): n is a, c, g, or t
  misc_feature (385)..(385): n is a, c, g, or t
  misc_feature (400)..(400): n is a, c, g, or t
  misc_feature (402)..(402): n is a, c, g, or t
  misc_feature (496)..(496): n is a, c, g, or t
  misc_feature (572)..(572): n is a, c, g, or t
  misc_feature (574)..(574): n is a, c, g, or t
  misc_feature (577)..(577): n is a, c, g, or t
  misc_feature (623)..(623): n is a, c, g, or t
  misc_feature (705)..(705): n is a, c, g, or t
  misc_feature (750)..(750): n is a, c, g, or t
  misc_feature (760)..(760): n is a, c, g, or t
  misc_feature (775)..(775): n is a, c, g, or t
  misc_feature (778)..(778): n is a, c, g, or t
  misc_feature (830)..(830): n is a, c, g, or t
cccttaccttatatttnatcctttaagagtacattttatacaaatccgtaaccaggcttcnctcatgtttcccctgacatgcccgtcactctaacnnnntctctttcttttatgtagtagcaaaangngtcaataatcctttcngganaggnactatttcggtnccncccaactggggttcaccatanacncgatccacaaatgggattggggcctcgccaatggngtagttnggcngngttgcccgggcggtcatctccgtcnggggggngtagcctttggggacanatttnncngttaantnctctagaacttcttttcggtataatcngaaacttcctgttaaatcagatgctcctggtctcagcaagatcngggttaaaanattggccccacggcngnttatttttcttttcaaatcccagccatatacacctccatttcctttgtagcgagttccagagtcaatatcaaaattaccctccttttgcgtccnaataaattcaggaataaattttggagggtgtgagagatcagcatccataataatgatgtagtttcctgtggttttnanaantccatgaatatatgcagttcctagtcccaactttttctctcgtggncttagaagaattctgtctgacccatagatcttctccaactgttcagcaacatcccttgttccatctgggcttccatcatctntgattataatttcatagttgattccactctcggagaagcttttcnccagcagccncacggatgtgcggcnggntctcgcgctcgttgtaggtaggtaaagcaccgaatatttgttctgtcggggnctgcgcact

SEQ ID NO: 706675 - DNA, 778 bp, Homo sapiens
gggtgaatacacttccttcctgcggggcacagaagaatataaaaaatttcatttttaaggccgccccccccttcttggtctccgaagcacccccaacttctttttgtgcccaaacaacctcattaaaagacggggaagaattgtgggtgtgtgccctcaccaaaaattggagtggggggaacacacactactcgtcgggtgacaagaaccccgctctcttctattataaatgtaagttgtgttttatcttccatatgggagacacgcgcgtagccacccacacgcgtatatgttgctttgtgtaaaaatgatgtgcaggggagaactctgtttacaaacacatcatcgcgcgtcgtgtgcgcatatatatgtgcgcacacgttgccccccgcccacacatacgtgggcatgtcttaagagtggtgctgcgcgcatggtagtattgcccgcacgaacagcatcgcgtgcgagtgtatacatatagccccccgccgtgaatttccccgttcttgcacacactcagtattttatttatgtgtgcgccattccgacgggggtgtctcttgtggtacccacacatgtaaccgattttcttgcgtctacatgtgtactctcgcgcctattcatagaatcttctgttcaccccgctctaaaacactgctttcatagccgccaacttggctcctcccgagaccccgtccaccacgtggcaaaatctatgcttcttctcctacataacaacaacaggaccccaatctgacccacaattgacaaaaaa

SEQ ID NO: 706676 - DNA, 369 bp, Homo sapiens
ctcatctcctgacctcgttgggatacgttatggtgacagaagagaagaatggtgtcgatggggaagccagagccggttgcgggactccgggactgacgaccaggaggaggagccgctggagcgggacttcgaccgcttcattggagccactgccaacttcagccgcttcacccatctggggtctggagaccatcccttgcccggatgccacagtgcgatggggcttaacttaggccaagccttgcggcaagaaatacacgcaaagttccccaagaactgagaaccagagctagaaattcaaagctgaaatccctatcaagcagataaccagctctaagaaaccgattccatcaaccccaattaaggagc

SEQ ID NO: 706677 - DNA, 495 bp, Homo sapiens
tattttaacacgagtgttccccatttgggtccttgaccccttatttgggccttaggagttgcaaaggggcccttgtatccccttggttgtaaggcccctggacaaacaaaggtggccaaaattgggaggcatggccctggggtcccagcaatttggtggggaatctcgtttttttttttaaaacttttggggaagggtttgactcccgaacatccccgacgggtttcctttttttttggggggccttgggacacctgccctgccccccagagggttaggattgggattttttttagggccaggcaggtgcttggacttttcccctgttggatggggactggggatgtgggaggggacccccagggggatttattttaggcctgtgttaaaaggaaggtcccctgtccccctccccctttttccccccccctccccagggtcccctcccctgtcccattgtaattgaatttcaggataataaagggtttgcctcca

SEQ ID NO: 706678 - DNA, 103 bp, Homo sapiens
tctagaggatcaccggtatctcttttccggacatgcttcgagtactaattttaccgcccggacagctggtgctttcgggggagctggtttgctgccgcctgcg

SEQ ID NO: 706679 - DNA, 803 bp, Homo sapiens
  misc_feature (401)..(401): n is a, c, g, or t
gttagctagtacgaggcgggtgtagtgtacgccggactcgattcctgtaggcaacagtgcccttaaggtcggcgacagcctcttctgggttcactgcagtccaaccggttccctaccctctgccattatgaacatccgcaacgctcagccagacgagctgatgaatatgcaacactgcaacctcctttgccttcctgagaactaccagatgaaatactatttatatcatggcctttcctggccccagctttcttacatcgctgaggatgaggacgggaagattgtgggctatgttctggccaaaatggaggagtggacaaccccccaaaggaatgatgtcccgcatggccatatcacctcactggccgtgaagcgttcacaccggcgcctcggccctgggncgccccccccccccaaaaaaagggggcaaaaaagccctgaactgggaccaggtcctccagggccatgatagagaactttaacgccaaatacgtgtctctggcccaaaacccggggggtttttccaaagggacagagtaagccggccagccttgcacctttattctaacaccctcaactttcagattagtgaggtggaacctaaatactatgcagatggggaagatgctttttaaacttttggccttatgcaaacgggccgggggcaattcctcctccgcagaatggcagatgagctgagacgacaaatggacctgaagaagggcgggtaatggtttgggggggtttcaccctttttggggggcgggcctttccccaaagggggggcaagaaccaggagacca

SEQ ID NO: 706680 - DNA, 502 bp, Homo sapiens
  misc_feature (68)..(69): n is a, c, g, or t
  misc_feature (72)..(72): n is a, c, g, or t
agttgcgttgttttttgtttattagtgaaaaaaaaacacccccccccccccccccccccaaaccccgnnatnaaaataataaattatatttttttttttgggggaggggcggggcgccctccccccctcctttttctttttttcttataaaaaaaaaaaaaaaaaaggggtgttatttcctcctccttctattaaaaaaaaccaccccccctctctcttccccagaaaagaggtgtggggggggaaccggcccccccccccccccgcggcgggggaaaaaaaatcttgggggggggaaaggagggggggccccaccccccccccccccaaaaagaggggggtctcaaaaaaaattttttttttttttttctgtaaaaaaaacttctcttttttccccctttgaaaaatttaggggggggttttttaaaaaggggaggggcttaaaaacccccccaaatttggccccccggggaacaatagcctttattttcccaagtaagtt

SEQ ID NO: 706681 - DNA, 85 bp, Homo sapiens
aagacagcagcatatatctctgcagcgtctgtagcgggagttcttacgagcagtacttcgggccgggcaccaggctcacggtcac

SEQ ID NO: 706682 - DNA, 609 bp, Homo sapiens
gaaaaaaagaaccagtttggatacataggtatggtctgagtctatgatatcaattggtgttcctagggttatatcgtagtgagcatcacccatatatttacagtagtgaatagacgtagactacacgagcagtatttgcacctccgactacctataatgcatcgctatcccgcaccggcgtcaaaggtattctagcatgactcagctcacgactccacggaagcaatatgaaatgatctgctgcagtgctctgagcacctaggattcatctttcttgtcactcggatgtggcctgactggcattgtattagcaaacgtcatcactagacatcgtactgacatcgacgacagtactatcagtcgtagctcacgttccatgtatgtcctatccatgtaggagctgtatttgccatcataaggagggcttcattcactgattgtccccgtattactcagtgctacaacccatagtagcactataaccgtactgcgcaaatagtccgatttgcacttattcgataatttcatctggcggttaatctaacgtttgcgttcccgacagacagcgtttgctcgggacttatccggaatgccccagacgtatacgtg

SEQ ID NO: 706683 - DNA, 430 bp, Homo sapiens
cgttatcctatagatacgtatgacaaaaaaataaaaacaaacagatggtgaaatggacttaaaagcacaattcttggtatctgggaacgtttcactgggcaacactaactgtatgatacagacgttaccgggaacagtagtttatgtttctcttcctatccccaaagaagcacaataaaaaaaatagacgcaaaagggaggagggtgtagtttaccaggttatttcagtgcagcctgtgggaatgaatacccgggccacagtgagcagtgcccttggctgtataccccaggctcctgtatgtggtgcgatggtaatatccaagagggtttgacaaaagagagtaacctactaaaggtatccaaaaaagggcctgaggaaatcgggttaaaatgtataaccttgtatggctactgatctataggagtggtg

SEQ ID NO: 706684 - DNA, 436 bp, Homo sapiens
  misc_feature (380)..(380): n is a, c, g, or t
ggctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagantcggccattgcactccagcctgggtgacaagagtgaaactccatcaaaaaaaaaaa

SEQ ID NO: 706685 - DNA, 378 bp, Homo sapiens
  misc_feature (3)..(3): n is a, c, g, or t
  misc_feature (61)..(61): n is a, c, g, or t
  misc_feature (310)..(310): n is a, c, g, or t
  misc_feature (313)..(313): n is a, c, g, or t
  misc_feature (372)..(372): n is a, c, g, or t
aanaaataaacaggcactcacctttcaaaaagatactcaagtgtattaatttttaaacttntctgtaggtttaaaatcttatttatttatttttttgagatggagtcttgctctgttgcccaggctggagtgcaatggcatgatctcagctcactgcaacccctgcctcccaggttcaagccattctcctgtctctaccttctaagtagctaagattacaggtgcctgccaccatgcctggctaatttttgtatttttattttattttacttttttgagatggagtctcgctctgttggccaggctgggntgnagtggcaccgatctcggctcactgcacgctccacctcctgggttcacgccattctcctnctcagc

SEQ ID NO: 706686 - DNA, 5495 bp, Homo sapiens
  misc_feature (308)..(308): n is a, c, g, or t
  misc_feature (323)..(323): n is a, c, g, or t
  misc_feature (329)..(330): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttggacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttctttttaattgctcatttgtaaaattgtcctaatctttcctagctttttaatagttaatattagaaactctttactattaaaaagctaggaaagattagaaactctttaatagttttcctttcagtttgtgagctcttctctgtcgccctgaagggtcactgtattctgtatgaatgcatggcatgatacaactaatttaagagtcttttataaataaagtttgcattaacta

SEQ ID NO: 706687 - DNA, 5901 bp, Homo sapiens
  misc_feature (308)..(308): n is a, c, g, or t
  misc_feature (323)..(323): n is a, c, g, or t
  misc_feature (329)..(330): n is a, c, g, or t
  misc_feature (5716)..(5716): n is a, c, g, or t
  misc_feature (5770)..(5770): n is a, c, g, or t
  misc_feature (5811)..(5811): n is a, c, g, or t
  misc_feature (5825)..(5825): n is a, c, g, or t
  misc_feature (5843)..(5843): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttggacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttctttttaattgctcatttgtatagttttcctttcagtttgtgagctcttctctgtcgccctgaagggtcactgtattctgtatgaatgcatggcatgatacaactaatttaagagtcttttataaataaagtttgcattaactatacctgactcccaagatgctccatatcatggagtgttgggcagcaattttttaacttttggtaccagctgggtattcagccagttagagaaaggttaattactgcttacagagcttccctttttcttggctcacagacttggagctgtcttttattcctttggaatggaaggaactctccttccctgctctccacaaacagctcctagggagcagaaaaatctcatccttccttgttttgagattttggtcatgatttccctccaattatcaccagtcgtttcaagaagctcttgagcatcctaccactntgctgaccaaaagcacacaagattgcgcccagagattggctgggcttcagaggntctcacactacaactaagattgtgttcatttgacctaaggnagttgggaaatctntaagggttgctgcttggnttgataaagccccttttgtccccagcttacaattgctttacattcaatccgagtaggg

SEQ ID NO: 706688 - DNA, 933 bp, Homo sapiens
caacagggatgatcgatatgatagagggagggccctggtcgcatgtccactatcaactaggcatgtcccacatcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaacta

SEQ ID NO: 706689 - DNA, 297 bp, Homo sapiens
  misc_feature (12)..(12): n is a, c, g, or t
  misc_feature (38)..(38): n is a, c, g, or t
  misc_feature (54)..(54): n is a, c, g, or t
  misc_feature (64)..(64): n is a, c, g, or t
  misc_feature (153)..(153): n is a, c, g, or t
  misc_feature (203)..(203): n is a, c, g, or t
  misc_feature (248)..(248): n is a, c, g, or t
  misc_feature (261)..(261): n is a, c, g, or t
ccttttgcggtntcctagccacactgaaccctgagatncttattcccgaattcncacagggccncaatgtgcagggttcagccctggggccatatcccttttcacctgggttggtgagcatgtatttggagtggtttcttcctgcatgtattngccaaggaaggacaagggactagagggtctgagttaggtccagacttgtnccctttccccagcccatcacaggatgctgggtgcacacccactcntactgacgatgtnccaccaacatccaggaggcgttctcccaaggacttt

SEQ ID NO: 706690 - DNA, 5036 bp, Homo sapiens
  misc_feature (308)..(308): n is a, c, g, or t
  misc_feature (323)..(323): n is a, c, g, or t
  misc_feature (329)..(330): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttggacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaaggtacctgtccttttcttctgtgcagttcagggaggtaagtccacaagcaggtctgaggccaggctgggccaacagagaggctggttaagtcttgcggtaaggttctggaagctgattcttgacctgcttgaacctggccttttagacaatctgttctccttcctcaaaaaccagatgaccggagtctcttgaccccttggttccaaacaagcagttctaagggggctcttccaacaaattgtccccagaaaatctctcacgccgcgtcgggggcccctttcacgggtttaccaac

SEQ ID NO: 706691 - DNA, 4360 bp, Homo sapiens
  misc_feature (308)..(308): n is a, c, g, or t
  misc_feature (323)..(323): n is a, c, g, or t
  misc_feature (329)..(330): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttggacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctatagggtcttaggggagagagaaagagagagaggaaaagcgatgaatacttttttcatcaggttgagtgggtaatataagagtctgtcactctttttgcttaacaaccttcgcttaaattagtttcttggtcatttctctttcctttccacctgtcttaaaatatgtggcagcctatcaaccagaagaacgggcat

SEQ ID NO: 706692 - DNA, 3534 bp, Homo sapiens
  misc_feature (308)..(308): n is a, c, g, or t
  misc_feature (323)..(323): n is a, c, g, or t
  misc_feature (329)..(330): n is a, c, g, or t
  misc_feature (3453)..(3453): n is a, c, g, or t
  misc_feature (3461)..(3461): n is a, c, g, or t
  misc_feature (3479)..(3479): n is a, c, g, or t
  misc_feature (3483)..(3483): n is a, c, g, or t
  misc_feature (3486)..(3486): n is a, c, g, or t
  misc_feature (3488)..(3488): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttggacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattctgaaccagancgggtgtntctcccccttcgtgctgnccgnatnangtcccacaattcctattccagttcccggggggctccaccagtctcc

SEQ ID NO: 706693 - DNA, 526 bp, Homo sapiens
  misc_feature (109)..(109): n is a, c, g, or t
  misc_feature (121)..(121): n is a, c, g, or t
  misc_feature (125)..(125): n is a, c, g, or t
atattcacattatcttataaactgaggctgactcataagcaaatgaacaacgggtggaagatacctttctataaacttctaacactggttatgtgacattccacatatngaaatagtcaantacncatcaaagagaggagacttagggtggcaaactcatgcaatcttataatcagaaagtgtaaaagagaagaaacctcactttggtgatgtaccttagtcatgatctacaaatacccaaatgctgtttttttctaggttaacactgtgctgaatgactgcttggatgatcaaaataaaggtattttttcacgtgtacaggaggggataatggggccgggtgcggtggctcacacctataatcccagcacttcaggaggccaaggtgggaggatcccttgagtccaggagttcgagaccagcctgagcaacatggcgagatgccattgctacaaaaaatttaaatatcagccaggcatggtggggtgcgcacctgtagtcccaactactcgggaggctgagatgg

SEQ ID NO: 706694 - DNA, 2247 bp, Homo sapiens
  misc_feature (308)..(308): n is a, c, g, or t
  misc_feature (323)..(323): n is a, c, g, or t
  misc_feature (329)..(330): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgctctagaagactgtccgtggatgagtttagtgtacagacttgtaaacagctgccccctctctgctcagtctagttcccagatccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaacta

SEQ ID NO: 706695 - DNA, 1708 bp, Homo sapiens
  misc_feature (308)..(308): n is a, c, g, or t
  misc_feature (323)..(323): n is a, c, g, or t
  misc_feature (329)..(330): n is a, c, g, or t
  misc_feature (1558)..(1558): n is a, c, g, or t
  misc_feature (1642)..(1642): n is a, c, g, or t
  misc_feature (1653)..(1653): n is a, c, g, or t
  misc_feature (1691)..(1691): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacaggnagaagcaaaagcagaaagccctgataaacccatcacatctcgtgagacttcttcactatcacgagacagggtttcaccatcgtntccacattggnctcagactcctgggctcaagcgatccacccaccttggnttcccaaagtactgggg

SEQ ID NO: 706696 - DNA, 609 bp, Homo sapiens
  misc_feature (477)..(477): n is a, c, g, or t
aacgaggtagggacctgggctgggggaagagggagggggggggaaatagatggaccccaaattcagggtgaacacagctccattctggtatactcttccttgggactcctacttttcttctaaactctcggggtagataaggtaatccttatgggccttagagatacccaagatattataaaaccagagctgttatgtctgtcaccagcccggcaggaataatccaggaaccggtggtacatgtgactggtccgaggtagaaatgtctcagctagatccccaagtgggggggtgaaaggtgtgaacagaatgggctgtaaaactactggcctggcaaggtcaagtacatttaaaagaggcagaaactgggatctggcttcttttttcatcaggctggtcagttcagggggtgagagaggagaagcttacagcagcggaggggtccagataaactagtccttacctcgttcggacggngctgaggagagggcggggctgctggggtagcggggcaggctggggggctggcggttggcacgggccccagagtcagggcaccacaaggcggtaggggctgctgggatgtgccgtcccccatttgacaccagt

SEQ ID NO: 706697 - DNA, 183 bp, Homo sapiens
aagccgctaactcgttctatcgccgattcttgtacttcgccgcttctcgttcttcgccgcttctcgttctatcgccgcttctctgtacttcgccgcggtctctgtccttcgcctgcttctcagttcttcgcctgcttctctgttcttctgcctgcttctcgcttcatggatccaatgtcctgt

SEQ ID NO: 706698 - DNA, 401 bp, Homo sapiens
  misc_feature (20)..(20): n is a, c, g, or t
  misc_feature (79)..(79): n is a, c, g, or t
  misc_feature (100)..(100): n is a, c, g, or t
  misc_feature (106)..(106): n is a, c, g, or t
  misc_feature (109)..(109): n is a, c, g, or t
  misc_feature (233)..(233): n is a, c, g, or t
  misc_feature (243)..(243): n is a, c, g, or t
  misc_feature (283)..(283): n is a, c, g, or t
  misc_feature (306)..(306): n is a, c, g, or t
  misc_feature (308)..(308): n is a, c, g, or t
  misc_feature (313)..(313): n is a, c, g, or t
  misc_feature (331)..(331): n is a, c, g, or t
  misc_feature (380)..(380): n is a, c, g, or t
taatcacaatttcaagtttngaaatgaaaaaaaggggtagtacctgttcttgatcaactgtcatataaagtcaaaagtnaatcactttcagaacatgcanttaaantanagcaaattgcacaacagctcgtctttgaaaaatcctgcactgaagcttatgaagaacacaccttttttctggacaatttaaaaggaaacactgtagatgtacaaggaggtctccttaaaccaantgaacctgtnaatgtcatccggataaaagtttcatcttgaccaaagtaancatatttatgcacaaaaaaaacntntcttnacacccgctgtagcttgnacatacttcaaaaatacgtgaaagtgtaactgcatcacagcaggtctgnttaataccgagggtcaacaat

SEQ ID NO: 706699 - DNA, 1193 bp, Homo sapiens
  misc_feature (308)..(308): n is a, c, g, or t
  misc_feature (323)..(323): n is a, c, g, or t
  misc_feature (329)..(330): n is a, c, g, or t
gagaagaaacgtcaagtggtcaagccctgcaggaggcattgatgcgatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcantaaaccattcctagntgatgnngacacactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggtaagtcagaacgaaatcaagtggaaaatagttaaatgttctgtcagtctctaagtcata

SEQ ID NO: 706700 - DNA, 217 bp, Homo sapiens
ggccaccagcagacaacataagaacggaaatacatgttacgatcactaccttctgacttatgaggtcaaaaaaatacacagcattataaggaataagaatggactaagggcgggacacgggggctcaggtctgcaatcccagcacttggggaggcggaggggggcagatcaggaggggaggagtccaagagtagccgggccaacagggtgaagggta

SEQ ID NO: 706701 - DNA, 275 bp, Homo sapiens
ctgaaaactgcaatcgtttccaagcagtgacatttacatcccagcatgtacgaggtcgatatgtgaggttatcacattccaatgttaagggttatctcatactcaccaacatttgttattatcttttttattcaaaccatcctagtgagtatgaaatggtatttcattgtggttttgggttggctttcctcttgtctagtgatgctaagcaccttttcaagtgcttatttggcttttgtttatcttcttcagaaaggtatctattcaaataattt

SEQ ID NO: 706702 - DNA, 111 bp, Homo sapiens
gaaagcgttcaagctcatcacttcttaccctaaaaaatccaaaacatataactgaactctcacacctaattggaccatcctattaccctataggaggactatgttaggata

SEQ ID NO: 706703 - DNA, 252 bp, Homo sapiens
gcttgagatttcttgttttgaatttcctcgaacatggatctgagcctggccacgagagaacaggtattcgtcccgggtcttggccttcaggtaccacatggctctccatatccttgctggatttactgtgtgccacatccagcttgcctcattgcctcctcgatttgactgaccagcttctgccgtacggcggtgctccgcctctcggtctcttgcgcggaatcgttcatgcctgttccccagctcccgccg

SEQ ID NO: 706704 - DNA, 1194 bp, Homo sapiens
accaacgggccactaacgggataacagagcacagagggtcgagctcacggtggaatccatagtagctattaaactatctactaactaggccaagggaagcgataccattgttagaataaagtattcggtctcgagagtcagggacccaagtgcatagtagattctgggagctactcggaacccacaggcaggcacgctgcagtgaacaagccgaggtgactgctgtatcgaagccgtgtagctaaggctgcatgttcaagagcggaatttatgcaatcaagacacactgactgagtctctgaagttgaactggctgctattgcgctttaaatatcatgtattcgcagcttgggatgacgctaggcaagtgatgttccgagtaatgaagagattggatcggctgggcatgcggatttctggaggggcccactggcagccaaaggaccagcatgggctaagccaggtgagctcgccgtcttacgcaggagtttgtcgggaagagcgattccagttgatagaaaccgtactacttgccaggcctcagcgggatctgttgtgtatatccgggtagctggcacgtcaggaactctggggcaaggtccgcgaggctggtgaatggcattgataccctactcactgtgtgcatattcaccatgggaaagtttgccctaatgggcaaccctgacaggatcgattgacgatgtgctaggctctaaattaacccgttcctaaacggcttggctgggtttcatctatactgagtggggttcaacatgagaagggctaatcgcacattgcgggcagagcaaacctctagaacctccggaaaggacgtaaaccggccacgcagacccctagcgcgtccaccacaaatccgtggcaaaccacaaatagcaaaagcccgccacggcacccacgtgaaccacggcacagcgacccgggtgcgcgccccacgaggaccccaggtactacagagcggctaggatagtacccgacacgagcggggacagcaaaaaaaaggacgacagcggcgggggaacaaccggcaaagaggcgatgggtagcaggccacggcccaaacacctggaaacgacagacagaggtaagtccaccacaacaagcgaaacgcacacggaacgacggccggcagtgagacacaggacacagcgccaacaaagagagagagaaacaact

SEQ ID NO: 706705 - DNA, 143 bp, Homo sapiens
gccgattgccgtgccggtgatcctcgccggtgtgcgcaccgccgtggtgatgaacattggtgtgatgaccatcgccgccaccatcggcgccggtggcctgggtgtacttattctggcttccatcagccgcagcgacatgttcg

SEQ ID NO: 706706 - DNA, 140 bp, Homo sapiens
gattgcagctcatgaaggtctgagtaagttcttcagtgaagcgatactctgagtaccacagtgaccagccgtccttatcaaagtactccaatgaggacacactctctgtggcactgccatatttctgggagcactttgat

SEQ ID NO: 706707 - DNA, 200 bp, Homo sapiens
aaagctgagaaggagaagcaagccactgagaacaaggtgtgggccgggccagcttgtcgggaagggccctgagcaggggcaagcttttagggccaagtggtgcaggtcccaccccggctcttctaaggctctgcttttctggccctggcatgttcactgcctcttctggggctcagtttctttatctgtcaagtggggtt

SEQ ID NO: 706708 - DNA, 704 bp, Homo sapiens
caaaaattcactgagcatgccactgcaaactcgacacttgcatcttgtgcccccatagaacttggggatggacggcatgcacttgggcatatggtataataggatcattacttgtgactacttaacgcttagactcatcatttggtgctgtctgccaaacattcagcagggtatctcccaataaagtgttcctaagtcgggctgtatactggaatgcaaggcaggctatcaaattttaggtgaaatgagtccgagtatccatgtaatgtgtttgctgtactaagacagtaactgtacatgtggtacaaaatgctccaggttccttaagtctttgtatgctgtccatgaatcctctgtggcagctgtacatcacagagccagaagccagacggcgcgcagggactatgaagtaggctgaccaaacatcatggggacatctgggtggcggacatccctgttgatgtctcgttgtggcccatggagctattatggctggtcttgcattagcttgaacttgaagtgaagaaccaatttttgctacttagtcttatctctccatgacttagaatggtcagtaggctactgagtgagtgctgtatctgaataggctggatcgcacagtgaatagaaggtgggcactggctttcaccggaaagtgaactggtttcagagaccaagagtccctgctcagtgtccgggaaaga

SEQ ID NO: 706709 - DNA, 111 bp, Homo sapiens
ccgacggggttcttgcagcagccagtgccttcttctggcacttggttctcttcttagtcagccctttttccttggagccagtgtccacgaagacgagtttttcatttgggg

SEQ ID NO: 706710 - DNA, 665 bp, Homo sapiens
gtagccagttgttgtgtgtctgggtggccaaagtccatttgtgtcatgttcctaattctctgttcccacataaatcttttaaagtcataaatgaagccacggtccctggccagtgaattcgcaagcatctagatctccgattcagttccagttctcatccatgatgcatgccgttacagggaacgataatcttaatatggagtctacttgtggcttactctggtcgatatttggagatccaattgtggatggtcgatctgttaaagaatttagccctcagcgtatcctttcgtaccgtattgtataattcggttttgcgagcttgataatcgagcaggcgagaataggaatccgtcgcaagctgtatgtatccagcccacagacagctcgcgatgcgctgacccctggagaagaagagttgaattgacggcattatatgagcaaaatgtgaaagccgatagtggatttatcctgcgagctcatgtcagcttctgtgcctgtggtagtaacgaagttagaggccttgaccagttgtgcattcagcagctgctgtcgtgaggtaaggaggtgcatcctagaaacgagcctttctacttgaggtcgggggagcaacggggaggacttgcgtcacacgctggccttgggaatatctaggtgaatgactg

SEQ ID NO: 706711 - DNA, 302 bp, Homo sapiens
ccgtcctctctggcacagtttccatcacaacacggaattagtgcatgtggagggcgatgtagtaagtgctcccgccgccctcctccccttctctccttcctcctcattctaacgctagctgctggccatgcccctccagactgccccttgggggttggtttcttgttagctttgagttgctgtgtgctgagtgggtgccgtctggcaggccgtgatactgacggatgcctactggcatgtcagctgacctagggacagaggagggaggggagaaacattggcggacgtggtaccgagctcta

SEQ ID NO: 706712 - DNA, 418 bp, Homo sapiens
agaataggcgatcacaacgtggcatagtagctactttactataagaggaatattagaatctagtctcaatgctacataacggatcagaaatacagattattgatagccaagcgacgttagtcgatagagctcttgtgaggaaagtcattgactttatcctctttaaccttcgacggttggggtgggtcatccaaagcatggggtctgtaccacatctttctttcttcagcacatttcatatcctcagttctgtcacaaatggttgtattagcatgttctctcatcatttcacataatcatactatagtggactcaaaagcatcataaatgctgtatcaaaatcagcccaataatagtcaactaggatatctgcctttatagtgttagacattagcctgagtaaaaaggcttaaaaatt

SEQ ID NO: 706713 - DNA, 1079 bp, Homo sapiens
  misc_feature (4)..(5): n is a, c, g, or t
gaanncctttttgatgtatgtgtgtgtctgattgtagtgatgcactacaaatgataaatactctaatgtgcaagaggccgtccaacggtgcccgcctatttcttagacccctggtattcgccggtacacacctggggtaatgtccccctttgtgtccaaagggccaaaaaaggggacccttttaagaaaggggtggagtgccacccgggtgtgccattaaagattgggaaaacccttgtccccgggcccagggcccacaatgcatctggaggttttcaaagttcctgtttttgaaaggagatcttccgatttgcccgaaatggtggaagtgccatttaggaaattccactgtggttttcccgggagatatttcccgggtgtaaaactcgcccggacttaactttccctggcactggatttttaaaccccgcggacccaaaatgggggggtacactggggccccacaagaatgcgccccgaccccactgagattggaggcttcaccctttgaatgtttccagagactatcccgcatggttatactttggctttcgttctgttttctgttgtgtgggtttttagactataaaaaaacgcccacacattcacgatacgcgagagagccttcttaagggctcacgcacccccaacacggttccgccccaattccggagaagaagagtgatggagaattcatgagacccgcaagaaggggcacgagccacatgagacttgaaaagaaaggggtgtccataaaagtgagtttcccagagcacgcacttggaaaagacactagaaaaggcttgcccactctatttattcctcctccactgagtgttcttcgttagagaaaagttaaaatgcctgtgagagagccccacagtttgaaattggggaagctcctctggaggctttcactggtggaaaggcacctaagtttctgggaaagacccctcggggacgcaaaccggtgctaaagattggacgagctgatggatatggaccccccctcccagaaatctgttttaagattccagacttccaattagtggcccaattaaaagtgctatttgtgtgat

SEQ ID NO: 706714 - DNA, 404 bp, Homo sapiens
aatttgcttccctatgttgctcatgaattgggtcataatcttggaatgaatcactcgtggagagatcgtacctgtggcagcaaagagctgcatcatcgaatacaggagcatcgggttccagaacactttagcagtagcagtgcagaggactttgagaagttaactttagataaaggaggaaactgccttcttaataattccaaagcctgatgaagcctataagtgctccctcctgtggtaataagttggtggacgctggggaagagtgtgactgtggtcactccaaaggaatgtgaattgacacccttgctgcgaaggaagtacctgtaagcttaactcatttgctgagtgtgcatatggtgactgttgtcaagactgtcggttccttccaggaggtactttat

SEQ ID NO: 706715 - DNA, 117 bp, Homo sapiens
tgggtggtggttggtggaggggtggttgtggtggtggttggagggctggggtggtggttgggtggaaagggtggtcgtgctggttgggtggagggctgggagtggtaagttggaggg

SEQ ID NO: 706716 - DNA, 915 bp, Homo sapiens
attgtaaatgctcatttatgtgttaatgacattgaaggtacatttattagtaccaaagccatattatgagttttctgtatagctaggctttagaaagattgattgactgtagagaaatagttttataagaaaatgatatttttattcagtaatttaattttgtagatgccaaatgaaaaacgtttatttgctgctatggtcttagcctgtagacatgctgcggtagtatcagaggggcagtagagcttggacagaatagaaaagaaacttggtgttaggtaattgactatgcgactagtatttcagactttttaattgttatatatatatacatttttaattcgcttctgcaatacattctgaaaacttgttgtgggagactctgcattattagatggtaggttgactagtgattagtaggtttatacaagcatgcgttgcacttctttgtggggagatgtgtgtagtcgatgttcgtatgtaggtttcgagtgtaggctgactgttttataatttgggagtgctggcatttgatccggatcccctgtggtttctaagtgtatggtctcagaactgtggcttggatcctgtgtttagaactggggagacagaaactgtgggttcgaatagccagtcacgtgcttgagaacatttgatgcaatgatggccgagcactgaactttgagatatgacggtgtacttactggctggtagcaaaataagatgtggccccttaattttaccgtaaaataagaaaagcaacaaagcgacggagggcacttgtgtccggcagtagtggaacaccgaaaagtttctcagaaacgcatttggggaccgggcaccaaaagtgacggaaaaggggctaagggtcccagagagacggggcaaacaaacaggcgatgacgaaaaaaaacg

SEQ ID NO: 706717 - DNA, 452 bp, Homo sapiens
ctatagtcattgtatgccaagttggctcaacaagtcgattgagtgcaaaagctgtagtattgtgagagaagcctgtgccctgatccgagtttactctactctctcaggtgacactaaattcccttctcatctactactcctccagagaggtgactgtgcgcctctgcctcatgtttgacgaacctttaacccaggtcttgagcaacaagctgttctgttccatagagctgtaagccaaagcagctgctgtggattctggcgctttcgcgtctacacgggaatacgtctgcatctccacccaagcatccactccgatctccttctctgtgtcatgtatgctcttcttctttatccgggtttaagtactctcctgatatcgaagtgttgatttctgccttcctagcgagtctccataagaaaatttggccccggagcaggatgattttggacta

SEQ ID NO: 706718 - DNA, 214 bp, Homo sapiens
gatccagcgcatgacatcttggagatgtacgcgctggtatgactggcttgtgacttcgtgcttgcccttgccactcttgggtacctcactccacatctcctttcacgttctccagcaccatgtcgcagtgcctatcgagggccttcacgcggcccaggagtttcttattcgttgcggcagtggatgagcacttgcgctcgtcccgatggcggca

SEQ ID NO: 706719 - DNA, 284 bp, Homo sapiens
  misc_feature (21)..(21): n is a, c, g, or t
  misc_feature (172)..(172): n is a, c, g, or t
  misc_feature (180)..(180): n is a, c, g, or t
gctagtattgagataccaggncacaaaggtcaataaaaagcttcatataggctgggcacagtggctcatgcctgtaatccctcactttggggggctgaggcgggtggttcacttgaggtcaggagttcaagaccagcccggccaacatggtgaaccctgtctctactaaaantacaaaanttagctgggtgtggtggcatgcatctgtaatcacagctacttgcaaggttaaggcaagagaatcacttgaacccgggaagcggaggttgcagtgagctgagatt

SEQ ID NO: 706720 - DNA, 239 bp, Homo sapiens
gcagctggagctcagcaggccccttttgccgtagcaaaaccctgtgcgggtcaccactgccaggactgtgcggccccacatcggacccgggcctgcaagatgagggtcccgcacgaagagtgtgtgcctgccggtgtgtctctgcacagtagggccccaaacccctccggcagtgccgacttcagcactggaatgctctctcctgtcagagagcacacagacaccaatgcacccaggaa

SEQ ID NO: 706721 - DNA, 284 bp, Homo sapiens
agttaagcattaaggccttggcacgcagcctccgtctccggggctctccgggactagctgcaaaacttatgctctaaacatttctagttcccccaaacaacctagaggccttgggacttcacatcccccagcacacaagcctcaccacccccttcacatcccccctccattgcttgttccagcatcttggtgaaaggggcatcagctctggtgtccctgagagacgagaagcctgtgggaacgacagaagaacatggcatttttataaattatttttttgaaat

SEQ ID NO: 706722 - DNA, 316 bp, Homo sapiens
gaggcgctctagacgatcccttataggttcgcaggaacagatgaacgatgtatctcctttaaaaacaaacaaacaaaaaaagacagtttccctctgtcacccaagctggagtgcaatggtacaatcttggctcactgcaacctccacctcccaagttcaagcgattctcctgcctcaacttgtcgagtaggtgggattaccggcacgctccaccacactgactaatttcgtatttttaatagagacgaggtttctccttgttagccaggttggtctcaaacgcctgacctcaggttatccacctgcgaacctatga

SEQ ID NO: 706723 - DNA, 307 bp, Homo sapiens
tcttgccgccggagacggtcctgctgctgccgcagtcctgccagctgaccgacgatgtccatccacctagtctagccgccgccgcccctgcgcaacaacaacaacaactgcgaggaaaatgagcactctctgcccccgccggccggcctgaacagctcctgggtggagctacccatgaacagcatcggtggcactgataatggcaatgggaaaaatggggggctggaacacgtaccatccttgtgcttcaaccccaatggaagccctgtggaaaatgctttagagtgcccaacatgattcaggacag

SEQ ID NO: 706724 - DNA, 1030 bp, Homo sapiens
  misc_feature (152)..(152): n is a, c, g, or t
  misc_feature (423)..(423): n is a, c, g, or t
  misc_feature (518)..(518): n is a, c, g, or t
  misc_feature (525)..(525): n is a, c, g, or t
  misc_feature (532)..(532): n is a, c, g, or t
  misc_feature (629)..(629): n is a, c, g, or t
  misc_feature (631)..(631): n is a, c, g, or t
  misc_feature (653)..(654): n is a, c, g, or t
  misc_feature (660)..(660): n is a, c, g, or t
  misc_feature (663)..(663): n is a, c, g, or t
gcggtgcggagcatttcggctctgagcggctgggcgaccggcgcgtcgtgcggggctgcggcggagctcccttaaggaaggtgcaagaggttggcagcttcgattgaagcacatcgaccggcgacacagccaggagtcatgagcgacagagncgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaagcattatacccggtcacggtctcgctcccgcgtcccatagacgatcacgtagcaggtcttacagtcgagattatcgtagacggcacagncacagccattctcccatgtctactcgcaggcgtcatgttgggaatcgggcaaatcctgatcctaactgttgtcttggagtatttgggctgagctntgtacancacaganagagatctaagagaagtgttctctaatatggtcccattgccgatgtgtctatgtatatgaccagcagtctaggcgtcaagaggatttgccttgtatntngaccctgtcgatgatgccaggnnagctanagnacgtgccacggcaaggacgccgatggacgtagaacagcacagagcaccacaccaaagaccaaccgccacacaagacatcactggggagaccaccatgaaaccatgccaacggaaacaagaccaagaaaaagacccggaaacagaccacgccaaaaatccacacccccggaaccgacaccagcagggcgaagagacccaaacgacaaagtagaaacgggacacaccactcacggcgcaaccaaacacacacgacaaacacagaccacactccactgaccccacgcgcacacgcgaaataagtcaacgacgcagagtgacacaccaggatgacaccggctgccaactcttccccgcatcacgataacaa

SEQ ID NO: 706725 - DNA, 838 bp, Homo sapiens
tttcgaaatttccacctcccccgataccaggtcaaggaatccccacgtattctctcactttttttgcccgctaattttcaagagtggcttgcccccctattaacaatttggacaaacttctggaacaacactattttttttttgaacaccaaaaatagggctccttaaactaatgtctttcaaataatttcatcccccccagttacccgtggataacttggctctaacaaaaattcttgtgtacaatcgcccaccacatatctttggaaatatcacctctgtggaaacattctttacaaaaacacttggtttccacacaaacgtttacagtccgccttacaattaatctcccgcgagatgtccccacatgctcttcttccacaaactttccacgcacggcgaaaacatattccttataatgaaaattttcctatgaggaaccccctcctctgtcttcacacaaagtatacccccgcccccaaacttctaaaacctaatgtaggacccccctgttggagatatactagcattttttccagaaacctatatccgcatactccggcaagttgaaatataccctatatccttcgtcgtcttttaatattctgggaacccacattcctctgaatcagaaatgatacctcccgtatatcccacgcgtggttataatctcaccacaacatgagaatcagcaccatagtacaccacacccccactcttgcggttaatcaatactcgacatacgtgcaagaatactcttcctgacacgttataaattcccttggacctacccccccccttgcaccccccgtcttcaccccaaccctttggacataaa

SEQ ID NO: 706726 - DNA, 779 bp, Homo sapiens
taaaaagggtaaccatcaggggcaaggaaaagaaagggtcgtatttccaattcattatccttattctgaagatagtaggggagaattttaagcagagataggggtgaagatggggactattatagagtggtgggactatggggcgcacaatctgggttctccagttaaggaattttttatatggtggtttggtggttgaaagatactatattaacgctggtgagaccataggggacatacgggagagtccattggccgtaatatcgtcactacagttatggtggaaaattcttatctacacacacggggtgaaacctctctacaggttttctaaatgtggccgtttatacagcaaggggggtatcaacacgggttgctattggaaaggcatatttgccactattgcgtggggggctcccaagggttgctgctggggtggtgagaaagcaagaatgcaaggctcttgggtttggtgccgtctctcctggttgttcacacacaagaccgggtatctgggcaaggtttgggggaactctaacaggtaacactctctgtgggcggggacaaagggtggactgaggctcaatcagtggagctttatttggaccacctttttagtgcagtgcttagagggaaacacgaagacatccgtggttacggtagaattcattcgggctaggtatattaacgtacaaagagaacgattctcaccaataggccggtgccgcagtgggattcaccacctggtaatccccaggcaattgtgggggagggccatg

SEQ ID NO: 706727 - DNA, 896 bp, Homo sapiens
  misc_feature (152)..(152): n is a, c, g, or t
  misc_feature (289)..(289): n is a, c, g, or t
  misc_feature (384)..(384): n is a, c, g, or t
  misc_feature (391)..(391): n is a, c, g, or t
  misc_feature (398)..(398): n is a, c, g, or t
  misc_feature (495)..(495): n is a, c, g, or t
  misc_feature (497)..(497): n is a, c, g, or t
  misc_feature (519)..(520): n is a, c, g, or t
  misc_feature (526)..(526): n is a, c, g, or t
  misc_feature (529)..(529): n is a, c, g, or t
gcggtgcggagcatttcggctctgagcggctgggcgaccggcgcgtcgtgcggggctgcggcggagctcccttaaggaaggtgcaagaggttggcagcttcgattgaagcacatcgaccggcgacacagccaggagtcatgagcgacagagncgagcagaactacggcgagcgggtctagatccagaagaagctcccgaagcattatacccggtcacggtctcgctcccgcgtcccatagacgatcacgtagcaggtcttacagtcgagattatcgtagacggcacagncacagccattctcccatgtctactcgcaggcgtcatgttgggaatcgggcaaatcctgatcctaactgttgtcttggagtatttgggctgagctntgtacancacaganagagatctaagagaagtgttctctaatatggtcccattgccgatgtgtctatgtatatgaccagcagtctaggcgtcaagaggatttgccttgtatntngaccctgtcgatgatgccaggnnagctanagnacgtgccacggcaaggacgccgatggacgtagaacagcacagagcaccacaccaaagaccaaccgccacacaagacatcactggggagaccaccatgaaaccatgccaacggaaacaagaccaagaaaaagacccggaaacagaccacgccaaaaatccacacccccggaaccgacaccagcagggcgaagagacccaaacgacaaagtagaaacgggacacaccactcacggcgcaaccaaacacacacgacaaacacagaccacactccactgaccccacgcgcacacgcgaaataagtcaacgacgcagagtgacacaccaggatgacaccggctgccaactcttccccgcatcacgataacaa

SEQ ID NO: 706728 - DNA, 915 bp, Homo sapiens
gcttattgcgatgcctagctggatggacttggattcgaagcccagttgggccgaccaggtggaggaggagggggaggacgactgatgtgtcaccagggtagctcctcaaggggatccctcgtggtccacagttgtgagaccagtcccagaagccagagctatctgccgtggagctccatctgctccgcgctcccaaggaggtcatcaacggaaacataaagacagtgacagagtacaagatagatgaggatggcaggaagttcagagattgttgcgtggaccttcacgggattgagcacccggaagggcttgcaaaagtgctgtcgcgaggaggagatgaactggaagaattccggcgaactcagagtttgacccccccggagccgatgtgtgcagcaccaatgtccgtgagtatgtctctatgacgtacatcagcctctctgaggcgctggactgccagagacggaggaggaccctatgaacaaacgtcaaggcgccagcaagatcagtagtcctgccgcatctgcacagggcgacactggaccacccgctgcccctacacaggatacgctggggcccatgcaaaggagctggccgacgcagctgggcctgtctactgcgagaaggagaagctgccgccgagagctacgagccggttgcaaggcgacgcataacccacgaccgcgccctctgtgcccgtcgaggctgcgcgacggggcccagcgcgcggggacgtcatgcaccccaccccgaagcccacacaacgcaccatccgtgtcacacctcgcgaagaccgcgtgcgaccgacctgggtagctctccgccatccggcgcaactccgatatacctgctaagcagcccggccctccaggctgccaccacacacccccccgacaacgcccccccgccactcac

SEQ ID NO: 706729 - DNA, 286 bp, Homo sapiens
  misc_feature (4)..(4): n is a, c, g, or t
  misc_feature (96)..(96): n is a, c, g, or t
  misc_feature (100)..(100): n is a, c, g, or t
  misc_feature (106)..(106): n is a, c, g, or t
  misc_feature (112)..(112): n is a, c, g, or t
  misc_feature (117)..(118): n is a, c, g, or t
  misc_feature (123)..(123): n is a, c, g, or t
  misc_feature (129)..(129): n is a, c, g, or t
  misc_feature (131)..(131): n is a, c, g, or t
  misc_feature (150)..(150): n is a, c, g, or t
  misc_feature (155)..(155): n is a, c, g, or t
  misc_feature (157)..(157): n is a, c, g, or t
  misc_feature (171)..(171): n is a, c, g, or t
  misc_feature (229)..(229): n is a, c, g, or t
  misc_feature (279)..(279): n is a, c, g, or t
tctntaaggctcaggctgttctcaaaggctttttatttacctgggagatgctcacgcctgttattttttccacactctctggcaggcgatttagantttncatttnttcccnatttnnttttnctgccncnatggtcccacttcctgctngacancntttttatcttattngctgaagttaatgggacctactgatctcctctgccactctggggcagcttctctagcntcattttcacttattctgcctttttgttcttttttttgtttttttttttntttgcca

SEQ ID NO: 706730 - DNA, 200 bp, Homo sapiens
actctcataaactttaaaaaattatgagtagctcgtacatatatctactttactgacaatcagagaatttattaaaggattacattagacagccacagtgtctcaggtccaaaattttaaaccaacgtagtatgctacaatcatttcagataccattctcataaaatctaaattacatagtatcaacattactactaggt

SEQ ID NO: 706731 - DNA, 260 bp, Homo sapiens
cacttctttttatattttcaagagggtcaataaggccttataagaagcaggtttaggtctcctccatagagagacatcctctccttaagtaaaaccttatgccacactcaataaaaaatcgatttggccgggtacggtggctcacgcctgttatcccagcactttgggagctgaagcaggtggatcacctgaggtcaggagttcgagaccagcctggccaacatggcgaaaccccatctctactagaaatactaaaaatt

SEQ ID NO: 706732 - DNA, 258 bp, Homo sapiens
tctccgacatactggagaccgcagcagctataccgacctggctgatgccctgctgaactgctgcagacttggatttgtccaactggtagatgctgcaaagcctatgaggtccagaggagctcattttatttaggtggtaggtgattcgaaacccattcggccccttgaagtgcttggattcccaaacaggtgatccaggctgggaggaaccaagggcctccttgggccccaaggattgaagggcccttttacaaggca

SEQ ID NO: 706733 - DNA, 215 bp, Homo sapiens
gtgcatgcgcaaaggcatgccctaaagatgcagctgtagtacgtcagtgttattcaagatgtcaggaactcaatgtctacatgcattccattcgtctctcagctctacttactcttgagagaagaggggcatcatattgacttaagtggacagttggaactaaaatctgtaatactagaagctttctcatctcctagtgaagaagtcaaatcagc

SEQ ID NO: 706734 - DNA, 303 bp, Homo sapiens
ttttgggcctgggccaagggccttgtgtaggccatgttcctcgggcaactgccccgggccggagttgggccctccaacggccctggggggtggttcctgcatagctagccccaacccataaagggctgtgatgagtgggtgggcctgtgctttgtttgggcccggactttgggtctctccccctgcggagggtttccctgggggtttgcccccttcctgggaggggcccccggcctgggtggggcccttttcggcagagcccccccccttatacctttggatgggataaaggttaatttttta

SEQ ID NO: 706735 - DNA, 114 bp, Homo sapiens
tggccaccactctggacactacctggccttctaacctacctggagagcctgaccaggcctgccacagagacctgagcagccaggagacctgagcatgcaggagacctgagcaag

SEQ ID NO: 706736 - DNA, 267 bp, Homo sapiens
cagactgtgttacaaaaattattaaaaatcaggtgggtgaggtggtgtgaaaccgtagtctcagctactagggaggctgaagtgggaagatcgcctgagtccaggagttcgaggctgcagtgagctatgatcatgacactgcactgcagcctaggcaacagaatgagaccctgtcttaaaaaacaaaatacatggccaggaagggtggctaacgcctgtaatcctagcactttgagaggccaagacaggtggatcacctgaggtcag

SEQ ID NO: 706737 - DNA, 686 bp, Homo sapiens
cccatgctagatgccacatcctgcccagtccacgatgctacgtgcgctcctggcgcctgcctccaggcccagcgaggcggaccctttctcaggcccaggcgccttccaggtgccttctgtacagaggaccgtatgcttcatgatgcgtttaaaggcttcatttcacatcatcattggtggtgaagtggggattgtccacgtgctcaaccataggttaaggtgactagcacttgtcgcgcgagcacctgcgtcattgtctctcatatctgatgacatctcactccgaacacatcctagttgttgtaatacccgcgaaatgaactttccagaatgcaaaaacaataacagattcagagaaccctggtcacacctgctgagcaggtcccctctactctggttgcatcatcagaatgcttgtttgctcaacaagagcaggcgctctcaacatcaaggcacaaagaaagacgtctccaggggcaagaatgatgactgaagtgaccagtcggcctctgcgaggcccgaggtcagagtcacggcggacggcgatgttcagcctgacgggcattgggaggaagagccaaggacaggtctcccgctggtggctcaagcgtcctcacgcgtacttctccaggaagttgatgtggaacgtctttcatcttctgcagcaccgttttcagcttctccaa

SEQ ID NO: 706738 - DNA, 393 bp, Homo sapiens
taatctatctcatcttgtctggatgtggaaatcataaatggtctgtcatcataaatgtaactattttaaattcaagtatatattatacattttgaaaatctgtaattcctgagtagaaagcaccatgttaaaatatttttttttaaaaaattaaatgccattatgaattaagtcagtatataataagatttgtaaggtcctgtgtttgatacctattttttgaagtgatattcaatacaatagaattgtaatacattagaaatagtagagtttgccccatagagagaagagtttgtattagtttgatggtatactgactgcctgtgtaaccacaattttcctttaatgttgaaaataatttttcttattaaaaggttaattctttacaaagcc

SEQ ID NO: 706739 - DNA, 315 bp, Homo sapiens
tatcccagcactttgagaggccaaggcaggagatcgcttgagcccgcaagttcaagaccagtctgggcaacatggtgaaaccgtttgtacagaaaattagctgggtgtggtggcacacacctgtggtcctagctactcgggaggcctgggtgggaggattacctgagcctgggaagatcaaaactgtggtgagctgtgatcacgccagtgcgctctgagcctgggaggcagagtgaaaccctaaatcgaaaagggaaaggaaaaggtctttgcagatgtaaatagatttaagatctgaaatgagataaaaagaga

SEQ ID NO: 706740 - DNA, 385 bp, Homo sapiens
catgttggtgtgctgcacccattaactcctcatttacattaggtatatctcctaatgctatccctcccccatctccccccaccccatgacaggccccggtgtgtgatgttccccttcctgtgtccaagtgttctcattgttaaatttccacctatgagtgagaacatgcggtgtttggttttttgtccttgtgatagtttgctgagaatgatggtttccggcttcatccatgtccctacaaaggacatgaactcatccttttttatggctgcatagtattccatggtgtatatgtgccacattttcttaatccagtctatcattgatggacatttgggcaaccatattttttgttgagttttgtttctttagtgcttagccatca

SEQ ID NO: 706741 - DNA, 850 bp, Homo sapiens
cgcggtggctcacgcctgtaatctcagcactctgggaggccgaggcgggtggatcacaaggtcaggagatcgagaccatcctggctaacacggtgaaaccccatctctactaaaaatacaaaaaattagccaggcgtggtggcaggcacctgtagtcccagctactcgggaggctgagactacaggcacgcactgcaacacccagttaatttttaaaatttttagtagagacgagatctcactacgttgcccaggtaaactcctgtctctataaaaaatgaaaaaattaggccgggcgcggtggctcacgcctgtaatctcagcactctgggaggccgaggcgggtggatcacaaggtcaggagatcgagaccatcctggttaacacggtgaaaccccatctctataaaaatacaaaaaattagccaggcgtggtggcaggcacctgtagtccagctactcgggaggctgaggcagggaggatcacttgagccccggaggtcgaggtacagtgagccaagagtgcactatgtactccagcagggaagagaggagacctgttttaataattaataattacaaaaagagtacaacaaaaaaatttttggcggctgactggaaaaggtttttagaaaatggtgggggggccagattgtacgtaaatggcgaagtggtccaaggatctggcttgaatgctgtgttttcaaaacgggggcagggtttgacaatcaggcgttggcttttgctatcaggccagcgcactcgcccgggcggtgtgaaaaagataggatataacgtgacagtagtaaacgacaacagtaggtggtgttagtggataggccatgagagat

SEQ ID NO: 706742 - DNA, 249 bp, Homo sapiens
tccattatttttattgcaacctctctgcctgtaagggatatgtcttgcccattttacttttgccaaattccccttgccgattgttttcaccagtctgtagtttccgatgtgcaggttgtacatctagcacagtgaggctatacgagtatctaccaccgagctcatgacgcggctggtccgacgaggtaacttcttgtacgcccatctccatgtgacgtgtggtatacactacaatgggcagagcgcccg

SEQ ID NO: 706743 - DNA, 805 bp, Homo sapiens
ggaaccaggggacgtgcacgcccggagttaggagcctcttccatcaagtggacctgatttaggaggcattaggcagaagcaagctgcacatttgttgcaagttgcagcctgcaagctaaacaggaaattcttgcaaacacaaagatgtggtggttcaacatgttcattatggcatggcagttggcaaggactcaaagatgatatcatccatttgtgcaaattggcagatgttttcaaggccaaaaacctaattgaggtcaatgcggcaaatctacatgcaagcccgtgcaaacaattgctccgtcttggcaattcttctcagaacaagtgcgcatgtcttaggattggacacatgtcaaggtagatggcgcacttccaaatgggttagacgttacctatcgaagtacactgaacttgacggacgcattacacggtgcacgttactacacacacactggcttggcgaacaatgaacggcagtatggtacttggacctcaagcttcctaatcttcttggtcgtgcagaaaaggtgacctttcagttttcctatggaaccaaaagaaacttcgtatggcctgatacttcttcaaaccacggcccggaaacttcgaaagaaattactctgtaaacttatataaagttactggaccagaacccttggagctcacagccgggagacggacagcaggaatggcagctggagtaccagtttccccatatgggaagacccagccacacgggtcaagtggcgacaggcgtctgcgcgagacactggcgccggcctctccaacgccggacgtacaa

SEQ ID NO: 706744 - DNA, 402 bp, Homo sapiens
tcatcgaaaccctgctctaccaaaaatacaaaaattagctggtggtggtggtgggcacctgtaatcccagctactcaggaggctgaggcaggagaatcgcttgaacccgggagacggaggttgcagcaagccgagatcacgccattgcattccagcctgggcgacagagcaacactcagactcaaaaaaaaaaaaaccaaaaaacaaaaacaaaacaaacacacacacacaaaaacaccatttttttggggccggcacatgggctcacgcctgtattccccagcatttgggaaggcccagggggaagattcccctgagatcaggattttgagaccagcttggccaagtgggcaaacccttgtctctaactaaaaaacacaaaggggttccggatgaggggtc

SEQ ID NO: 706745 - DNA, 156 bp, Homo sapiens
atcgcatgcctatcatatagtaaaacccagcccatgacccctaacaaggggccctctcaagccctcctaatgacctcccggcctagccatgtgatttcacttccactccataacggtcctcatactagggcctacttaacccacaaaattaaccat

SEQ ID NO: 706746 - DNA, 720 bp, Homo sapiens
tctccgtccctactggcctttctcctcgtcttcatatttgtacggtacaagcaataaagacactcatttcagaccaggaaaaaaaaaaaaaaaaaaaaaaaaaaaaaaaaaaaaaaaaaaaaaaaaaaaaaaaaaaaaaaaaaaaaaacaaaaaaaaaaaacaaaagaggcaaaaaaaaaagacgacgagcaaggacaaaaacaaacaccagcccacagacacacaacatagacgcaggcacccaggaactgagaatacagaagagagacaacaacgaaagagagacaatagcaacaaataccacgccataggcgcgcaagctaaaaacgaactatggtacgagtcataaaagtgacgagagaaaagaggacagaagaacgacagggaaagaaaggacagcaacaacctacagagggacgcagatgcaacaaaagtagacgaagaagcaccccaagctcgaacacgaaatacgcacgcacaacagacggacggaagaaataaactgaaccaacaccaagccagagagtagtaagaggagctcagttacaacagcaaagagccgcaatcaagctcacacgagaccatccatcgacgctgccagcaaagcaaagacgactactctcatccgcagagggagaatacaaaagaaggcagcgacgagaattagaagagaaacaaagacgaaaagagaaggacagactcacatacccgatgagata

SEQ ID NO: 706747 - DNA, 282 bp, Homo sapiens
  misc_feature (270)..(270): n is a, c, g, or t
  misc_feature (272)..(272): n is a, c, g, or t
  misc_feature (280)..(280): n is a, c, g, or t
gaggacacatggacacagggaggggaacatcacacaccggggcctgttggggggtgaggggcccaggggagggacagcattaggacaaatacctaatgcatgcggggcttaaaacctagatgatgggttgataggtgcagcaaaccaccatgacacatgtatacctatgtaacaaacctgcatgttctgcacatgtatcccagagtgtaaagtaaaataaaaaaataaaaattaaacacaaataacatttctaataaaacacagcactananctgttctnac

SEQ ID NO: 706748 - DNA, 867 bp, Homo sapiens
aggtgggctgggacctacacctcagtgaaagccggagaatgtgggcacgaatgcggggctttgatgacccgcaaagggcgaggcatgcaggaggtggaggaattaagtgaaacagtggaatgtgttgttaaacagcaccgtgtgggcgaggccttaagggtcgtggtccttgtcttgggcgtgtggtcttttgggcgtcgacgatggcctggttcttgggtatgtgcgtgggctactactgtgggctggttgccttgcttgtgtgaaatgcctgccctgctgcgcttcttgcccatggcgcattggggcatctgtactctatgcctaccactccatgccctgttgggcctccatccctgtgccctctgctctgatgctgctgcctggacctggttcttgccttcttggacaatctttaccggttggagggagcaaagtcctgcacactggagtggtgtactagcggatcaagtatggacactgactcagactgaggagcagctccactgcactgtgtaccgaggagacaagagccaggctagcaggcccacacagacgagctggagtgcgtgcgcaagtaccttccagctagatgttaccctggctcaactgtatcaacacttggggtaccgtggacatccaaattccatgaggtggctcagaaattccaaggtgtgcgactgctgcgacaagaacccattgaatggctattcacatgtatctggtcctccaaaaaaaacattgccgcaatcactggcattggctgcagtgatgtgccaatggttaggacctcggttaaccaggttgatgatgtcccatacatggatacccagcatgaagcctggttgcaaaattgaggcacctcag

SEQ ID NO: 706749 - DNA, 554 bp, Homo sapiens
gttattgacttactgctggagtgaaggagtctaagtagtataaagaataatagtccttatcagatgtgtgtttcgcaactatgtactccatgtctgtggctcgtatattcattcccttgacgtagtcttttgcagagcagaaaattttaattttagtaaagtccatcttgtcacttatttctttcatagctcttgcctttggtgttgtgtctaaaaagatatcactatactcaaggtcatacagattttctcttgtgttttcttccaggagttttattttacatttaggcctgtgagccatttagagttaatttttgtgaacggtataaggtctatgcctagattcattgttttgcgtgtggatgttcatttgtttcaataccatttgttgaaaagaatattatttctccactgtattgtctttgctcctttgtcaaggatcagttgactatatttatgtactatatttatatacttattgggccctccactgttgcattgatttatatattatttcaacaatgcatactctcttattatagtagggggtccat

SEQ ID NO: 706750 - DNA, 736 bp, Homo sapiens
ggttaaatcacaggggcaggcccaggacaagcagtttggttattcccccttctgttggttgcccgaccggcagagggggctccatgtggcaggagctaggctcccaacgcccatggttcttgccacccttctgggcctcccaggctgggctccgataggctcctgtctcccctgccagtatagttaggcaatttcaggttgtgtgaggccgcagggataaatccaggtggctctgggctgggccctcttctcttcccagcggggaggtgctgttggcctggctgggctggcctgaatctgtttcaagttctcccttcctgcccagctcagttcaccagtgctggatccacggttcaacttgacggggacttggttttttacaacagcgttggcaagttggctctgtctccgtgggcagccattattcccagaacccacgtgggtttgaaggtttctgtgggcgtggagggaccccaaggttttccaagccagtggctgcacttggcagcaggcctcttgaagggaggcggaaagggtaggcgcggagagcaggctccattctgggtcgacttggaggcctggttcccaggttgagttcacaccagtgctcccagctggcggttgctcagtctctcctgctggtgcaaccgcggggggccggggctatgccatgctgctgttgcgaccagggggtgctctgggtgctcccgaatgctgtggttggtcgctgtgctcc

SEQ ID NO: 706751 - DNA, 302 bp, Homo sapiens
acccacgcgtccggagagggaccagaggggggagacagagccgcatgcagtggattgctccttgacgacgccagcctgagcttcttctccaccacccccgtgaggcttcctccttttactggccttccagctcctagggcagaccagagctaatcccatgtacaatgccgtgtccaacgcggaccttatgggtttcaagaattttctggaccatttgggagaaaaggtgcctttagaagatgaggtcgtgcccccacaagttctcagtgagccgtatgaggaggcaggggcttctctcagcc

SEQ ID NO: 706752 - DNA, 270 bp, Homo sapiens
ttttttttttttaagaaaaacccattcggtttggggggggggggaattcaatgggggtttggcggggcatttctctgataattaggaggtggcccattttttttatgtgggggggcggcttttttgccatcggaccttaaacaaaggggaaaaaaataggcatggggaaagggcctttttattaaaaaaagggggcgggaatggctggctttccatttccagaaaaataaaactgaccccctccttttcaccatataaaaaaattacctc

SEQ ID NO: 706753 - DNA, 458 bp, Homo sapiens
  misc_feature (51)..(51): n is a, c, g, or t
tgaaagtacggtaactgcagtagaagggaatgggggtacggtgagaatganaggttgtggcttgcataagcaaaagggatgccgtactttggtggggagaatacatgcatgaatgacgatacggaataccacagacgcgatagaagggccgaccagtgtgaggggggcatgacgcgtgaaatacaaaacaggagggaggcctgcaccttggaagaagtatgaagcagctaaaaaacgcgaggctagaaggcatactttaaataattaataataaggacttcgtgggcgatgaaaaacaattgcccgacagtaataacccgaatattgggagtattgatgcacagattatattttgcgacgacttaaacaataagaacctcctacacaggcgcagattgccccttacgttacataattctttgggcgcgttgaccgcgaaacctttgcataacactaac

SEQ ID NO: 706754 - DNA, 230 bp, Homo sapiens
  misc_feature (36)..(36): n is a, c, g, or t
  misc_feature (38)..(38): n is a, c, g, or t
  misc_feature (137)..(137): n is a, c, g, or t
  misc_feature (141)..(141): n is a, c, g, or t
  misc_feature (207)..(207): n is a, c, g, or t
  misc_feature (220)..(220): n is a, c, g, or t
cggcgatggaaccagcggagtagtcgagcgagttantntcagccgagggccgaaaccggtaaggtggcgctgttccagcgattgcggctcccgggtgctgcagacaggggatcgctctcttctctcgccgacagctnttcntaccctccatgagaaggaagacagctctgtctgacggtagcattcctgacggcgatctcctccagnaacactggctggntgaggacatg

SEQ ID NO: 706755 - DNA, 954 bp, Homo sapiens
  misc_feature (716)..(716): n is a, c, g, or t
caggcatctgggcctggagctgtccccgcgggggtagtggaggctccccggggaggggcgaaggtccctaccttggtgcatgcatctctgcacgctctgatgagacaccagctggcgctgcgggagcgcgtggctcacggtcctgtaatcctaacactttgggaggccgaagcggtcggattggttgagctcaaaagttatgagatgagcctgggcaagcattggtgaaatgcctgtctctaatgaaaacgttgagccaggcgtggtggttggtgctagtacgttcccagctactcaagtgaggctgtatgggcatggacgaattgcttgaacctgggagttggaagtttgcaggattgtagccgagtatggagcctacttgcgacgtctcatgcctggtggtggacaggagtcggtagacctcgtaaatcaggcgacaagataaatcactatatacaaaaatggaccctatagagaaaggggacaacacgcaggtaggtctcctcccaggtgcccgtagggttatccctccgtggggagaggcactggttggggcccaagggaatcatgccacattgtgtgtagacgtggcaccacagggtggtgagaaaatcctaccatcccaaaaaatatgcaggagaaaaccagattcatgcactgtcttcctcggctctgtgccaccctaggctctgcaaggacatctctgcgtggttgcnaactacccacggggagggattctaggtcccccatcatggggattccacctaggagagacacgggacaagttaaaccaatggtgtcccttcctagatacaagccgtagtgttaaagtgcctcgccaacggactcctggataggttctattagaacaccaagactcctcaccatagaacatgctaaccttctaaaagtggctcaatatgggtgcctgcaaaaggcaatccgcataacatg

SEQ ID NO: 706756 - DNA, 446 bp, Homo sapiens
ctgtatttttggcacagatgttctgatacagtatttacttcgaggatccctacagacaggctgagtgtctggagcattctggcctacatcttgtttcagacgttatagaggtcattgcttggatagctctgtagtcctgcccttatccatagtttcagagtcttggactattatcttctacgtcgtgactcaaaactacctgtcgaggtgagttcacataattaaccacaagcctagcacattctgctccccagtaggcctctgtctcactgttcaccctcaacattgaaggccacgtcagtgtgaggctgatagatggggtgactgctgccaccaagtacatctgcaacctttgctggctgtatataagatggccagaagaccttggggcaccccaaaacgtgtatccctcaatcagtagggctttccctctttcacttctaaca

SEQ ID NO: 706757 - DNA, 267 bp, Homo sapiens
gcccgtatagaggatcctctctgccccagatgtatgtgatcctgctcagcctcccaagtgctgggctacaggcgtgcacacgcgcagtaattttaatattttttttttgggtagagatggggttcactgtgttgcccaggtgttctcgaatcctgacctcaattgatccgcccacttcagcctcccaaagtgctgggattacaggcttgacccattgttcttggttgaatctggcatttctgatgggggttaagaatctgggaggga

SEQ ID NO: 706758 - DNA, 718 bp, Homo sapiens
ggatccatcgcgtttacacgagcaccggtggttaccatgaaccagattgtgcgaagcttctctcctgtcaacatgcggtcagctctcccgactagcgagatgctcactggagggatcggacagtgtgtctatagctggtgggctgcccgcaaccttgcatcccgcgacttacacccggtgtatccaattctcggtgcgtacactctccgtgctctgacttgtgttcgctctcggtgctctgttgcggtactaccctctgcatgattcctctctgcttgcctgtggcttccttggcgttcgctctactccgtgaagttgaggtgactggaggaagggttgctgatgtggtggggggtcccgtgtattattgccttccgtcgaccagtgtgcgcttgattcacttctggggccccctggatcctgggggcggtcttcatgcatgcgatatctcgtccgctgttactcgttccccatcaggtctggtcccgtccctgtgcccgtagtcgattgatcctagtcacgggtcatcgcttgcacgggcccagtgacggggttgttctcgtgagctgtgtatttcccattgatcatcatcctccactatgacgttccatcggatcttggcccgtacagcgcctggtacgctctgcgatgtcgtacgtggattcctcctttcgtgctacaggtacctacttcgtcggcctggtcacaggacctgtgc

SEQ ID NO: 706759 - DNA, 90 bp, Homo sapiens
tgcagtggatttaattatgaggctaaaactcaccctcatctttcctggaagaactaattaactatggtttattgtagggttttgtttgtt

SEQ ID NO: 706760 - DNA, 380 bp, Homo sapiens
gatcgcttgtaatatgtacgaagacggcagaacaatattaccatgagagatatgaaaacaaagagcaaatgcaccatgtatccagctacatcacacactacataaatgtgaaagagcttagcattacaatcaaagggttttttaaaatgacagctgcaactaatatctatccctaggaattcatactttagattcaaagacacaaacaacttaaaagttaaaggatgaaaaatgattatacaatacaaacagtaaccaagagagatggagcggcacatgttggcagagacagacagagagagagacccactgcctacaagataaagtctaaatcactttataatctggcctctccttttcagtttagtcttccactcatg

SEQ ID NO: 706761 - DNA, 453 bp, Homo sapiens
gtgtgatagaggatcccctcagcaccacggaggatggctacaatcagagaatatcaagtgttggtgaggatgtggagaaaataggatcctcataccctcataccctgcaggtgggaacagaaaacggtgcagccacttcggaagactcttgggagtgcctcagaaagtgaaagagagttgccatatgacccagtaattccagacataagcatatggaaatgaaaatgaacgtccacacaaacactggtacgtaatgttcacagtagcactactcctaacagccaagaggagacaacccaaatgcccatgaactgatgaatggataaacaatgtggactctccgtacatttggccataaaaaggaacgtacgtgctacaacatggttgaaccttgaaaacactatgccaagttcaagaagccagtcacaaaagaccacatcctccatggtgctg

SEQ ID NO: 706762 - DNA, 104 bp, Homo sapiens
tagtgaggcaggagatttgtttgaccccagcaggcagagatagcagtgagctgagatcgtgccattgcactctagcctgggccacaggggtgagattctgtctc

SEQ ID NO: 706763 - DNA, 310 bp, Homo sapiens
  misc_feature (50)..(50): n is a, c, g, or t
  misc_feature (62)..(62): n is a, c, g, or t
  misc_feature (128)..(128): n is a, c, g, or t
tcagcggtacacagcataaactattactataggcctgatataaggaatanagttgcaggcanaagggagagaagggaatagcaggaggaactagtccagagagaaaaaaaaaaatatgtgcaaaaccntggagatccaaaaggttgtggtgcttccagatggacaaaattaaggcctgtaaaaaagaaataaactagagatctctaaaagggaggatccttctggatcctttccaaaagtttcccctctcatccttaccatcgtaaaagcatttccccttgactctgcttttctttccacataccaatag

SEQ ID NO: 706764 - DNA, 325 bp, Homo sapiens
attccatttgggaacagaaaacggggggttttgggcaaagggccctggggccccccccctcctccctgggttgggtccccggtggctataggccctttcccttgggcccccccccaccggttgggggcccgcccccctgcccggctgggtttttcccccaacccccttttatgggggggggaaagggggggaggggggggggcccgcccccccccccgggctttggggggggcccgcccccctggggttttcccctccccggggggtttttcccccgcccctttgtttaaatccaacccggattaaacccccaggttttttttga

SEQ ID NO: 706765 - DNA, 344 bp, Homo sapiens
atacagtaaagtattagtatcagcaggaaacttcaagcatgaagaccagttggaactcaggatgaacagtgctagttgaaagccactgctctggatctagcctaggattctaacaattactagactagccaaccatcttagacagagtggatgaagtctggatactaaggtgggatgacaaaaaagatggccttatcactctccttcactatccttttgctttaggttgacacagctcattgtctaacaaaagccttccctggaacatccgtttcaatcctactctttgccttcaaatcacaactcagtcgtcacctctcagaaatacctgacccaacatcatt

SEQ ID NO: 706766 - DNA, 192 bp, Homo sapiens
  misc_feature (176)..(176): n is a, c, g, or t
gcggtgctctgacggctcccccctgacccgtccccactctgggaccacggtccccttgggggcccttgactgtcaaccttccgggccactggacggtcgccttccaccttggggccgacgacacaccgtccaccgtcgcccttcactcttgggacactttcctacccggggcgggngtacccgacgctcgac

SEQ ID NO: 706767 - DNA, 309 bp, Homo sapiens
tcagagcggtctccatcgctcagtgggttaaatatgcatcactaccttgagctgtagtgtaggtcacagatgcgtcttgaatgccacgttgctgtggcatagactggcagctgcttggacacatcctcacagagcaaggatgacagtatctagtaagtggagcatgaattagccatactgcagagcacacaggtttcatgttaacccacccgtctcttttatgaagatccggccttttctcttttagagtttggaaccttctgggagggctgctctggactctcctcctccccacacctgactattgct

SEQ ID NO: 706768 - DNA, 851 bp, Homo sapiens
  misc_feature (54)..(54): n is a, c, g, or t
  misc_feature (67)..(67): n is a, c, g, or t
  misc_feature (86)..(86): n is a, c, g, or t
  misc_feature (126)..(126): n is a, c, g, or t
  misc_feature (142)..(142): n is a, c, g, or t
  misc_feature (152)..(152): n is a, c, g, or t
  misc_feature (181)..(181): n is a, c, g, or t
  misc_feature (186)..(187): n is a, c, g, or t
  misc_feature (195)..(195): n is a, c, g, or t
  misc_feature (226)..(226): n is a, c, g, or t
  misc_feature (237)..(237): n is a, c, g, or t
  misc_feature (245)..(245): n is a, c, g, or t
  misc_feature (269)..(269): n is a, c, g, or t
  misc_feature (276)..(276): n is a, c, g, or t
  misc_feature (279)..(279): n is a, c, g, or t
  misc_feature (294)..(294): n is a, c, g, or t
  misc_feature (300)..(300): n is a, c, g, or t
  misc_feature (305)..(305): n is a, c, g, or t
  misc_feature (555)..(555): n is a, c, g, or t
  misc_feature (638)..(638): n is a, c, g, or t
  misc_feature (642)..(642): n is a, c, g, or t
  misc_feature (730)..(730): n is a, c, g, or t
gaagcctccgaacacgcacagaggaaggagccagctcccagcccactcatcgcngggctcatgattntttacaaattatgttttanttccaagtgtttctgtttcaaggaaggatgaaataagttntattgaaaatgtggtnactttatttnaaaatgatttttaacattatgagagactnctcannattctaantttgttggcccttgtgtgtgtgttttttttnttaaagttctncatcattnattacaatagtactcgcgcatcgncccctcnccngcacaatgcagcccncccacncactnccatggccctttgctcccccaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcacatttgttagaaccngtcttttgaaagaaaagtatttccaacttgtcacttgccagtcactccgttttgcaaaaggtggcccttcactgtccattccnaatngcccacacgtgctctctgctggattctaaattatgtgaattttgccatattaaatcttcctcatttatactattatttgttacgttcnatcagaatccccgaacctcctattaagcttagctgcccctttctgaggatgctgagaacggtgtctttctttataaatgccaatggctacccttttaccataaaattttgcaatgtgccca

SEQ ID NO: 706769 - DNA, 401 bp, Homo sapiens
atctgtctcaaaaaaaaaaaaaaaaaaattagccagctgtggtgcacatcctatatcccgtttctggagctcgtaggtatcaccgaaccagagtgaggtgtgtgaccgagacgtaccacgcactccagcctgggtaacagggtgagaccttgtctcaaaaagaaaaattacaataaaataaataaaataaaacggaaatgcatccctttcacaggattgagaaaggagaattcagtgagttagtgcaagtttttctgcttatctaacactgcataccaaacaattccaatatagtgatgaaaaaaaggtcactaggctgggcgtggtggctcatgcctgtaagcccagcactttgggagtccaagcggcgatcgcaaggccaggatggtctcgatgaacta

SEQ ID NO: 706770 - DNA, 668 bp, Homo sapiens
gagcagacgcaactgcgtctctgggcgcgggccgttggcgctcgagaggcagtgcaccgcgacctcaggtccccgaccacgtccctggcagccccgattatacagcctcagcagagcacggggcgggggcgaggggcccgccgggagggctgctactcttgagacctctgcgggctgctagcacgccccccttgctgggtgtgtcctcgctcgtccctccctccgtcttaggtcactgttttcaacctcgaataaaaactgcagacaaattccgaggcagcctcattgaccagacggaacccagactctgacaggttcggtccgcatcctcgtaccgtaatccgcaaggacccactgaccacgaagcccagtgaatactaacagaatcactttacagccgagccctcctgttcgctccggacaccatggacaagtttggtggcacgcagactggggactctgcctcgtgccgctgagcctggcgcagatcgatttgaatataacctgacgatttgcaggtgtattccacgtggagaaaaaatggtcgctatagcatctctcggatggaggccgctgaactctgcaaggctttcaatagcaccttgccacaatggcccagatggagaaagctctgagcatcggatttgagacctgcaggtatgggttca

SEQ ID NO: 706771 - DNA, 947 bp, Homo sapiens
agcggagcgccatggcggccggagtgtttcggctaacttggaggtactggccacgactgcatgcccgtgcacgccgaggtgatacctctcggcgtgtgacccatgtgtgctctgctgaccgacagatggatgtctgcactgtctaacgtgctagactatgctcagctttgtgggatacagcggagcgtttgtgagcatgcttggcgaggtaagccgttatagccgtagccaacatagccaagtcatttagcgagacggaaatcctgtaatgaatcagggccccatgtccggtagactagagtgaccacgtctggtgaggaacatcgggagtccacgcgagagacctctccaaggtcagtagaatgggtgtacagaatgcgtcccatcatgggccctcgctggttccagcatggtccctcctgtggacccccatgggtactactggctggcgagacctttgtctgcctcgatgtatgactggatgaacgcgagtttggcacttgtgctcctggaatcgcaaacttgggccttacatgggcaacctcagaggccctgctgtgtgctgcttggacgcccctggtcccttcaatggtgtccacagtgacctggctgctgacgccttggtgaaccttggtgcaaacgtggtcctgcaggtgactcgtgggtccagctggccgctcctggtcagggctgcgtgcaaccatggtccacccttggtatcacctcggacgaagctggtcgcacagagcgactcgattgcgaccaacacggggtgcgtcgccgatgcccctggaagtttcctggcaattccctaggcatgccaccaggggcattacgggcgacaactactgggtgttgcaatggatttgcagtggcgaagccccggtggtaccaggttgtgaaaagaggtggaactggcggctgcctggtgaagaaggaagacaccg

SEQ ID NO: 706772 - DNA, 359 bp, Homo sapiens
tgagcggccgccatggcagtaccttccgcgagctgcacctgctcatggccagtctggactgaggacagcagtgggcaggggcgctcggcacgcacagggcctggcctcagcccccactcctgttccttgtgcacccactggcccatgagcctctgcctggcccctgctgctatcctgtggccgtcctggaggaagtgatgctggtccctggccacatctacagcacagaactcttgagacaactatatacaacactagctgcccaaaaatgacaaactgttgattcttaaggacagcaaactgaacctaaacagataatgtaattaataagacaaaataaattaaatatataaaaaata

SEQ ID NO: 706773 - DNA, 371 bp, Homo sapiens
  misc_feature (5)..(5): n is a, c, g, or t
  misc_feature (39)..(39): n is a, c, g, or t
  misc_feature (163)..(163): n is a, c, g, or t
  misc_feature (275)..(275): n is a, c, g, or t
agttnggtccttctccttgaaacttgagggcctattccnggaagtttccctccctgcaccctgtctgcagatcccttttgcatggccctaaacttgtcatcctactgatggttttcccaaactgtggctcccccaaacaccccacccatcagaacccactggnggtgcctgttaaaaatggaagtccctccaagataagcaaaaaactgagggatttcattaccactagactggccttacaagaagtgctcaagggaatcctacatctgaaaagnaaaagacaataataactctcatgaaaacatgaaaaagtataaaagttactggtagaggagaaatagaaagaagaaagagaaaagaagcaaaactat

SEQ ID NO: 706774 - DNA, 1021 bp, Homo sapiens
ggagactgtacgtgagctgatggcgtaccgggttgcttgccggtgctggccgcgaccgggagagccggggcagagcagaggtgctcatcagcactgtaggcccggacgattgtagtggtacccgttcctgacccggactaaggtccctgtcttgcagctggatagcggaactacctcttctccactagtgcaatcatgccgatataattcataatagtacatctcggctgggagcaagatgacctccattaaccagtggctggaatgggaagacgacagagctgcagccagctttgtctagctgccctgtactattatagtcggtccaatggcaacgaagggggcacgatgtacttggattcaagtagcggaggagccctgactcacatatagaccacagtttagagtcgacagaactgaactttcctggactagggagagaacagaatactactagccgacatatgtacaagtcggggagccctatacgcattaactagcaaggatcaacgacctaacctccctgagagagctagagtagaccttgacacagataggttccagaacactcgaggtacaccacgggaaagccatagaccggcagagacatgacacgaaacacctagcataactggcagagcagaccaaggtgatccagagacaactacgagaccattaccaccacaacaaagcagacaccaggcccagaacaccgactaagcgaggaaacgcgcgcttggacaaccccaacataggcagacccgtggaagcgaagcggaagggccagcatagggcacgtaccccgcataattcgttgcaagggcagggacacgcaagtggggcaaacatagagagcataggacacacacatggcccagagcgggacaaaccaagcgggcccacatactaacacacggacactcgagagcccaccaagcagtacgagagcccaccccacacacaagacacagacaccaacagagtgatgagacccaagggaacgaaatcgacgccaagcaaa

SEQ ID NO: 706775 - DNA, 150 bp, Homo sapiens
tggcgcacgtacctggaccgttgggtagtgtggtctatggtgttacctgagattaggggatatcagttactgaaagcctcctattatggcccatacagctcctattgataggacatagtgcaagtgagctacaaggtagtacgtgtccgg

SEQ ID NO: 706776 - DNA, 123 bp, Homo sapiens
ggatgttacatcaactgttcgcaagccaatgcactgggcaccaggagaaatcggaacccagagccaaacctggctgactccataaccagatgaagactttcccctgaaggttatttctaatga

SEQ ID NO: 706777 - DNA, 201 bp, Homo sapiens
ggatgaccttgcccacagaccttggcagcgcagttagaggcagggatgatgttcttggagagccccgcgcccatcaaggccacaatttcccggaggcccattccacaatcttcttgggtggcagtgatggcatggactgtggtcaagagtccttccaagataccaaagttgtcatggatgaccttggccaggggtcctaag

SEQ ID NO: 706778 - DNA, 309 bp, Homo sapiens
ttggcgaactgagttccctatctgtgcgggtggctaatctgtagcgtcagagggaaagatttgtgcaagtaattgtcacacagaagaaagtcctcacaaattatcggattccagtcacattgactcacttattcaagataactaaaaacattggttgtgtgatgaccggaatgacagcctgacagcagatcccatgctccagagggcacgctatgaggcagctaactgtcaatactagtttagctattagattcctgtgcacatgctgtgtaagagaattgccgatatttctcaggtctagacacagat

SEQ ID NO: 706779 - DNA, 868 bp, Homo sapiens
  misc_feature (283)..(283): n is a, c, g, or t
  misc_feature (289)..(289): n is a, c, g, or t
  misc_feature (311)..(311): n is a, c, g, or t
  misc_feature (317)..(317): n is a, c, g, or t
  misc_feature (325)..(325): n is a, c, g, or t
  misc_feature (329)..(329): n is a, c, g, or t
  misc_feature (332)..(332): n is a, c, g, or t
  misc_feature (338)..(338): n is a, c, g, or t
  misc_feature (340)..(340): n is a, c, g, or t
  misc_feature (346)..(346): n is a, c, g, or t
  misc_feature (379)..(379): n is a, c, g, or t
  misc_feature (382)..(382): n is a, c, g, or t
  misc_feature (387)..(387): n is a, c, g, or t
  misc_feature (412)..(412): n is a, c, g, or t
  misc_feature (437)..(437): n is a, c, g, or t
  misc_feature (453)..(453): n is a, c, g, or t
  misc_feature (866)..(866): n is a, c, g, or t
gaaccccgaacgtggtcggttggagcaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacacctggaagtacangctganggaaaattcaaacggctggaancaaatntttttcancctnacncccctntntgcctnaaccacctgccaagaccaaatgggaaaggaaancanggtgngcatgctccggggcccttgacgcangttcaataacaaccgcacggcgcanggggactccaagccgnctcaacatcttcaagaagtgtcatcaagtgggtgttgggggaactggaatctagacaaaagggccaagtgaagaaagcagagccccaataccaaagacaaacccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaacctcttcatgctttccggaggtctaaaagtcttagctcagaaattcccgggaagacttgattctggttccctnca

SEQ ID NO: 706780 - DNA, 211 bp, Homo sapiens
gcaattgttgtagcgacacgggcttcacggcgttacactcacttttgtgggtccaagtttctcctaattttgggttctatccccgccccatatttagttccgcttacaatccccaactacgcctggggttgaaacccccccctagtaggcctttttaaaagtgggttcaaaaatttttgaatttccatttttttgaggggggccccaaaaa

SEQ ID NO: 706781 - DNA, 198 bp, Homo sapiens
aaggatctcctgctgctccctcttcatccagctttcgctgtagctcctccacttttcgggtaagctcaccctggcctgccacggccttagtagaaaccagaaagaaaccatacactagaaggctgcaatcttctccaggcaacaaactaacccttctcctcacagaggtttcactttcttgagcttccctccctcagg

SEQ ID NO: 706782 - DNA, 677 bp, Homo sapiens
gcctcccgagccgctgaacttttcctggaggcggctggcctcgtgctgcctgctgggtccctggggttcgctgggccctgattgctgccgtttccccgctgcagagctcgccgtgcgccccgacgggccccgtgatgcagctggtgcccctgtgccgagcctggactcagcctggagctccagctagccacatgcaccttacctgggttccgcctggtccctgagtccccacaaaatggctgatggaggaagccccttcctaggtcggagggactttgtctacccttcctcaagccgagacctagtgcctctaacggagggggcagccagcaggagggacagagacgaagagaaaggcgcaggtcaagttttgacttccaggcgcagtcccccaaggagctgatcttgagacgggtgacattgtctacatccacaaggaggtggacaagaacttggctggagggagagcacacggcctgcctgggcaatcttccctgctaattatgtggaggttgcttgccgcacgatgagatccctaagccccatcaagcccccgactaacaggtgctgcagtatggagaggtgtggaccagtacaccttcgagggggacctggaggtggagctgacttcggcaagggaagagcacatctgcttgatcgaaggttgacgagactga

SEQ ID NO: 706783 - DNA, 149 bp, Homo sapiens
cccccccttttttttttagggggggggggttagggccggccccctccttctctttcaaaaacatgtatggtaaaaagaaaaaggacccgccccaccaaaagatcataagccccctgcccccaaaacaataaagaaaaaaggatttttca

SEQ ID NO: 706784 - DNA, 876 bp, Homo sapiens
  misc_feature (377)..(377): n is a, c, g, or t
  misc_feature (864)..(864): n is a, c, g, or t
agcgggttttataatactgtatttgaatctctatttaatttttttgtggaaagatgtgtgcaggatgccagcatgatatacagaccaactttggggaatgcctgtgttctaaaaaaaaaaaaaaaaaaaaaaaaaaaggcaagatggggctggggcattgcgtggactcacacctggtggtctcacgcagtttgtggagggccgaggcaggcaagatcacttgagggccagaatgttcgagaccaaggcggtgccaaccatgtgcaaaacaccatctctactaaaaatataaaaattacgccagggcagtgtgtacacgcttggtcatcccagttatttgggaaagaggctgagggcacaaagaattggcgttggancccggggagggcggagagggttacacttggaggccaaagatttgtgcgcactgggatgtctaggccccagggcaaaaaaggcgggaccatgtctcaaaaaaactaaaaacggcaaagatttcggtgttttcccctttgaaacctgcgtgacgacttgaacttgtttttttcggaacaccattttcatcacttgtggtgcatagggtttccccttttgcttagatccgtggtacttgcgggttgaataataaacttccgtggggggagaggtatttatccccttgttaacctaacttgtgatcgtgcacatcacctcttttcaacgcatcttttcttcaaagctcctgacaaagttctgcttgcacatccttggttggcttacactgggttttcctcaggcgggatgcccttcctgagaaaggctcttgggaagatgaatcccattgaccctttttacatatttgtgtgggaagcccgcccttttgcncggtcgttggtg

SEQ ID NO: 706785 - DNA, 952 bp, Homo sapiens
  misc_feature (484)..(484): n is a, c, g, or t
  misc_feature (805)..(805): n is a, c, g, or t
  misc_feature (821)..(821): n is a, c, g, or t
  misc_feature (950)..(950): n is a, c, g, or t
agcggggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaagtactttcctgtgtgngtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagactgggccaggtgcctgagattgatgttccgtcctacctgcctgacntgcccggcattgccancgacctcatgtacagtgcgacctgggcccggattgcccctctgcccctggcaccattccagaactgcccaccttccacactgaggtagccgagcctctcaaggcagacctacaagatggggtactaacncc

SEQ ID NO: 706786 - DNA, 332 bp, Homo sapiens
agtccaccttttacccggtcatgggaaatggttcattaaaccactgctcgaaggtgctacatctcttgaagatggtggacagcaggaagttgagcaacgcccagagctcgggaagcttgtgctgcaacggtgtgcccgtaagcggcaggcggcagggtggccatatagtgcgtgttgagcccctgtgtcagcttgcatgtgcggttcttcatgcggtgaaccgtcgtccacaatcatatacgtccaacggatcttggcgaggatgtgctagtctttgatgatgtacacgtacgtacgtcagcaagacgttgaacttcccaactccgaaactg

SEQ ID NO: 706787 - DNA, 840 bp, Homo sapiens
  misc_feature (372)..(372): n is a, c, g, or t
  misc_feature (693)..(693): n is a, c, g, or t
  misc_feature (709)..(709): n is a, c, g, or t
  misc_feature (838)..(838): n is a, c, g, or t
agcggggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaagtactttcctgtgtgngtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagactgggccaggtgcctgagattgatgttccgtcctacctgcctgacntgcccggcattgccancgacctcatgtacagtgcgacctgggcccggattgcccctctgcccctggcaccattccagaactgcccaccttccacactgaggtagccgagcctctcaaggcagacctacaagatggggtactaacncc

SEQ ID NO: 706788 - DNA, 280 bp, Homo sapiens
gctcgacttttttttttttcttcttcttcttctttttcttcctcttcttcttcctcttcttcttcttcttcttcttcttcattattattattattattgacatttcatgaaatatctttaatagcttcatcaaggacaaatttatatatctatgccaacgtaaaatacttctttcctaaacttatacactatttcataaataaaatattgtttatttaatacacaatataaactacaatgtattaaatgggccactttataaatggaaaatagtcgacgc

SEQ ID NO: 706789 - DNA, 319 bp, Homo sapiens
ccgtccgtgttttcaggagtggttgaggacacagggcccccagcccagccctttgcaccccccagcccggccatttgcgccccccagcccctttggagcttttttcttgtcctctccccccttccccaaagtttttgcccaaaacttccttttgaaagggtttttttcattttccatacctcccccaagctctcctccagccccttcccagggctcagccctgctgtcctgagcgtctcctgggccaaaaaaaggaaatgggggtgggagggcctgagtttatgttgggtttttcctcccataaattggggttttctta

SEQ ID NO: 706790 - DNA, 593 bp, Homo sapiens
  misc_feature (204)..(204): n is a, c, g, or t
  misc_feature (206)..(206): n is a, c, g, or t
gccatgaaccccgaatatgactacctgtttaaggctgctttcgattggcgactcaggcgtgggctcgtcatgcctgctcctgcggttggctggatgacatcgtacacagacgagcgtacgatcgagcgaccgatcggggtgcgacttcgaacgagtccgacagccatcgcaggctcgggaatggccacagagactactcgaaancntgtcgagagtcgtgggaccacaggcgcggcccagtgagacgggttccagcgtaccatcgactatccatgcgctacgtaaccggtgagggtcctcagtggcacatcattacggtgggaatggtgactgcacgatcagcgtgaaccacggtgaagtccctagcggcacaagcgatgaaaggcagctggactgacaggcgacgattgcacctgcatactagccatggcgggatgcacaccggtcgaagtgaaggccatccgtgtgcgtggtgcaaagcatacgtatgccgaaccgtctaaccatcgcagatgatacggatgagctgggaccaaagcaccccacgagcctcgaacggaatggttatggctagatcgtcgtgcttggtgcat

SEQ ID NO: 706791 - DNA, 201 bp, Homo sapiens
tactagttcacagaaagaccttttttaatatgaaaagagaaaaacattttgaagcccccacaattgtgggtgtaccaacataatttcaagtaaagggaatgtgattaaaacattttgatttcacaaagcctttcagagggggtttcgacaaacgcaaagcgacccaaaccctggggggtcacatccgggttgctacaaacc

SEQ ID NO: 706792 - DNA, 496 bp, Homo sapiens
agctctttcagggaagggcaggaggtggtccccagattggccccatctgggtgccccgtgggccctgccccaccctccagggggccccaggggcctccccttttctttggcacgccaattgggtggtagtgggaggttgtgccttgaggccccttaaaactccctcttttaaaggccctctcaggaaaaaaaacccggccccggggccggccggggggggttcccggttggccctaaccttttttttttttttttttaaaaaaaaaaaacctttaaaaaacccccccttaaaaccaaacctttttgggtttttgaccaagggattttccaaatttggttggggttttgttttgaaggttagggaatttttccccccataaagccccccgttttttgcccctcttatttttatgtttggggtttgggggggggccggggttttttttttttttttttaaggggggggggcccaaaggaaataaacccggggctgtta

SEQ ID NO: 706793 - DNA, 841 bp, Homo sapiens
gtaaatggtgggacaagcaaagctcatttttttttcttttttctgatcaattggaagtttatttgccaaggttaaggacaatgcctaaaagagaagtctgagcctttctctaaggatgatttagacggcttcgatatttgaaggggaaaagcaggatggaggtgaatgaagaatggtatggccacattactgaatctacaaggtgcaggacaaaaggagcagctagggcaatagtcaattatgtatttttctggagctcagtaaactgacactttacataagataagatgaacatagagtagctacctgtggggatatttaaccttctgcctgtagctatctgcttaggaacaaaaggaaaggcggattcttgtacgactcagctttcagcttttttttttttcccttgggcagagtgaatgggggtccaagcttaatttccctttggagacagaattattacccggtggatcgccggagatcagaaaatttcgggccgcagttccattgacctttcaaagggaactttcaaatagttgcagaaagctagggatttgataagaccctgaaaatttccgggtgtggtaacgcgcctaagaccagttggcccaacttgtggttgttccgcctaggtttcctagggttccctaggggtcttatttctctcttcctctttcccacttctttcggaggagaggtcccattttgggccgcgtgtttagcctggcgagacctctggctcgtccagtgtgtccggggcgcgttccgcttttttatccacccgggttccacgtttggtggggcgcgaaagtcgatagggggccctctgggggcggttcta

SEQ ID NO: 706794 - DNA, 955 bp, Homo sapiens
atggaaataccacctgtagagcttcccccagaagaacctccaagactatctgtcacgctaatagccgatgagttatgaacttctgccttataaaaagatgacaggcgaacagagaaggctacacgacagtatgatgaagaggacgaggattgaacgatgcactcagggggcgaatcaagtactcaggaacgaaatgatagatggacacatacatggacatctagcacgatgcctctctatgtgtcattcagtcgttgcatcttgcttacataggctggatagctgagatcctatgtcagtgtgctgttgagttagctgtcggaatataacgtaactagaaaatcgatagcttgtccgtcgacaatgtctctagcatgcgtgtcattgcgctgtctggtaaaaacggcagctacgcgtagtatgtagctagacgccaggacagactccgagtactagtgacaactcattcggtcacacactgcatgggaccagaggttaccataatctatactgaagggaccgctaagaagccacttagtaaggctcaccgttagttattgactctactactaagttgcgttaaccacacaatttggtccccacacttggtggtagcggcgatcggaccaggagagctccttttgacgcgaaatacgtataagcactgtttttggtcatgcttaacacaatgctccgtctatgtgccctatatgtaacccgatatcgtatcaattcatatattatcccaagattacaatttaaacactgtctgctccaaacttttttccaattcctatctcgcacgcgcggacaaacctcggacttctacgcaactgcggggtctcgtcggttccgatgtttcccttggacctgcggaggcaaacacacctggcaaaccacccaagggggcacctccaagacacgactggactccttaaaccaagtttccagcagg

SEQ ID NO: 706795 - DNA, 138 bp, Homo sapiens
ggcgatctagaggacccaagtcaaaagcagagctcatatagccagaatagctttgtgatgcttgtccatagccttggctgcctggatttccataggtagaataactttgctgctcacccccagtacaagaaccacacg

SEQ ID NO: 706796 - DNA, 161 bp, Homo sapiens
tagaggatcccgtcccaagatagatgaattgcacagtgaggcaaaactaataataacttgtatatgaagaacactaaaagaagtcaaaaagagagataaacattcatacaaaaaactatattttcctctatcatctctagaaaagaaatgcacaccaattc

SEQ ID NO: 706797 - DNA, 110 bp, Homo sapiens
agacgactccctgccgtcgtgtatactcctccagccgacagcagcagaatgtggcccaggcggtgccacgcttgcaagggggaggggctgagcgtgacgggcaccgtgta

SEQ ID NO: 706798 - DNA, 1440 bp, Homo sapiens
gaacgctgtcgggggtgcctaaagatagggtgttaatgatcgaaggagaggacggaggaccttgagtcgaacagggagttgcctattatgaatactacttatgtgagataagaagataatgatatacaaaatattcaaaaaaaataatagttcctaatatagtgtctttatacaataactatgtatatgtgtcaagaggtgattatataaagtagtctctagttgaggactttatttgatgttatactatgcataactcttggcaagaacttgtgattgagaagagctagtctatgcagtgaagagactgatcatgcaattgtggttttctctatacatgatcgatgagctggcgcatggaagattgtcattcatgtgttgtatacatagtgtattaaatatgtacatattgtaggaagagaatcgtaatggtggaactaagttaaaatttcattcccatttcaaagatgaggagcatgtgcctctaggaagaatttaaacccatgtaggggtgtacctctgatatcggcagggtacatagggtctgagttcttagaaaactttggtaccgatggagttaccccttaaattcatgctgaagctgtagacttattctatacctaccgtagaatagaagggccgtagggattgacttgagacacgcaagctttgtacaactttaccaattgatgcggcaagtggaaagaaaccattggccttttgcgggtgtttagaaggatgcttagccattaagtggggaaatgttaacttaatgagggacaggaggggacattaattgagaaccaaggaatagatgttcggcgacaagtgggagatatgggattaggaataacaatattattgggtaggaaaggaaagttcaaaggtttttggaaagaatgggaaatattttggaaactcacgcaggaaagctcactggaggaaagcgtgtaatgaaaaaagaactttagaagaaaagtagtcagggggaaatattaacacacgtggatagaataaaaaatccgtgttttacggacaagaaagagctatcagcgtatattttacaaagactttgtcaaaagagtaggagaagcagaaaaagcaacaaagaaagaaacaagattggtggagacgaagaaatggctaccgggacaagaatggtttacaaaataacaaaatgaataatttgggcaagatgagagcacccaagtaatatataatgtgcaaagagtagtagtcacgaagaaggtataccagaaatgaaaatgtggagaatagagataaaagacaaggtattgtggcaacgtatataaaaatatgaaaggaatgagaagcgaacaagtatgaaagaagatacaacaatgaatagatgttggtgcaagagaggataagtagagagagaggaagaaagaacataataatgaccacagagagaaaggt

SEQ ID NO: 706799 - DNA, 1221 bp, Homo sapiens
agctggtaagccagtcagagtgatacgcagttttaaagggaggaagcatccagccaacatatgctcctgcaagcaaggcccaccagcatcatgcatggcgatttcatcacaggtggtgcaacatcactggcccagcagatttccatccaagcccagtggcattcattgcgtttggccgctcagtctttgtcaagcacagcagcatgcatgtttgcaaccgtgcgtccattggcacctcatgcacaggcacatcagcacactggtccacaggagcattcatgtcttcacagattatcacatggtcatcccagcaagggtttcagcccttatcgagcatcacacagcacagaggcacagcacagcccttcaaccagggcaccaagttcacacagcacagcgcagcgcccagatggtgaaacaccaccacacacacagggcgctacatctctccacgcatcgcatgcacgtgggtccccacaggtgcccctcccaaaaggtgtgggcacccacacagcccagtccgcagcaattcccatgcgcaagcccaaggccacacttggacatgtggctttcgctcgacaacgttcaaagcatacgccttccgaaacgcaaagaaacacacattcgtccccatccgagccagcaacacggatttgggttcgcaaaaagaggcgcaggcaacaggccttaggtttggaggtgctattcgtcaacaggttgggccatatattcacaacgctatttccattatggattgggaggcaacaggggcacagccgaagagaatggttataaccattgggcacagacaagaaatttgtggggagaaaacgacaatatacagtatagtgttcaattcgggtatggcagggttcttattggccgtaggggttcccgagggggaaaggcgtgaaaggtgattgaacacccaaagaccacctctggatgggaataccagaaccatttgcacagagattgagccttctcccccaattacaacaacgttagagtttcatatgagtataagaccagaacgttctgcgcgccctataaccaaagtggcagggcccttcacccgtcatttcaacgcacggtagccaacaaacgggcaggtttctagaccattccctcatttgtgacacgctatggagcaaatgggacccggtggcagcacagtttgtgcaagtccctttcgtagggaccccaagcgacaaaggtgtg

SEQ ID NO: 706800 - DNA, 452 bp, Homo sapiens
  misc_feature (151)..(151): n is a, c, g, or t
ccgaactcatcaacgaaacgcatggttactctccgttttcatatgatcgacgacgaatcgaaagcctgtatttcatcggaatagctgctcccgagcttctgaacggccgcgagcgtgagaacgcctcggtctcgtcgatcttcgccatggnaatccgacatggaccagaacccagtcgtcgggttcgggcatgtccttttccagcagtcggacactgatgatccggcgtacgcactgacgtcgaccttcgccaaatagttttcagcatcagttatctcgatgatttgaccaggaattccaaggcacattttcttcacaccactttcttcagcagatacgtgggcagcgggttcgccgacgagcatgttccacgatggcgggttaccccgaaaggcgttcccgcaccacggacccttcgcggccggtttcttggcaattttaacgattttggc

SEQ ID NO: 706801 - DNA, 397 bp, Homo sapiens
  misc_feature (100)..(101): n is a, c, g, or t
ccttctcccggttttgggggcccttgttggggggggggaatttttttctccaaggggggacccccccttttttttttttacccctttttttggggaaaanngcctttttaaagggggggggcctttttttttgtttaaccccccctggggggggtggggggttttttttttttttttttcccccggaaaaagtgtgtttttgggggggggggaaatttacctttttttttttccccccagggggggtttgcctttcccttttgggggggggggccctttaggggccgaaatttttttttcccttttttgggcccccccaattaaggggggattttttccttttccctttccccttttcccaaaaaaaaggggggggggggggtttttttttttttta

SEQ ID NO: 706802 - DNA, 1267 bp, Homo sapiens
tctgcgcggctccttctttctgtgtctcgttttgtcgctttttctctgtctctttttcttttcctttctcctttctctctcttctttctttctcttgtttgcctctttttcttgtgcttgtcgtcttcttgcttctgctgcttgtcgttgttctttcgtgcttcgcttttcttcttccggttcttcgtttttgcgttcgtttcgtattcttcgcttgtgcttcttttcctctctcttcttgcttttgtctttcgctcgtttcttctctctcttctctggtttttcttttactttttttttcttgttctcttgtttctctctggtgtcttcgtctttttcctcttggtgtctgctctgtgctgctgtgctttgcttgttcttcttttctgtcctgtggtgttctcgtttctgtgctttgtttctctttcttttcgctcgctcggtctttccatgttctgtttgtcgtcttttcctgctttcctattttttctgttttttgtttctctgttgttcttttctcctttgtcttctttcctttctggtcttgcctccttttctgtcctctcgttgctttctcttctcgctctgtgtttgttgtttctcgctagtctgtcgtcttgtttttatttcatgtgcttcgtttcctccgtgtttttcgtgtcgttgtcttttgttgcgtggtgtgttgccttcttttctgtgtcgtttttttttcttttctttttttctttgttctgtgctgttgtgcgtttctggcgtgggctttgtatcttctgcgattgggtggtgtttctgtcttccttgctctattctccttttttctctttggtcatctggcctctggtctctcctgtctcgcttgccctgtgtgtctcgctatctctctgtgttcctatttgatgcatgcccttcttgtaagagtccattgtgtgcccctcaccgtttactcagcaccctgagtattcttggatgcctcatcctgccattgccacggagtcatctggaccatgtgtcattcctgagatatcgctgtcacatctatcagtcagtgtcgtgttgcctctctcgggcccttgggtcctgggaatgctgtctgtcttcaacccctagagccataacgaatggcagccgtttcttaacatgttgagagatgattctttcctggcctggccatctcgggaagcttgatccccaactcctggaaggaattaactctcctggttgctgagtttggtggggaagggaagggtactatagatgttactcg

SEQ ID NO: 706803 - DNA, 412 bp, Homo sapiens
gcaatgttaaaaagtagattgaaagcagaattaaggattggccaaagacaaagctggttttagggaaatgagtgagccactgacaaagccaaaagttaagttttgatgatctaaaaagattccccattggcccgatgtgggtggctcatgcctgtaatcctagcactttgggaggccaagacaggtggatcccctgagatcaggagttcgagaccagcctggccaacatggcaaaaccctgtatttactaaaaatacaaaaattagccgggcatggtggcacatgcctgtaatcccagctactcgggaggctgagacaggagaatcacttgaacccaggaggcagaagttgcagtgagccaagatcacgcccctatactccagcctgggcgacagagcaagactctatctca

SEQ ID NO: 706804 - DNA, 108 bp, Homo sapiens
catggtacgaagctatgcagaggggtcaacgatagatatgggagaggctaattgcctattgctatacttgtcggtctgttcctattactgctgtgacttacttgtacg

SEQ ID NO: 706805 - DNA, 530 bp, Homo sapiens
  misc_feature (13)..(13): n is a, c, g, or t
  misc_feature (139)..(139): n is a, c, g, or t
  misc_feature (156)..(157): n is a, c, g, or t
  misc_feature (159)..(160): n is a, c, g, or t
tcctgcgcacgtnggctcgggggcgccgtggagctcccgaagcgatcgtgggattcagaaacctctcccgggactcccatgggaggaggctgaacccgggccggcacgcgatcgcgggatgggctggagttgtaggaangccctaggccggggccnncnncggggcactggctgcttctgtgttgcaggcgccgcacgggttcgtccgcttacacagaattgtattaaattgtctttttatttccccacccaggaaatgaaccacatcccccaacgactagacggaagcacgcacaagctccttcctcccgaggagcgtttccagtgacttgagcttggttggcccaggtcatttgactagaagctttgtctgcgtgcactgagtgaggatccggccctactgtgtgtatccctactgcgtgctcctggacctgttgggtttgactcttgatttgctgtttttgggtattcactggctgaggacagtggctgtgttcagtggctgtaaataaatggagcttgaactcaaa

SEQ ID NO: 706806 - DNA, 102 bp, Homo sapiens
gcggccgcctactactactactgctgctataataccttctaataacgatctgcgacgacctggacttgatgacccaaactgaaagaaccatgcatgtggggc

SEQ ID NO: 706807 - DNA, 365 bp, Homo sapiens
gtcgacgcacaatgtatgctgtttaattccaagagcagacaccgagagggagttcatttctatggaagcacagatttgagagagatttctaatctgcgaagctatgagtgctgtttttttgtttgttttttgtttttgtttttttttgggggttttttttgagacaaggtttctctgtgtagtcctggctgtcctggaactcactctgtagactaggctggcctcgaactcagaaatctgcctacctccgctccctctgggattaaaggcatgagccaccactggccggcctatggtttgttgttgttgttgttgttgttgttgttcttcttcctcttcttctccttctccttctcctgtcgacg

SEQ ID NO: 706808 - DNA, 223 bp, Homo sapiens
  misc_feature (213)..(213): n is a, c, g, or t
tcgctatactcggcacctcaggtggagcgatcttgggaagaagaaaaagtcttagcattaaaaagcctatattatatgctagaatctattccaattacatctcatgcattactatggttcctcgctagcttatcatacgccagttgctatcattaggtgctgaaattatgaggggcgagttacagacgtgaccttgatccctgtacctcacangcgttcacaa

SEQ ID NO: 706809 - DNA, 147 bp, Homo sapiens
tgatctacgcatccttataacagagtgtgcgattggcatcagtaatcgctgatcagtcttttacgtctctcccccaagagatttttattagatattgcaaggcaaagaaatcaaacccctttgccattgagtcaagccatattcagg

SEQ ID NO: 706810 - DNA, 3795 bp, Homo sapiens
  misc_feature (240)..(240): n is a, c, g, or t
  misc_feature (2452)..(2452): n is a, c, g, or t
  misc_feature (2509)..(2509): n is a, c, g, or t
  misc_feature (3728)..(3728): n is a, c, g, or t
  misc_feature (3731)..(3731): n is a, c, g, or t
agccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctncgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtttttggttcataggtgctcggcaggtggctgtgggattttttttttttggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgttgggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggnactcccgagacgtgtaatgacaccacacttgttttctttgtttctttgttttatttnggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttggggggggagggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttcctttggggggtaaagttggctctaccaaatagtgatggtaacaaatggatctgtttgggatgtggctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgcttttggtcatgttatgcagtgaactatttttaaggtctaatcagtgattatttttccagctccgggtttctctaaggaattatttcacacacggaccatctttagcagtttcctcagtgatggaatatcatgaatgtgagtcattatgtagctgtcgtacattgagcaaataaacttacagatcttgaaaccanaanaacaaacacaataacatcaaaaaaacacttttgtgggcccctggccccgaaaaattttaaaaac

SEQ ID NO: 706811 - DNA, 121 bp, Homo sapiens
ttttttcccccggggggggggggggagcaaaagctttggcccctttttgggggggggaaaaaaattggaggggtttttaattattttgggggggggaaaaaacccgggggaaagcccccca

SEQ ID NO: 706812 - DNA, 466 bp, Homo sapiens
tcagtgtctagatgcttatcttgtagttaaatataaacagaagtgtaccttttataataaacaaaaagaagttgagtaaaaaaaaaaaacacacaaccctgttagttccaaaaatgacattgctggcttaaaggttctgaagtaaaggcttgtaaagtttctcttagtttggattggaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagtttatgctgtaatagtttatgacagcataaactattccagtctgtcattgatgggcattggggctgatgcc

SEQ ID NO: 706813 - DNA, 139 bp, Homo sapiens
gtgccttcagaaaggtctgtatgttaactggatcactgaatctgtccagtcagcaaaacggttacttggaccagaattgttgaaaaagggagaccagcttcctggctttccatcatggtcgatggacccgggaaatcag

SEQ ID NO: 706814 - DNA, 106 bp, Homo sapiens
  misc_feature (82)..(83): n is a, c, g, or t
acccactcaccttactacagacaaccttagcaaacatttacccaataaagtataggcgtagaattgaaacctgcgcatagtnngtacgcaggaagtgaaatataac

SEQ ID NO: 706815 - DNA, 238 bp, Homo sapiens
ccaacgctcacacaaggttttttcctagtgtccaaagtgctgttcctctttggactaacagttaaatttacaaggtggatttagagggttctgtgggcaaatttaacagttgaactaagattctatctatggacaacctagctatcaccacggctcgattaggttatgtcgacctctactctataaactcttcccacttattttggctacattacgacggcgtgtgcgtcattttagc

SEQ ID NO: 706816 - DNA, 117 bp, Homo sapiens
agaggatccgtcgaggcgtaggtgcgccgtagccctgtggcacaatagtattcttgctcttatgcgatggatggacccgtcctgtatgcacattgcgaagacaccacggcactcccc

SEQ ID NO: 706817 - DNA, 237 bp, Homo sapiens
actaagaccctcctccctaaagcctacaagaaactaagaaagccgcaaccttccttcaagaacgcttcttatggttggctttttaactaaaaaaggtttcgacaaaatctaatattgcaactttatggcccaatcatcattggcaagggggtttaaaattatacaaccataacaaaaaaaaggaagcatggggaattgccacccattggaaataatagggttgaggggagagagaaa

SEQ ID NO: 706818 - DNA, 811 bp, Homo sapiens
  misc_feature (109)..(109): n is a, c, g, or t
ctggtgttacatgtagatcggaccacttatttcacctcgttctccatgaccacaagctttgaggattctgacctgaagtctgatggacgcacacagcatgccgaggacnaatcaccatttcttactagagacactggattgttcttatcattccccctttaaggaccacttattgtttcataacactgcctttcctgtgcttgctaccagactattactacttgctataccagtcatacagccacattgttagtaaaggacagtcaaaaattctgattacacgtcataggaagaccctacaaaatatggatatttattttatttcttattatacaagcatatccatgttatctttgatattgctacttggtccacacaggtggataaggtaccatgcttaccatctgaccctttatagaaaaaggtagctgacccctcgtctaaactatgaagacagaaccatctgtttttttccttattgcactcccacaacaggtgcaaatgggccctaaatgaccctcaccaagtgaatacatgatgcgagaaccgcccaccccccaaccagcgcccccccgtggtcgaccgcccccgccggcgcacctctccgggctctttccggctccagcgccccgcctcgggcgacctcgggaccccgtcgccgcgccagcccgagccgacgacagcccgcacctccccccccccccggtccccccgacaccgcgtcctcccactggcccacgctatctacgcgaccccggcccccccttgccaccggacgaggcccctcggaggggcgggcgcggcggctcct

SEQ ID NO: 706819 - DNA, 130 bp, Homo sapiens
gaccatcattgggtctggagttacatatatccatgggaaaaagttagtggatgacttggaaggttttgcagaaggaggcatgacttgatcaggagactgtaaatactgagtgggaaactgtgaaaagctc

SEQ ID NO: 706820 - DNA, 292 bp, Homo sapiens
tggggtgctcaactctgatgccggacatgggtgatccatggtgctgagaaaagccccaagttcagcagtaaggtaggtgagacaacgttactaatgacagtcaccagttactgaatgctccctaggagccaggcactgacggtactgtgctttccattcattatcccaccaaacccacacagattcctatgaggtatatattattattccccgtttatagaagaggaaattgaggattgaagaagttcagtcacttgcccaaaatgtaaccagatgtgaacctcagcagctg

SEQ ID NO: 706821 - DNA, 739 bp, Homo sapiens
ggtgtgacagggaaattggtgagcggcctccacctaaacgacttactagggaagctatgcgaaattatttaaaagagcgaggggatcaaacagtacttattcttcatgcaacaagttgcacagaagtcatatggaaatgacaaaaaggtttttttgcccacctccttgtgtatatcttatgggcagtggatggaagaacacacaaaagaacaaatggaacgcgatggtgtgtctctgaacaagagtctcaaccgctgtgcatttactgggataggaaatagtgaccaagaaatgcagcagctaaacttggacggaacgaactattggcacagccaaaacatggtatatatctgactcagtacaagcgaaagccacttcatgtcgtctggtacccgcatgtcctatggcaacagtgatgaccatcggtgtgttcctcagcccagcggcataaacagtcatctccaaaccttccaatacaagaagcagtcatcgaaaaagtgctgactttatgccattgcctcagggaaacaaagggtgggctctgctccaatctgactacgatccccagacagttaggctacccgattactggcctgtccgaacggcggtcacttcccactggccagctcacacggcagtggggaagcctatttaatcacactcccctggctggctcgccgactccgaagggcgagcaactcccagagccgggactgggttcctccccttttggcccaca

SEQ ID NO: 706822 - DNA, 285 bp, Homo sapiens
cccttaattgagggactaagagacccattttcacgcttcggtgttgatagtgctagagtttcaacagtgtggcatcatgtgcataacaggcatatgcatgtaaaattcgacatagtattaaaaccagagctagacagtcacagcaagcagtaaaaaatagattttcactccaggaactatgggcaataaagtaagggcattgcagtatagcaactgtgctcagttctgaaaagcacagcaagaatcacaggggggcatcatcaccgaggccacagattgcagtcg

SEQ ID NO: 706823 - DNA, 171 bp, Homo sapiens
  misc_feature (145)..(145): n is a, c, g, or t
atggcaggagtgtaggtggcgacgatatcggctcactgcaacatccgcctgcccaggttcaagccattctcctgcttcaaagaatcataaaaacattacaacagcctggcacaggtggctcatgcctcgtaatcacacgcacttngggaggaggtcgtggggtaggacggt

SEQ ID NO: 706824 - DNA, 175 bp, Homo sapiens
  misc_feature (91)..(91): n is a, c, g, or t
  misc_feature (112)..(112): n is a, c, g, or t
  misc_feature (158)..(158): n is a, c, g, or t
  misc_feature (171)..(171): n is a, c, g, or t
ccaccttcatgcgtgtgccctccttgcccacgaagatgtcatcaatgtccaccaggatggagcgggccaatggcagggataggcgcttccncgagaggaaggccatgtcctncacgatgacaagccttgctcagccagaaattcaggctgaagactgncagtacgccctgnaggc

SEQ ID NO: 706825 - DNA, 690 bp, Homo sapiens
ccccccggctttcctgcagggcctggggccaagcccagggaccttctctcctggaggatccagggatcaaggcgatcgcagccaagccaatataactacagccacggtcctgatccgttcccccatgcagaggaacttggtggtgatccccaagtctgtgacaccagaacgcattgctgagaactttaaggtctttgactttgaactgagcagccaggatatgacccccttactcagctacaacaggaactggagggtttgtgccctgttgagctggacctcccccaaggattaccccttccatgaagagttttgaaactgtgggtgcctggtcgtccccaagtgacccaaacctgtggttcttgcctcatttttttccctgcaaaagtagtatggcctgtgtcactcaacagtggggcaacaacctgtagagtggcccaccaggggcgtgtttagctttatgttggatttcaaaagccccgtcagtaaagtaaaagttttttccagtttgctttgcccttctttttaccccgctggggaaaggacaacctgaaaacccctttttggccaaaaagaagcaaaattttcccgggcaaaaaagggcccccaacgggtgagttttggctgcttggaactggaatcccttcagcaagacttttttttgccccaaaaaaaaaggggttttgtgga

SEQ ID NO: 706826 - DNA, 681 bp, Homo sapiens
tgtgtgttgtgactattcttagtctttagcttgccttttcattttcttaattatgtctttcaaagaacaagtttttcatgttgacgaagcctagtttatcaattttttttatggctggtgcttttgtgtgttccaagaaatcttgcctactcatttaattacctgtgtgcccttgtcaaattcaattttattttggataattcatttattaacttggctaattctttatattaaccgtggtggttcgcccctgtgctcacatattacacgggtatatcgtgtagaatcgtggatgatctatttatgtcatttatctatgtgtctcttcttatgccagtaccccactgtcttgattatgtggctttatggtgtcttgaaattaagtattgttaagctttgcaatcttttccaagattgttttggtataggtcctttctttataaagtttatattaagcttctccatttttctttaagaaaaaatctgtggaatggcactgaatttttaggtcgatttgggaagaattgaacaatattgaacctttcaatcgatggacatggtatgtttctgcatttattggggcttttaaaatttatctcagcaatatttgtagttttagtgaagaagtcttgtatatatcttttgttaaatgtattcctaatatttgtggaaatgtacacg

SEQ ID NO: 706827 - DNA, 141 bp, Homo sapiens
gtggtgtaattcggctcctgtggaggcctgctgggaacgggacttctaaaaggaactatgtctggaaggcttgtggtccaatggccatgttgttgctgtgctatgaagcggggggctccggaaccaaagggagcacacagc

SEQ ID NO: 706828 - DNA, 369 bp, Homo sapiens
catgctattgtgcgcatgacaggttaaaagtctatgcagactacgaagacctatgtcaagtgtcaagatagagagtgagatacagcatgtacatgaatccaaaggccatggaaacacaatggtacacaaaaacatagctgcctcggggaaattctccagtgaccgaacaattaaagaatatgcccaaaacatctggaacgtggaaccttcagatctaaagatttctctatccaatgaatctcacacagtccatggaaattgaactctacaatgtctctagaaaacatagcttcttactgaacttgaacatttttacaacattcactggttttagttttgttagctaataatctataatcgttgagtatc

SEQ ID NO: 706829 - DNA, 212 bp, Homo sapiens
ttctggcttcagttgcattgtctgtacctaatgagttttcatagcaaagaatataaatttgctgtagattttggtatgaattttttcacaaaaagatcctgaataagcatagttttatgaattttacatttttcctcaccatttagcattttctgaacggtaataatgtctaaatctttttcctatctgaatacttgcttgtacattttttt

SEQ ID NO: 706830 - DNA, 848 bp, Homo sapiens
agctcttgggaccaagcttatacatttcaccagaatatctgtaattgagcagcagtcatatcgccacagcttgtgtgagtacacagcgtaacagatgcggtcgagacctgagatgtgctcgtttgattcctcctctcccagattggctccagcaagaaaagtccctcgtgcaacaggcagctcttgtgccggcactacttgcataacatggctactttctaagctacaaaccattagaacataactcaaacaagatggcagaggcaaactccacacgaaggggggctgccctccatcacacagcacgcccgtacccacaccttgagcacacaccatgacagatcacccagcttggatggccgtcacctcggacatcactccagggagcacccgcaggagctgggcccctcagcctgcttcctgggccagcttcctgcttgcggccactcgcatgcacagaggtggggcttcgggcagggaagcggccgattcctcataggtgagtccaaatgacctccagcctctcgcaagtgcatcacagcgcccctctgacgaactcgcactaaactcaccaaaagcttcagctgcttgcccctgcctcgacctccatgggtctcttcggtgttccttcgtttcaccccagacaagtgcgcggcttccccctcgcccatatccgcgccggacaccttgtcgggccccccaaggcgcactactgagaccagcgcttccttgccgcggcgcgcgcgccccacttttgtgcgcacctgtgccacagcgctttctggacgccgggtcgtttcactggcttgccaatcatccctttcgcacatctgtctttgcccgcgcgg

SEQ ID NO: 706831 - DNA, 101 bp, Homo sapiens
tcattcgcaaggtccaaggaggttgtggaggagaaaccacgctacgaaataaaaaagctacctgcgagttgtgcccctactctggccttgcccatatgcaa

SEQ ID NO: 706832 - DNA, 411 bp, Homo sapiens
aagtcaggatcggtgcaggacaggcttgttcgtgtctgcaaaccctgcagtataaaacgccggccgaacaggcaatcacgtgatttgggacaggggtggagatgtgagggagggaaaggggatctttagcttcaatatgtcatctcccagcacgatgagagtctgaacctgtggtgtagctgggtctgcgacaagcaatggtatcagctgctgtaacgatgtgatgatgatcacctgtggtaccatggcgtcttctcccgggtgagtcccgatttcacctgctgtaatgatatgacgatgatcacctgtggtactgtggcatcttctcccgggtgagtcccgatttcatctgctgtcatgatatgacgatgatcacctgtggtactgtggcgtcttctcccgggtgagtct

SEQ ID NO: 706833 - DNA, 285 bp, Homo sapiens
ggtaccgctacgagattacgtgaacgctgttatgtgggaacaaactcagccccaatgcatcttggctgaggatcgcagcgctggcctagttctcacctagccctatgctccacatagggccaaggagggtttgggctgcctctggctccttgggcactgctgcttggctggtggtctccccagctcgacaccaactgagcccagtttccctttgcacaatgcagctcctagaagcgcgttttgggccgtttcggagctaggtccgttcacttaatgccgctagcg

SEQ ID NO: 706834 - DNA, 112 bp, Homo sapiens
cggcctgatgagtatcttcattcttcacctgaggctgtccctacattcaaggtgaagaatgaagaatacttcatcagatgcacaaacagagccaaagggttgatcgagctac

SEQ ID NO: 706835 - DNA, 392 bp, Homo sapiens
  misc_feature (11)..(11): n is a, c, g, or t
  misc_feature (25)..(25): n is a, c, g, or t
  misc_feature (37)..(37): n is a, c, g, or t
  misc_feature (106)..(106): n is a, c, g, or t
  misc_feature (146)..(146): n is a, c, g, or t
  misc_feature (225)..(225): n is a, c, g, or t
  misc_feature (256)..(256): n is a, c, g, or t
  misc_feature (350)..(350): n is a, c, g, or t
tacccgggccnacccagccccagcnaatttttggtanttttaggtagaagatgggggttttcgcccctgttggccccgggctagtgtcaaactccctgaccctcanggtgatcccactcgctttggcatccccaaagtgcctgggntcacaggcgtgagcctctgcgcccagcccccacatgtcaggttaattttatacataacacagtgacttgagttttatcnacatcattatatttaatttcagatatttgcntctgtctcagaaatgtgagactatgtatatcctctgtattttataaatttacccagaaattggatttgctctatacatacttaataaaatgtcntaaaatatatatgtcttaaaatgtaaacaataaattctggaa

SEQ ID NO: 706836 - DNA, 372 bp, Homo sapiens
cgggtgaggggaggcaggcagagaggactcagagtcagaagtgggttggttggagagagtgggggagaggggtagagccggagcagggacatacggtggaggatcatgatgctctggtggaggatcatgatgctgtcgaggagggagaaaatccacggggtcaaaggacagcaggcagtcatcggctgggtctcgtgggtgggagtgacgggagcatgagtcaggttttgagctggtgagcaggatttggacaagtagagcaggagtggcagcacagaagggtggttccggagaatgaacaaacctgaatatcaggaatctcagaccatttctccattgcgatggcaaaagttgtctaagtctctaagtata

SEQ ID NO: 706837 - DNA, 122 bp, Homo sapiens
tcatggcaggcgcagtgagctcatgcctgtatcctagcatttgggaggcgagaagggtgatcacctgaggtccaggagcaaagacccagcctgtcaacatagccgcgggaaaaaacccccag

SEQ ID NO: 706838 - DNA, 354 bp, Homo sapiens
gacttttttttctttttgtttaaaaatcatttgataaaaaaagtcactgcatcctttgcatcattgcaactgcttagactgtgtctccaaatttgtagaaagtttttgtataactagtaacccataattaatttcagatacatacaattcacagaaatcactcaacaagattttacatggtttccaatctagaggaagagttgtgtaggtaagcttagatgttgggatttaaccatagattcagttatttagggccaacattagagctcgtttgaatttaagaaataaggccatgatttttatgaaggctccccctatatccccctttagagcgctaaatagagagtggtacga

SEQ ID NO: 706839 - DNA, 164 bp, Homo sapiens
aggggggggtttttttttagggggggggttttgggaattttaaaggggtgttttacaaaagtcccccttttttttttaggggggggggggggcccctttaccctttgggccccatcaggccccctttttgtttttgtaaaaaaagtttttttgggcccccccca

SEQ ID NO: 706840 - DNA, 183 bp, Homo sapiens
ccagattgactttcttcttcttctccttctccttctccttcttttttttttggagactggagtctccgtcggtcactcaggcgggagtgcaggggtgtgatcgggactcacggttaaccttctaccttccgtgggtttcaagttgagttctccgtgccttcagccttccgtgagttagctgtg

SEQ ID NO: 706841 - DNA, 122 bp, Homo sapiens
tatgagtgtatgagatcatgaaggttaattaagtgtttgaagtttatctcttagcagtggaaaacaatatgttggatgttttcattcttgctacttttttcgtgcttaatctaccattctgt

SEQ ID NO: 706842 - DNA, 424 bp, Homo sapiens
  misc_feature (122)..(122): n is a, c, g, or t
ccggcttcggtcgagggccgttcgtggtgcagcgcgtgcgccatcggttcggcggtggtgtcgccgatcgcgccgagcagtggcggcagacgcggcgccggtcgcgtcgtccacgcgaggtntgaggtcgaggttcactggtgcgctccttccggcggcgtgagcccggcgcgctcgtaccgcagccggtcgcggtgtgccgcggtggccgcgaggtcgggtgtgccgtcggtcaggacgacgccgtagacgtcgagcgcggcgatcgcggacaccttgccgtcgcggacgtcggcggcgacgcgttcgggttcgcggtgcagcgggtcgccgattccgccgccgccttgccaatgggtgaagtagacgtccgcttcggcgaggtcggtttccaggtgcggcgggagggtgtccgcgcggccgc

SEQ ID NO: 706843 - DNA, 223 bp, Homo sapiens
ttagacgatcctctctgccctgaaggaggctctgactgtatcactaattttacgaaatatggcttgcatgtaagcttcttatcaaggtgcaagcttggaagctggtctccgaagtacatcctcaggagctagaggcacaaccaggattaacttgaagagaacccttgtgggttcttccctcttggaacttttgacatgcttggagggtctcttggaagaaggg

SEQ ID NO: 706844 - DNA, 126 bp, Homo sapiens
cccgactagcccgaagcggagagtggatagggagcaaaaatgccagagacacagggcagagatgaaagacagcttgagcgctggcagaaagcaggcattacctctgccctgtcgggctagtcgggg

SEQ ID NO: 706845 - DNA, 693 bp, Homo sapiens
ttcagaggatccccgagttgaaatgtgttggtcacccaagagtctgatggagatgtacaaagagattaatgttttatgtctgctaaacaacatccattctgcaggatccattagtccatgggtcaaggagtaattttgactttcaagtattatttaaggaatacattttgtaaggctgtggctgccatagtggttgttctgtacaaagtaacttgaaaaccttctggaaaggattcatcattctagatgccattaaggacatttgtgattcatgggagaaggtcaaaatatcaacattaacaggagttcagaagacattgacctcaaccctgatggatgatcttgaggggttcaagacttcagtggacgaagtaactgcagatgtggtggaaatagcaagataactagacttagaagtggaacctgcatatgtgactgaatggctgcaatctcatgataaaacgtgaacaaatgaggagttgcttctaatataagagccacaaaagtggtttcttgagatggaaactactcctggtgaagatcctgtgaccattgttgaaatgacaacacaggacttagaatattacataaacttagttgataaaacagcagcgagtttgagaggacgacttcaatttgaagaatgtcactgtgggtaaaggctatcaacagcacacatgtacagataatctt

SEQ ID NO: 706846 - DNA, 1181 bp, Homo sapiens
  misc_feature (587)..(587): n is a, c, g, or t
cggcacgaggaagaaatgttttcagtgtgcagattgctattgtttgaatatccccagcaaaattcttgttgaaacttaatccccattgtaacagtactgggtggggggtctttaagaggtgatcaggattagccaagttcatcagggtggagcctccatgatgggactggtggctttatgaggagaggaagagcaactggaactgggacacatgcttgctctgtcttgccttttgatgcctcctgccatgtcatgatgcagcaagtaagcccttaccagatgcctgcacctttatattggacttcttagccttcagaactgtgaactaaataaacctctattctgtataaattacccagtctatggtattcagttagagccacacaaaatgtaacaagacagaatattgatagccataagtaggtttgctgctctgacatttacataaaaatgtagaagtggctttggaactgagtaatgggtagaggcttgaaaaatctggaagatcaggtcagacaaagcctgtattatctaatggagcattaagggtgattttggccaaggcttagaagagaagactagggaangtctgaaccttcttagagattacaggaggtccttgaacaacttgggtttcaactgtgtgggtccacttatggactttcttctgcctctgtcacccctgagatggcaagaccagtctccctcctctccccttctcagcctgcttaacaaaatgacaaggatacagacctttatgatgatccatataatatagtgaattatatttactaaatataatttctcttatgattttcttaatattttctctagctttattataagaatatagtgtctaatatgtataacataaaaaatatgtgttaatcgactgtttcagtaaggctctggtcaacagtagactattagtagttacatttttggggagttaaaagttatacatggcatgggggttggtgcccatatgatgggactgatggctttataagaagaggaagggagacctgagctgacatgcatgctcttgccatcttgccatgtgatgctttccatcatgttatgacacagcaagaaggccagatacggcccctccacagttcccagccctcggaaccatgagctaaataaacttcttttctttataaattaaaaaaaaaaaa

SEQ ID NO: 706847 - DNA, 177 bp, Homo sapiens
  misc_feature (132)..(132): n is a, c, g, or t
tccctcagacagctggaccccctatacagacccgagtcttcagcggctgggagcgctgttcactgacccgcagagccgcgcttgggaggacccagttgagaaacagctacagcacgagcggagggccggagnaaaagcgcccccgaggtcgctgtcaatggggggtcgggctgtctg

SEQ ID NO: 706848 - DNA, 853 bp, Homo sapiens
  misc_feature (587)..(587): n is a, c, g, or t
cggcacgaggaagaaatgttttcagtgtgcagattgctattgtttgaatatccccagcaaaattcttgttgaaacttaatccccattgtaacagtactgggtggggggtctttaagaggtgatcaggattagccaagttcatcagggtggagcctccatgatgggactggtggctttatgaggagaggaagagcaactggaactgggacacatgcttgctctgtcttgccttttgatgcctcctgccatgtcatgatgcagcaagtaagcccttaccagatgcctgcacctttatattggacttcttagccttcagaactgtgaactaaataaacctctattctgtataaattacccagtctatggtattcagttagagccacacaaaatgtaacaagacagaatattgatagccataagtaggtttgctgctctgacatttacataaaaatgtagaagtggctttggaactgagtaatgggtagaggcttgaaaaatctggaagatcaggtcagacaaagcctgtattatctaatggagcattaagggtgattttggccaaggcttagaagagaagactagggaangtctgaaccttcttagagattacaggaggtccttgaacaacttgggtttcaactgtgtgggtccacttatggactttcttctgcctctgtcacccctgagatggcaagacctgagctgacatgcatgctcttgccatcttgccatgtgatgctttccatcatgttatgacacagcaagaaggccagatacggcccctccacagttcccagccctcggaaccatgagctaaataaacttcttttctttataaattaaaaaaaaaaaa

SEQ ID NO: 706849 - DNA, 401 bp, Homo sapiens
  misc_feature (362)..(362): n is a, c, g, or t
ggatagctgctcatcctgggaaatgccaagctcatccgactcccctgacagctccttgatgaagttggaaggaaacattccagtcttcccgttgagaacaccttcccaccatccttcctctaccttttctaccggcagaaagtcattttctacttcaattgaccttggtcttagtttgattggcttgtctttgaaaatgtctccaaagcccactcccttaactttcttgggctggattgctgcagttgccactgtcccgttggcaccttcagacttggtgctgcttgagtcacccccatcactctcggagcctgtggtttcccttaaacttatcttggatagctgctcatcctgggaaatgncaagctccgagagtgatgggcggtgtatcctctagagcg

SEQ ID NO: 706850 - DNA, 371 bp, Homo sapiens
aaaccccccccgggggggtttttccaattttcccgggaaggtaggttcgctctttcccaaaaaaaggttgggttgggggggttttgggggcccggggggccggctggggccaatgctgggccccttctttttttcaaaaaaaaacccaaacccgggggggggccccccccccccgggggggggggttggggcaggggttttggttttcattttcccccccccccaattgggcctttttcccgggctttttttccccgggggggccccccaaggggggtttatttgggttgggcctcccaaagggggccggtttcccccggccccccctgcccccgggttttgcccttaaatttctttttttttttggggga

SEQ ID NO: 706851 - DNA, 145 bp, Homo sapiens
tataacattaagtaatctatagggttctttatgggaattatctggtgctggatacttacaaattgtatctagctgcagactaattttaactaattattactgttttcctggtaaaagtgtgtgctgattagaattgaccaatatt

SEQ ID NO: 706852 - DNA, 674 bp, Homo sapiens
  misc_feature (130)..(130): n is a, c, g, or t
  misc_feature (157)..(157): n is a, c, g, or t
  misc_feature (220)..(221): n is a, c, g, or t
  misc_feature (275)..(275): n is a, c, g, or t
taaagtcattgtataacgcacgaatgttccctgctgtgagtacttgtgaaagctaaattagtttagcttcccgtccacttagaagtgctgctacactttacagcagcttcctttctttccatggcactgnctagttaacagaagtcttataaaaatntaaaaagacacatttcttacaagttgaatgaggtaaaatggcattagatggctctatattttnnaaagctatgtaattgttcagcgtcacttttctaagtacttatacatatctaaanatgtcttcatggtttatattttcagttatatatgctgggctggattaagctttgttgtgattgtgaccaacattcaggccacgtgagcactgtcttatcacatcgccaattagttgtaataaacgttcaacgtcacaaacgactgtgagtgtgttctggatctctttccaaaagttggtcaaactatgcagagctgctgaaggaagaatgctcatatagttcctcacgtgaaaagtgttgaaaattcctcctccatcttgaatatggtggtggtataagcacacacaagatacatggtggacagatctagaggagtcttcatgtacttcattgcgacaatgcacctggattccatacgtgagagcctatctacacatttattttcaatcattacctgct

SEQ ID NO: 706853 - DNA, 407 bp, Homo sapiens
  misc_feature (368)..(368): n is a, c, g, or t
acaccaccgagtctggagttgctgtagttgcaggtacttcttcccaatagtcttttctaccggcagaaagtcattttctacttcaattgaccttggtcttagtttgattggcttgtctttgaaaatgtctccaaagcccactcccttaactttcttgggctggattgctgcagttgccactgtcccgttggcaccttcagacttggtgctgcttgagtcacccccatcactctcggagcctgtggtttcccttaaactgtaatagcgtctgtggccctccgtctttcccggtgcagctcggtacagaattgtcccttcaaaggtagtctttcttgatatcttggatagctgctcatcctgggaaatgncaagctccgagagtgatgggcggtgtatcctctagagcg

SEQ ID NO: 706854 - DNA, 729 bp, Homo sapiens
  misc_feature (130)..(130): n is a, c, g, or t
  misc_feature (157)..(157): n is a, c, g, or t
  misc_feature (275)..(276): n is a, c, g, or t
  misc_feature (330)..(330): n is a, c, g, or t
taaagtcattgtataacgcacgaatgttccctgctgtgagtacttgtgaaagctaaattagtttagcttcccgtccacttagaagtgctgctacactttacagcagcttcctttctttccatggcactgnctagttaacagaagtcttataaaaatntaaaaagacacatttcttacaatatagagccatctaatgccattttacctcattcaactcttttttgtaagaaatgtgttgaatgaggtaaaatggcattagatggctctatattttnnaaagctatgtaattgttcagcgtcacttttctaagtacttatacatatctaaanatgtcttcatggtttatattttcagttatatatgctgggctggattaagctttgttgtgattgtgaccaacattcaggccacgtgagcactgtcttatcacatcgccaattagttgtaataaacgttcaacgtcacaaacgactgtgagtgtgttctggatctctttccaaaagttggtcaaactatgcagagctgctgaaggaagaatgctcatatagttcctcacgtgaaaagtgttgaaaattcctcctccatcttgaatatggtggtggtataagcacacacaagatacatggtggacagatctagaggagtcttcatgtacttcattgcgacaatgcacctggattccatacgtgagagcctatctacacatttattttcaatcattacctgct

SEQ ID NO: 706855 - DNA, 548 bp, Homo sapiens
  misc_feature (362)..(362): n is a, c, g, or t
ggatagctgctcatcctgggaaatgccaagctcatccgactcccctgacagctccttgatgaagttggaaggaaacattccagtcttcccgttgagaacaccttcccaccatccttcctctaccttttctaccggcagaaagtcattttctacttcaattgaccttggtcttagtttgattggcttgtctttgaaaatgtctccaaagcccactcccttaactttcttgggctggattgctgcagttgccactgtcccgttggcaccttcagacttggtgctgcttgagtcacccccatcactctcggagcctgtggtttcccttaaacttatcttggatagctgctcatcctgggaaatgncaagctcattcgtctcccctgacagctccttgatgaagttggaaggaaacattccagtcttcccgttgagaaccccttccctccttccttcctctacctctcctcccagctctatgatgtcgccaactttcagctcaagttcatcgtcactctcgggcaggtagctgaatgccacctggcaaaagc

SEQ ID NO: 706856 - DNA, 175 bp, Homo sapiens
aggactgggcagcttgttgaaggctcgtccaaaagtagcacttagttatcacaaggcctgcactcaacctcaaaagcgtaaggttaaggccaggcacggtagctcatgcctgtaatcccagcactttgtgaggcagaggcgggtggatcacctgaggtcaggagttccgagacca

SEQ ID NO: 706857 - DNA, 152 bp, Homo sapiens
acagaaaaatcctgctgaaaaaaaacttctgaggtacataaataggattatcccgtatcgaaagggctttttggacaggtggtgtgtggtggccttggtatgtgctttctcgtgttacatcgcgcatcattggtatatggttagtgtgttgg

SEQ ID NO: 706858 - DNA, 100 bp, Homo sapiens
ctcgatataagacggaggtaaagtgggtctggtgcaactagtgtgtaagtcagggagagtgcgtcatatgtgtcctagaagatgataccatcagtaggga

SEQ ID NO: 706859 - DNA, 94 bp, Homo sapiens
acgcgtgggaaatgaagaccatgagtgaacagttgtttcctaacccatggctatttagaatcttttgccaaagaatgacaataaatcccatgaa

SEQ ID NO: 706860 - DNA, 124 bp, Homo sapiens
  misc_feature (4)..(4): n is a, c, g, or t
  misc_feature (23)..(23): n is a, c, g, or t
  misc_feature (88)..(88): n is a, c, g, or t
gtantctgagcaagacaccacanttatccattcagtgcaccctatgtaactgctagatccatttgctttgtataaaacagtcacaccnactgcttcctttgttgaggaggtggggggtagggtg

SEQ ID NO: 706861 - DNA, 698 bp, Homo sapiens
  misc_feature (129)..(129): n is a, c, g, or t
  misc_feature (135)..(135): n is a, c, g, or t
agcgggcattctgggattacttctttaccgtgggagtaaggaagtgctttgaatgaggtactgagggccaaggtgttggaagttcctaatctctttcctacggcttaagccgtgtgaagactctgcggntgttgnggataggccttgtgcctcaaggtcatcaggccaggagaggctactggacgccgcgcacgcacttcgtctgccagcgaggcccaaaggggaagccgtagcggagctcaggtgtggcagctgctggcctctgggccgctacgttgtcaataccatgcgtttcctgtagatatttgtggtgaaacagtaacctcagaaccagacatgaaagctcacctaattgttcacatggaaaagtgaaattatatgtccattttgcaagttgtcaggtgtgaattatgatgacaatgtgttcttcatatcgtaaacagctcatctggacgcagaatacaccttgacccgaaacctttgagaggatagatacagtacaattatggaacttcagactaacaagaaagacaagaccctacagctgtggaactggagggttaaggcaagtgttctttcaggttgtgcatctaatcatccaaagagattcagctctaggaagctgagcgtaaagatagtactttacaatgcatgaaggcttctattcagagaacttaactgaatctagaaaattcctg

SEQ ID NO: 706862 - DNA, 900 bp, Homo sapiens
tggagatggagtcttgctctgtcacccaggctggagtgcgggggcctgatctcagctcactgcagcctcagcctccgcctcccgggagaatcgcttgagcctgggaggcggaggttgcagtgagctgagattgtgccatgtgcactccagtctgggtgacagagtgagacccgtgtctcaaaacaaaacaaacaaacaaacaaaaaccaccaacaacaaaaaaaccatgtttggtatgtctttccagattttatgtttctgtctttttctcttttaaataaaaggggatccatactaacatggtctttaatcttaagggttggtcttaaaaagttgtacctgggagatctggcctgtgtaatatttacagatctgctacattttaaaagggggcttgaaaatcttcgtgtatgtatgtacggtcattaattctgttattttttcccactagtactatcacctacggtaaagaccttcctctgggcccagggaatcaagttccagtaaaggtggttcagatgaacttcccttaattggaggtggtcccagcagctgtttgggcgaagacaacgacaccttcacgggtttccctgattaagtgacttattatgactgtgacagtgactattccccttatgacccaaaggcctgattacatcaaggagattcctttttaacacttccacttcacttgtgcccaacattagccagagtttcccaaaatctacaccagcagcacacatacaaaatcttttgtcgcgaccctctgcgccgcaagaaaagtctttagacacactcgttggggcgcggggccccatagtgttatctcaacatgggtccacagggttccaagaggacaccgcgcatacaaactggtgtgttttcccaaataaaaacgcc

SEQ ID NO: 706863 - DNA, 328 bp, Homo sapiens
ccgtggccggagattacagatcaagcaataggaggcctcatgtacactttctctgagttatcattagtagtagttatcctcttaccagttatctagagacggcaaaattgtcgcttttttgaaattcaggtaagatgtaactcgatgaactgaggatgtgcaaactcttttattcccatgaaataagcatttccgttttgctataggtcaagatcattgttgcctctgactgtgctactcttgtactagagtcaacatcagtggcattaaatgattatgaacaactgtgaactgccgtgtgtgtccagaactctggtgtatgggaggc

SEQ ID NO: 706864 - DNA, 203 bp, Homo sapiens
  misc_feature (34)..(34): n is a, c, g, or t
  misc_feature (69)..(69): n is a, c, g, or t
  misc_feature (72)..(72): n is a, c, g, or t
  misc_feature (85)..(85): n is a, c, g, or t
  misc_feature (143)..(143): n is a, c, g, or t
  misc_feature (146)..(147): n is a, c, g, or t
  misc_feature (189)..(189): n is a, c, g, or t
cccaccccaacagtctaactctaaagggggtaangccaatggctttcctcacaagagctcacggctaangtngctttgctatcanaatctgtatttctgatccgttatgagcattggggcgaggttcagatattcccggaggnagnngcgcaatgcacgttgtggtcgcctattcagcaacagcgggcnctgcgtccagaact

SEQ ID NO: 706865 - DNA, 434 bp, Homo sapiens
tgaggaggaggaaattgatgatgaggaaatagagcggcggcgtggcatgatgcgtcaggacgcacaggagagaaaaaatggaggagatgggagtcatgtggagtgtggaaatatgagggtcgctctgagagagtgagtcagaatcaagagtctgatgtatgagagagtacacagcacagttgaagatgagagtggagcctcgcctataagcccagtcttccattcggaagagaagggaccgagttgaccaggttccaagaaacgttgaaagcccgaagcttttgaaaacgagaaggggcgctgggcgccagggaagccaaaaacgctattggcttgagggaaaagggcgcaatgtaccgcacctcaaacacaatgcgtgaaagagggctcaaacacaaggctggaagaggggggtacccgggctcggaatttcc

SEQ ID NO: 706866 - DNA, 415 bp, Homo sapiens
aaaagatcccagtttctcaatttgcactgccagatgctttaaaaattccaaatctttctattgaaggggtcagcagacctctgtgagttctgaaaactgatttttctctgcattcttaagaaagcaacactctggcggggcgcggtggctcacgcctgtaatcccggcactttgggaggtcgaggcgggcggatcacgaggtcaggagatcaagaccatcctggctaacacagtgaaaccccgtctctactagaatacaaaaaattagccgggcatggtggcaggcgcctgtagtcccagctactcgggaggctgaagcgggagaatggcgtgaacctgggaggcagagcttgcagtgagccgagatcgtgccactgcactcccgcctgggcgacagagcgagactccatctcat

SEQ ID NO: 706867 - DNA, 108 bp, Homo sapiens
  misc_feature (3)..(3): n is a, c, g, or t
  misc_feature (97)..(97): n is a, c, g, or t
agngtattcacatctcatatcttatattgcaagtcccttttgccacttaagagtacaccacaggtatggagattaggaggtggacatctttcagggnccattcttatt

SEQ ID NO: 706868 - DNA, 589 bp, Homo sapiens
catgcggccttgtgggtcacagtgcatgcctgggaagccacagctgaggggcgcagactgaagcatgatgctccacctctccttctttagctcatggggtttgcttggtactgtggcatggcgccactgagttggcccctggtggacttgtatctcatgtgtgcatgtctacttaagttcaccacacacagtgcagcatctttatcccctcatcacctacttgaactacattatcatcattgtgccattgtatgcattatttgtgccatcaaaaccagtgccttgcttgggtatgctgcatcatgtggactgtttgatgtgccttacaaactccatagacacccttggcacatatatcacattgttacttccacttggagtctcttgccatgtgggccataaccaatagtgcgggggatggggtgtgggaaccccaaaaatagaactcaccagtgtggaacgtcttttgttgtgcggatgggtaatggccccagtggtccctttagcactccccaccaaagatttttggtccatatatttttaaccccaacatttcaacgggagcttgtgtgaagaaaagaaaaaaacc

SEQ ID NO: 706869 - DNA, 962 bp, Homo sapiens
  misc_feature (618)..(618): n is a, c, g, or t
ggagtgtgcgagtcgcttttccaggatgccgaggcccaaatcggtgccgggcctgaatgggtcccccgtgccagccctgcgtgcctgtgccgatcatatctgcctgcctgcgtctgtccctgcgttctcggactgatgtgctgccgttgtcggacagtggcatgcaggtgtccagagcctcatggcagccgcgcccatgtgtgccctccgaggtgcccattccaggtgtcatgtaatgcccaggaggtgaaagcttttgaccatccagtgtgcctaactagcaaagcaattgtgttgctatggacagagctagcctagatagtacacacagcacttgctagccggtcaagatgagggctccttaggattggcctagataaattgcaagaaaggccctgaggttaatggaggcagccttcaactccctgtggggctggtgtccacccaggggctggcgcccgagcctagtatcgtccagtccgttcggtaggaaccttgcacagtcccctctgctcgtatccaagcgcgggagagcacgctgtaggtcgccttctgctcaacgcccacttcgcttgtggagtgttgggcttccttcgagcacacttagaccttcgcgtnctcacatttgggttcgcctaagaacaggaattcgatatagctgtagacattggacatatgcaggcttgggagtttgattgttgatttcaaggagcgctcgtcacacgtttgcacggcaccagaaaggtttacacaaagtcgaactggcccaacaggattcgcgcgaacaaacccaattgtgggtctagacgaaagccaacgagaaggggttttggggacacatctccaagaggagagttcctgcaccagaatgaggggacgtattctagggagtgtagctaaccgtttgacagcacggatcacatacaacataggtggtaagggacacgacaacaacataagaa

SEQ ID NO: 706870 - DNA, 949 bp, Homo sapiens
tttgcgtcgtcgtgctctcctccttgtgctgcgcccctgtcattagcccctcttcgacccgggctcgggcctggtcccgggctcgttgcgtcgtcggaccctttctgctgtgctctggcgctctgttgtgggggctgtggtaccctgctggccgaggatggcgtccccctgcccgttccgctttctcggttccctctcggcgttccgtggcggccattggttctgttccctgtccgactcgtcacctgtccgtctgagtgatgttgggcgtgcccttgcgtgtctgttagcgccttcattcctggctgctgttggtccccatcctgcattttgtacgcccctctgggtcccttgttggttgcactgtgccttgagacccggcatcatcgaccgcgaagggcctctgacacatccttagcccatgtgcacgctacaacgcccttacatactcacggaggcccacggtgcgtcccccttccacggcacattccaaccatgttggaacgctacaccgtatgcggagaccatcatcgtgcccaagccttccacgtgagccatacttaccgaatccagagacacgtttcgcgcacgacacacccgcgtctatttgacattgctataggcaaccgtgattcacagagtgagcatcgaaccatgatacggccagcgcagctccatcgtgcatgtgccctgggctttcctagctgtctccgaatcggcgcaagcaagggcctcatgctcatcagccgtcgggctctcatcagctggatcgtctccacgcacagctagcatctcgcgtcacttgcggccatcctccagtccaaagctcctgcctttcggccacttacggcagatccagctcatgcctgccagtggcctcctttaggcaccagctcattcctcacgtcggccattcaggccctgtttttcccttccggcagcctcttac

SEQ ID NO: 706871 - DNA, 359 bp, Homo sapiens
catggcatacttttggttaaatagctgggattcagggttacagatttgattgacccaagggaaaaaatactgccactaatcatttttaagggctatttcaaaaaaatatgcccaaggtttctaagttattgggactttgggactgtcgtagctttaaattataatactaatatcctactatgagaaaggggtaagacacaggtttaacaaacaactacattaacctggggcaacaaccatcatggagctgctgtaacacaggcatggggggggcgggcatcgggctcttacacacaccagggatgtgaactgacatcccgcctttccaaaaacaaacatttaactcaactgttttttgc

SEQ ID NO: 706872 - DNA, 773 bp, Homo sapiens
ttcatcgcgcacgtttaaccggttgtgccctgaccaccgggcaaccaacaatccgggcgctcacgggcccgagctcaccccacagatggtcggactccaagaacatgatggccgccctgcgacccgcggcacggccgctacctgacggtggctgcacattttccgggccgcaagtccctgaaggaggtggacgaccagaagctcaaacggccaggaccaggaccgcagctacttcgtggagtggagtcccccaccacgtgaagacggccgtgtgcgacatcccgccccgcggcctgaagattgtcggcccccttcaatcggcaacagcacggccactccacggaggctgttcaagcgcatctccgaggccgttcacggccactgttccggcgccaggccttcctgcacactggtaccaccgggcgagggaactggaacgagattggaggttcaccgaggccgagagccacatggacgacctggtgtccgagtgacccagccagttcccggacgccccggccgacgaaccaggggagattcgaggaggaggagggcgaggacgaggcgtttaaaacattctccagatccatcgtgcatccctttagtgaacattctgttgtcctccagcctggtctttctacttgtaaactatggtggtcagattttgcctctgttaggaattcaccctcgttgaagtaatgatgtggagactccttttaaaattacagtattgtctgtgaaggtatttatacttattaaaaagcatgtgtaga

SEQ ID NO: 706873 - DNA, 161 bp, Homo sapiens
gcgagtatagcgcccctagcctatacgatgctatttcccctggccatcatcttactctccctgtcacctacactgtcaatctgtcccaaaccttgggccacttcatcctgcccttctgcggtcacagctgtctgctggggggggcgcgttggctggggggt

SEQ ID NO: 706874 - DNA, 308 bp, Homo sapiens
  misc_feature (4)..(6): n is a, c, g, or t
  misc_feature (17)..(17): n is a, c, g, or t
  misc_feature (31)..(31): n is a, c, g, or t
  misc_feature (41)..(41): n is a, c, g, or t
  misc_feature (54)..(54): n is a, c, g, or t
  misc_feature (62)..(62): n is a, c, g, or t
  misc_feature (72)..(72): n is a, c, g, or t
  misc_feature (94)..(94): n is a, c, g, or t
  misc_feature (102)..(102): n is a, c, g, or t
  misc_feature (110)..(110): n is a, c, g, or t
  misc_feature (125)..(125): n is a, c, g, or t
  misc_feature (155)..(155): n is a, c, g, or t
  misc_feature (240)..(241): n is a, c, g, or t
  misc_feature (297)..(297): n is a, c, g, or t
gtgnnnactgggggagnccttagatagcaancccggactcncagcgggaatgancggggatnccccgggcancagctggagctaaaggaagggnaggcccanaggggccnccgcagagccgagtngggcggcatcgtgctggtgctctggccccntggagtggagcaggcagataccgttaagcgctgtgctaccggccccaggcccagccacccggtacctcccgagaggctgtccctnnccctggctggcatggaaatacagtgggaaaaccagtcgggacctttaataaaagancttggctttct

SEQ ID NO: 706875 - DNA, 1243 bp, Homo sapiens
  misc_feature (1243)..(1243): n is a, c, g, or t
ggggcatattggagccctgggcgatcgcggaatttcttccctctgtgttcctggacacagaggaggtctaacgagccagaggtattgcccatgccatccgactatctcatagatctgccctagcattgagtgccttctccgtagcgaggagtcagagctagccactattgcattgcctgtcataccctgtggaggtgggggaagtgtatccctcattccggtgctttcccaatccatgggccagctgtatccaggacattcacttgcccatgccagccctccctggcagcccattgtatctccttcctattatctcagcccccatgaactttcccgtgaggaagaatcatctctgccaggtcaactggagtccctggtgtagctccagtatctgaggtgtcacaagcaatgaacgctatgcaaacagataggagggtgtgacaggggaaccgtagacttcatatatgtaactgactgttattataatactatcgttatattaaatgtgtttactcacacttagcctgctacggagctagagtagtgcctctggattaaggtgatgaataactggagcactttccctcaaccaggccttaagtagaacacagagaataaaaccaagacgtggacggtcccctctaaccctctcagggccagagctagctgactgtgtatgagcctgggagcaatgtgtctcctccacgagtggttcccaggaggttcccatacaatctctatgaagcttccttctcccaagaatggggcttagatcctatgaaggctgaactgttcaccaggacaaccttgggatcccagcacacagtccaagagttctcaacactgagggtcctcaaggccaacagtgcgtgaaaacttgtttgggatggaggtcaatgcgtaagatccgggggcccaacaaaacatcagggacgaacccggggggggtaaaacccgcaatcgggcattcagtcacgaactcctgggggcggactcaacacagtgttcgaagtaagaaggagtctacctactcgacacaagacacaacggagcacgaggacaacaagtgcagaaaacaagtgccggagcactcacaccatggtcgagaacagcacgaggatgagacacaaccagacagacacaccacgcagctacgagaagaaccacgacgcacaaatcgtacagccagaccagaaaaaaaagtctctcgccatctactgtcgtgctacataattctcgatcn

SEQ ID NO: 706876 - DNA, 1167 bp, Homo sapiens
agcggggtgtggggcaccgggtcggggcctgcgggagccggcgccccacggacctgctgctgtcagaccaagccccgggcccccatcatcactgcgtccgcgctttcagtgcgccgagaatctattcgcgtctcccggcatgctccgtgatgacttggccttcgtgctgcttggtaggcggggtccggtcccttccagctccgctcccgccgctgtcgcgaatcgcggttcgcgtagtccattggaggatggaggcatcgtcccctgcgggtctggtgcttgcagccatgccgacggctgtgattgacgctgaccctgggcattcgggcgctgcagtccgtaggaaatcattctcgcgcacgagtgtggatctgacggtggaccgatctataggaaccagccgtctccgtgcctgaactgtcatatgaattgtctttccatgggaacaatgaggaataacgtgtgtgatggccttgaaggatgtcaaagaactctttaggcctcgattgaccagactgggcgttaccctaggattgaactagtgcgatgtggttgacctgacttgggattgaggccatcgttcattttcccgacctggcgggaaagtcgattggcggatttaaacatgcaatctccaaacatcttgatcttcaagtcttcaccaagaggtcctatccgtggtattccacttcctaaatgcacctcaactcttggcaagacactggacggacgaactactagcacttgacacgcccaggttggatggactccacgtccgcaagatggaaacgccctcggcttttggaccttcttcggcagagcgtggagtatttgagacgccgtgggaatttccgttgccacgtaggccaagtggccgaacaaggttcggccatttgctcattggacccacaaggttgcggaaaaaccgcagtcaggttaagccaggaagtacaagtggagaaatctgggttcccctgggaactaggaagtccgttaattacgttgggcaattatttgcgtcgaacaggaactatccttttttcatggaccttaagtaataccggcgactgaggctcaattcgacctaagccttggggcgcgttgccccccaaatggacgaaaacatatgcgttgtcagccacgctatgtggcatttatagcccgaca

SEQ ID NO: 706877 - DNA, 465 bp, Homo sapiens
ctccctgtttctccacaacagcctggggtatgtaccccgctgtgctcacgcgtatctgggagctcagaggccaccttgtgaggaggatgccacgacacttcctactctcggagccctacagacatactaccagatgtgccagacaaataggagtgagtgtatagtgtagtagtagtgtagtgtagtgtagcacaacgttgtgtaatagagttgcagcagattctagttagccgctgggggaatacgtgcatattaataaaaagagatggcgccaagatggtgccaactgtgcaatatgaggccatagggaaaaaatgcatggaactaccaggtaggcaccatttggtctaggagtcgacattaatcatggacacgcctaatctatacaccgattaccataatagaagatccttatggccagattggccccactaacggatgaaggctcctaggcaaaaaatgtag

SEQ ID NO: 706878 - DNA, 199 bp, Homo sapiens
ctgagcggacagcactacgtcttaaacaagggtgggtgacgacagtatcttgccacacaagatggaggaaacagatggatgctggtcaaggaaaacagtgggatgccagttgaagtgtttattggccacatgcaggagtttgcactggatccagaacatccttgtggagccacaggtattgggtatctatgcttcggca

SEQ ID NO: 706879 - DNA, 150 bp, Homo sapiens
gccccgtttccctggttggttttccccccccttccctgggcgggtgccatggccaggaggtaagggcccttttgtgggcccccccctacccctttttttaaaaacctgttttccggaagggtttgattaactccttttctttccggggga

SEQ ID NO: 706880 - DNA, 149 bp, Homo sapiens
tcagcatgtgagtctcactatgtttctcagatggtctcgaactcctggcctcaagcatcttcccgcctcagcctctcaaatagctgggttacaggcatgagcacacacctggccaggatttggttgtttaaatataaacctgatcaccc

SEQ ID NO: 706881 - DNA, 132 bp, Homo sapiens
cccccccgggtttttccccccccgggggggggaggggggccccttccccccccaaggcccgggccccaaaattgggcccttttcctggggggtttcccggggggggtttttttttttttaaaaaatccccca

SEQ ID NO: 706882 - DNA, 762 bp, Homo sapiens
  misc_feature (552)..(552): n is a, c, g, or t
agcggaacggtggcggcggtggcggcgacggcgacagcagcggaggaggtgtctggttagctcggtggtggcagatctcgacggcgacgcctgcgagggacccgggccgagggtcgaggcgggcggccgcctgcgaagggacccgcgtcgagggtagaggtgggcggcgcgcgggggcaggcagcatctgaggaatgcgttaggcgtcccaatggaagcaggccggtcttcccaagcttggtcactgaggaaaagtggtgcctatgcgatgcctcggatcagccctgtggcaagtggcaagatagcgagtccggatccgtcacgcttcccgaccgatgcctaacccatcccaatcaataaatcctggaaggaccggaggcccgagtgtcccttcactcctactgcgataaagcaagggccatccaacaactattctccatccgtacgcctgcaatgcgtgcccgctatcaccggcgctacctagacgattcagcgaaggggttcctgccctctctccgcaattatcgaatcgtggcactcacaagatcagcnacattgcgcaggcgcactttggtggtgctcagaacaaactcgagctaatgttgaaacagcgtttctttaccactgcttgctgacaagttttggccaaatgacgatctccccctgaggatttgggggagaaggtgccgggactctttgttctttgcacttgttgaaacttcgggcaagttgacaagatgggacggaaattccacgtggtaa

SEQ ID NO: 706883 - DNA, 143 bp, Homo sapiens
gttgctggataggtttggggagagtgcctggtaggtggatcctatgcgcttgcggtgatgcataatcaattgtcccggcttatccctgtcggcgatacagcgatcacgcccgatacagcgaccagccccgatacagcgaccag

SEQ ID NO: 706884 - DNA, 605 bp, Homo sapiens
  misc_feature (128)..(128): n is a, c, g, or t
  misc_feature (164)..(164): n is a, c, g, or t
  misc_feature (227)..(227): n is a, c, g, or t
ggagagaagagcaaaatggaacgcttcggatagctcctggatgctcaattcgtcggaagcaagaagccagagtgatcgtttaagaagcgcaggctacgaattaagtacgataacctatagtgtatcantacacgatacgattataggtgacacgtatgagaacntcgaaggatcgcacaagttatgctacaagaaaagcgaggcttgatagaaatcgatcggcacangtaacctatatacggtccgtaatggtacgcgacggcctgggtggcgaacttcggtcatcgagggactacggtcgcggcgacattggccagaatcgtactcaagtaatgtactggtgatcgtacaggtaaatcacgggacccgctatgagggcctcacctctcggaaaaatcggtgacagtaaacttgaatatcagactcagcacgcacaagtagcatcttgctctttcatgtggcaaaaccaagatgaagagacgagatgtggggatctggcactgtggttcctgcatgaagacagtgggtaggcggtgcctcggatcgtacaataccatcttccgctagttcaacggtaaagtccgccatcagaagagctaaggagg

SEQ ID NO: 706885 - DNA, 606 bp, Homo sapiens
agcgggaacaatcactgggtgggagaccaagattcctggaggacagatatcacatctactaaaatggactttaaagccatctaacacggtacttggcttagataggaatatacgaaattctgggtcataatactgatttagagtcattggttcttttcaggaatatctctagagtcatttagagttaatggttcttttcaagaatatctactttttgggaaatgatctacagcttttcagatgtgatttaaaaggaaaagtctagtaatatggttaatttggtgggaatataaaccagttctgtttctacattcatgctatataatgcagtgaaataacacttaggtgaaatgtattccaaaatgtttttctgcccatacaggtcctctaataagtaattctttccagtggaattatggtgaaagaattatttccagagctaaatttaaaagattaaacattaatttttttaaaagggtttctttggaaaggaatgtcttagagttattagagatcattctgagtaatatgtcattctttatttttatgccagatgcaaatgtagtacccttacttaccttgagagtgacatttccttcttaatat

SEQ ID NO: 706886 - DNA, 472 bp, Homo sapiens
aacgtgcgaatatatagccataaagattacatactgcaataaatgcatcatcattaagcccaaaaaaggaaaaacaaggcaggaatttacatccagtttggctacattgttgaaatacaaatatgcagattttatcactgaaaaaattctcaatagtgtgtcttcatcagaacttcaactgaacctagaactttttcacacctcgattagaaagaaaacaaaacaaaacaaaaaaccagaaaaaaataaactataagttgattggctgctgagacagcaaggactttttacagagacctgtacagcatcgcacccaagagggggcgatatctgggaaggagattaaatagctgtgtctcgctctgtgccaggtcaccccacacttgttaactcggtctactataaaaggggtcgctgggaggaggacccactgtgggggatccccgggtatatgcaaagtacaacgtcatat

SEQ ID NO: 706887 - DNA, 319 bp, Homo sapiens
tgctgcaggtggcaacttccacatcaaacttttcaaaaggacggggtaaacaaagggaaaacctgagggctgggtgcagtggctcacacctgtaatcccagcactttgggaggccgaggcgggcggatcatgaggtcaggagatcaagaccatcccggctaacatggtaaaaccccgtctctactaaaaatacaaaaaattagctgggagtggtggtgggcgcctgtagtacccagctacttgggaggctaaggcaggagaatggcgtgaacccgggaggtggaagcttgcagtgagccgagattgagctactgaactc

SEQ ID NO: 706888 - DNA, 556 bp, Homo sapiens
cgttgctgggggcgtggtccgcgcccttcctcggcgggccggactggtctccatgaaatgcttcgggttcatctttcatggctgccgggtacttccatgcctctatgactcatcttcaagagactgggactgctgtagcagtgtcctctattcttgaagagcgtattcttggagctgatacgctcttggtggatcttgagagaatctgggcgtgtgttaagtattggtgagtgggtagtgtggcaccgacgatacagtggggctgagagaattgctacaatgccagaacgcatacactggctacgcgaggttgttccttcagagcgtatataagggttaatggtgcctgtggaaacgtgtggaatcgcttggaacgaattgatttgggtgggtttggtgcgatggtcctcgggaacattggaataatagcgtaaattaaaggggcaaggaggaggatataatgttgacatgagggacgatggacgcccgatttcgtgcggacggttgcgcgaggttggggtcgcacggaagcatcgttctgtggggtccgtatggt

SEQ ID NO: 706889 - DNA, 1200 bp, Homo sapiens
gtaatgaccacaaattgacaatgaaattaattcaaggggcaacgtgaccatcatggatatagacagtcttgtcaacgtatgcatgtaataacaggattcacccatgcattggagagcactctcatttatatgtactgtgaataatgatgcaaggagagtggagtggacccaccgatctgaaatgcagcaggaaaatctctaacttccaaggtcccaccaacagttcagaaacctaccacagataaatgttccaactacagaagtctcaccaacttctccatgaaaaccaccacaaaaaccaccagaccaaatgctcaagcaacacggagatacacctgttatccaggacaaccaagcattgttcattgaaccaagccccaacataacatggacacgtggaaccactttcaaggtacttaacacagttcctatcatatctaggggcaccacggttgttttcaacggttttgacccagggtattagctatggggaacagcttagataacaccccgagtgcgcggccattggccttggaactttataggccccacacaaggcacacgacaggttcaaaggaaaacgacaaacgatgagcacgcgagcccaaggttactaaccacggacgcttggtgtccccttaagatttatcctatacggacccgtcgtaactcactagccgactaacttaggggcaatacacagatcatcacgatttggcccaaactatcggctgcgacatacctgttgccaagttctgttcagcggccaattggccctttttgtcccaacctgtagggtacctaatgcacaaaagcggaactggttggtctacagcgggcaacttttgatcccaactcctcaggcgaaaagccaaacgagtgaatgtcaacacagaaagatagggggcgaaggacaccgcctgggcggcacacattccagacgaagatttgacaggtgtctgacaggcgagccccgacgaggacacaaggtggatgccgacgcacgggcgtcgcccacccccaacgaccactgctagatcgaataacaaagaatcaaccaccccgatcaccgcaacaacacaacaaaacaacacagcacgcacaacgaccgacaaagactcaagtaggatctagactaaaaccacaccatcagatccaccacccgccatacattcatgagtacagaggacgcgtaggaga

SEQ ID NO: 706890 - DNA, 188 bp, Homo sapiens
atgttggtctggtgggttcccgtgcggcggcggccaatggaggaggagacacagttggatgcagctccgtgggctgactggggcttgaggcctcagcagctgcgagcttgagtgctggccgagcctgcggctgccttcccctgctgggtggttgactgaagctggtgccccgcggctgtcatcgtgct

SEQ ID NO: 706891 - DNA, 323 bp, Homo sapiens
acatgtggctgctcgtatttaagttaattaaaatggaacgatggccgggcgcggtggctcacacctgtaatcccagcactttgggaggccgaggcgggcagatcacttgaggtcaggagttccaagaccagcctggccaacacagtgaaaccccgtctctactaaaaatacaaaaaattagctgggcatggtggcaggcacctgtaatcccagctactcaggagctgagccaggacaatcgcctgaacgcgggaggtggaggttgcagtgagctgagattgcgccattgcactccagcctgggtgacagcgagactccatcta

SEQ ID NO: 706892 - DNA, 431 bp, Homo sapiens
ttggaggatctgccgccaacctgattcctagacccttatgcaacgttctctctggtcttctgtgtggatccttcagaaagtgaccttggcatctccgatctccttcaagtcatcggtggaaccattagacaaatcgtctcgaaaatgtctgtcgagctggattagatttcccatgtcaaacaaggttcacaatatccttgcagacctcggtgatgataagtagtgcgaggagggatcagtagtggggggatccgtcatcacatccggcatataatccgagtaagctataccccactatgtatagaagctacacagcggtatgtaccatatatctgtaaggtaaacggtcattgatgaacaggtcgggcccaaacagtaccggcgtgctgaggcatatcatcatcaaatctcacccaagttaccatccacag

SEQ ID NO: 706893 - DNA, 392 bp, Homo sapiens
tcacgttatgtcacaaggcagcgtcagtcttcagccactaagccgagaaggagtcggtcaaagagccttgggccagaattccagggctctgggagtggctgccaggtgagttgaacactccgattttcagcgaggtcctgcacagatgggacatggcttggaggaatcctgggctgcaggcattccttgccctggtggtcagatttctggcacttgtagcaagctcctgggggaagcgggcctggaggaacgcctggccgctgcagttcaggcgtttggaagttcttgtgtgctggagatgtggctggggtttgtctcacagtggaggcaaggaattgcaacttttttatttcattattgtacaccttgaaggtgaggttacttaagtcctg

SEQ ID NO: 706894 - DNA, 248 bp, Homo sapiens
ccttgttgcgcagctcacttttgtaccccctcaccatctgcagacacggggagaaccccggacccctggcactgcatgctgtcggcggcatgcctcccttccacaagcccattctgctgcagagggagcctgtttttgcaacacccattgtactgggctgtcgtctgctgtccgagcagtctcctggctccagtgggaactgcacaccagtccactggcctggcttggccttcccatattcaaggttt

SEQ ID NO: 706895 - DNA, 859 bp, Homo sapiens
  misc_feature (8)..(8): n is a, c, g, or t
atcccagncacacagaggccggcttggtcactatggaggagataggcatcttggtggagaaggctcaggatgagatcccagcactgtccgtgtcccggccccagaaccgggcctgtccttcctgggccctgagcctgaggacctggaggacctgtacagccgctacaagaagctgcagcaagagctggagttcctggaggtgcaggaggaatacatcaaagatgagcaaaagaacctggagaaaaggaaatttctccagtgccccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtctcatgtatggcccacctggctgtgggaagaccatgttggcaaaggcggtggcacatcacacaacagtgcatttcatccgggtcgtggggctcggagtttgtacagaagtatctgggtgagggccccgatggtcgggatttgttcgcctggcaaggaaaatggcctgcatcatcttatagacgaattgatgcttgcaacaaaagattaatgtcaa

SEQ ID NO: 706896 - DNA, 581 bp, Homo sapiens
  misc_feature (68)..(68): n is a, c, g, or t
  misc_feature (99)..(99): n is a, c, g, or t
ctccttaggatgttcttcccgagcccggagggacccacgcgtgagcggggccaagtacttcattcaanatgagtatctgaggatcagctctgcaggtgnagatgggcgtcactactgctcccctcatttcacatgcgctgtgggcgctgagaacatcccccgtgtgttcaacgactgccgtgacttcattcagcgcatgcaccttcgtcagtacgagctgctctaagaagggaacccccaaatttaattaaagccttgagcacaattaattaaaagtgaaacgtaattgtacaagcagttaatcgcccgccatagggcatgattaaccagccacctttcccttcccgcgagtgattttgggtggcccccttttcccttcagcctgcttagatgttcctggtttagagggcttaaggcggcgttcaggggaaggaaaaaaggccccccccgttccctctctctttctgtggggtccctcttccagcagcttttttctaataaaatgaaataaaagaacaaaatgaaataaatattgtgttgtgcagcattaaaaaaaatcaaaataaaaattaaatgtgagc

SEQ ID NO: 706897 - DNA, 761 bp, Homo sapiens
  misc_feature (8)..(8): n is a, c, g, or t
atcccagncacacagaggccggcttggtcactatggaggagataggcatcttggtggagaaggctcaggatgagatcccagcactgtccgtgtcccggccccagaaccgggcctgtccttcctgggccctgagcctgaggacctggaggacctgtacagccgctacaaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtctcatgtatggcccacctggctgtgggaagaccatgttggcaaaggcggtggcacatcacacaacagtgcatttcatccgggtcgtggggctcggagtttgtacagaagtatctgggtgagggccccgatggtcgggatttgttcgcctggcaaggaaaatggcctgcatcatcttatagacgaattgatgcttgcaacaaaagattaatgtcaa

SEQ ID NO: 706898 - DNA, 745 bp, Homo sapiens
agctgattaaataatctgtacaacaaacctccatgacaagtttatctatgtacaaacctgcgacacatacctctgaacttaaaagtttttttaaaaaaatataaaaggtggccgggtgcgagtggctcacgcctgtaatcccagcactttgggagtccaaggcaggtggatcacaaggtcaggagttcaagaccagcctggccaatatggtctctactaaaaatacaaaaaaaaaaaaaaaaaaattagcccggtgtgggggcaggcgccggtaatcccagcttctcgggaggctgaggcaggagaatcacttgaaccgggggggtgggaggttgcagtagagctggagaatcgcgtcacggtactccagcaggggcaacagagtgaaactccttctcaaaaaaataaataataaaataaaaaggttaccaagtctgggggttttctggttatagcagcagaaaatagactaagacagaaaatgggcacaaagaactggggcatcattgggtcaagcctggtagtcccagctaactggggaggctcagtaaggcttgaggccctgggagttcgaggctctaagtggtgtcatggtcctggcttatgaataaccattgggacttcagcctaggcaaggtagcaagatctcatctccatttaggtaaataattttttggtggacaaaaaacgggtacctagaaagggggctctggcttgtaacaaatacctgaatatgtggaaagtg

SEQ ID NO: 706899 - DNA, 179 bp, Homo sapiens
  misc_feature (73)..(73): n is a, c, g, or t
  misc_feature (100)..(101): n is a, c, g, or t
  misc_feature (150)..(151): n is a, c, g, or t
ggggtaggtaataaacacacaccgggaaagtgctatgctggttttgcagaaagctaacagcggtgtggtcatnttctttacgttctaaacggtctgcccnntttcaaaagaatcaactatgcaagaaaaaggtagccctgtccgtctgtnnaaagtatgcatctataaaagcctgaggg

SEQ ID NO: 706900 - DNA, 401 bp, Homo sapiens
  misc_feature (52)..(52): n is a, c, g, or t
aatttccccttttccttggggcccgggtgttggccggcaggtgttccaccgnccctttaattcctacgactttgggagcaaggtggcgaccctgaggttcgaggaggcttaaagttgccagccggtcttgaactcctgacctcaggtgatccgcccaccttggcctccctaagtgctaggattacctgaggtcaggagttcaagaccggcctggccaactgggtgaaaccctgtctctactaaaaatacaaaaaattagccgggtgtggtggcgggcacctgtaatcccagctacttgggagactgaggcagaagaattgcttgaacagaggcggaggttgcagtgagctgagatttgccactgcactccagcctgggtgacagagcgagactctttctca

SEQ ID NO: 706901 - DNA, 272 bp, Homo sapiens
  misc_feature (206)..(206): n is a, c, g, or t
caattctaacccaaaaggaccaaggctggccattggggctgagactggaccaccgcagtcaaggctgtgcctttgcgggtcaaggctaacccaaaaagtccacagcaggcaaccccgaggagatccagctgggcgaggacgaggcgaggacgagatggcctggagcccaacgaggtcgctggagcagcagagcgtgccagccgagngtttgggagctgaaggaagactgacccgtcctccccctcccacccctcccaatacaagctacgttg

SEQ ID NO: 706902 - DNA, 868 bp, Homo sapiens
  misc_feature (182)..(183): n is a, c, g, or t
  misc_feature (228)..(228): n is a, c, g, or t
  misc_feature (248)..(249): n is a, c, g, or t
  misc_feature (289)..(289): n is a, c, g, or t
  misc_feature (292)..(292): n is a, c, g, or t
  misc_feature (364)..(364): n is a, c, g, or t
  misc_feature (383)..(383): n is a, c, g, or t
  misc_feature (414)..(414): n is a, c, g, or t
  misc_feature (416)..(416): n is a, c, g, or t
  misc_feature (431)..(431): n is a, c, g, or t
  misc_feature (441)..(442): n is a, c, g, or t
ggcccggagcatggactcctcgtgacttgcttgacgtgggctgtgactgctgcagtgagtacctggagctgaagaaggccctgggctacatcgagaggcaaagtgtgcagcagctcatgaaggtcaacagtagcctgagcgacgagctccggaggctgcagcgagagatccacaagctgcanngcggagaacctgcagctccggcagcctccagggccggtgcccaancctccactccccagtgaacnnggcggaacacacacccatggcgccaggcgggagcacacancgnagggatcgccaggcctttccatgtatgaacctggctctgccctgaagccctttgggggcccccctggggacnagctcactacgcggctgcngcctttccacagcactgagctagaggacgangnccatctattcagtgncacgtccctnnctggcctttaccggatccggaaaggggtgtctgactcagatgtgcccttcactccctcctccccgctgctgtacctgctcccaggagggaagcctggcactacgagcaatgctttcccgccacggcagtggagcctgacagtgacttatgatgaacccgcagaagtggggacccagtgctggggctggaagtggaagaggtattctagatgctgtggcaaagaggaagacttccaatccagagctggaaagcctggatggagacctagaatcctgggctttccgagcacagagggatgtcatcttgaaggaccgatgcaggtcaccaagaacattcaggacactgttgcggggccagccacgagttcaagcatgaccaggttcgtgccctgttcagagaagatccattttggtgtgacccgagatg

SEQ ID NO: 706903 - DNA, 260 bp, Homo sapiens
cgactctacaggatcttctgtgaatagtataataacggagatatgtataggagattagtatagagaggtagagttttttcgtgatagtggttcactggataagtgaccttggtatcatcacccgatgaggcaacagccaagaaacgctgaacgcaggcacatacttcctaatactacacccctagtaggctcccttccttgtactatccctaatgaggcataaattattaaccaaagctcccatcttgccttacgaacaa

SEQ ID NO: 706904 - DNA, 417 bp, Homo sapiens
  misc_feature (19)..(19): n is a, c, g, or t
  misc_feature (259)..(259): n is a, c, g, or t
  misc_feature (269)..(269): n is a, c, g, or t
  misc_feature (313)..(313): n is a, c, g, or t
  misc_feature (339)..(339): n is a, c, g, or t
  misc_feature (376)..(376): n is a, c, g, or t
ccggctgccttgggttttnaaattttactggaaacacatccctgtcccatgtgtttatgttgtgctcctacagcagacagcatggttcacaagccctcaaatattcaacatctagccccttcaagaaaaagtctggggccctggcgcggtggctcttgtctgtaattcccagcactttgagaggctgaggcaggtggactgcttgaggcccaggaatttgagacaatcctggccaacagggtgaaacccatctctactnaaaaacattnaaaaatcagccgggcatggtggcgcatgccggtaatcctagctncttgggaggctgaggcacaagaattncttgaacctgggaggcagaggctgcagtgagcggagntcacgccgctgcactccagcctgggcgaaagagcgagactc

SEQ ID NO: 706905 - DNA, 493 bp, Homo sapiens
  misc_feature (408)..(408): n is a, c, g, or t
  misc_feature (427)..(427): n is a, c, g, or t
tcgacatcgagcatcctccaagtgtctcccctccccggtttctggatcctggcaccatgttaaatatgccccccatggttgcaggcatggtcctctaagccatggaaccagatgagctaagtgatggggccaaccacgcttacccatgcagccttagcttatctgccttgtatgatttccctttgactttctagaacctgtgtgatttgtctggctctctgaaaaacagatctctgaagagactgtgtcacttttgggcaaggctcctttagtggaggcaatgtgctagattacctgctattacagcccatgctaaagcacttacccttaaaaaaagtggttctggttaacttctgaatttaaatttcccttactaattaagtactgttttaatcagagacataatangtgccttaaaagaacgtangaccgaatggccatttttctactgatgggacaatattgggactaaaatctggctgcggttgactga

SEQ ID NO: 706906 - DNA, 434 bp, Homo sapiens
ggagatgacttaccctggtgtcagttgggacattgacatggaaataatccttccggtgagagtaggcactcataagttagctgcatcaaagggatcgtgattttttacagcgggtcgccatgatctgctttgatgaactcatggcactcatcacaataactagcgagatagcgcaccatgttcgaacccaaaacttaccaggaaaagctgaacctgctcaaccgtcagctggtggacaacctgctgatgcagctgccggatcagatccgcctgaacctcaaggaagtcaccgatcagctggtgcgttcggaagccatcatccgcatggaacaggtcaacaacgtcgttggcccgatcgagatcccggaagacgagcgcgccgacaaccgcttcatgctcgacctgctggccagcaacctgggccgtaccgcgtg

SEQ ID NO: 706907 - DNA, 556 bp, Homo sapiens
gcggccgcaacttgtgggcggtatgtcaggaaaaaatatgcctgggatacaggccgtagtccccgtgtgggcccgggcattgaggcaacatggtgaaactggcgggtttccccaaggggtcattgatctcagtgagacgctccaaactctttgaacaaatttgcggagacaccccggcgctcgtttctgtgtgtataacaccccagcggggttagtgtggtggcgtccaccccaccgcacatgtttcccactaaaaagtgaagatatagtatgacttgaccacataatactgtgcagtagcgccccccgacgaatataagagttggcagtccccccgaaatggaatcgagagggcccgcctcccttgtagaatagacatgcatgtctgtgttcaatagagtcgcgtggatgtacacgccgattcatacgggctggcgaagaactctccgcgctgcggacatatatgtactttatcggcgccgggtgtcttcgagagcagagagctccaacggcaaagtaacaaaattatggacgcacaatagcacgaacaagataa

SEQ ID NO: 706908 - DNA, 293 bp, Homo sapiens
gcaaaaaagagtgacatatgatgtggtggttctaaccaggaggtaatctgggcgcaccgaatttatctgagtctcgggcggtgaaagaagatattgaaggagcaggaaaacggaatagcctgatagccgccatctgtgcaggtcctactgctctgttgggtcatgaaataggttttggaagtaaagttaccaacagaacctcttgctaaagaccaatgattcattgggggtcattacaactaatcttggaatcgtgtggaacaagacggcctgattcttacaagccgcggggg

SEQ ID NO: 706909 - DNA, 120 bp, Homo sapiens
ccgacggcgtatgcatgcctggagtccagctactctggtatgctgacatgggagaatcacccgatgtctgggaggctcaagactgcagctgagccatgagcctgctaatttgtgtatttt

SEQ ID NO: 706910 - DNA, 662 bp, Homo sapiens
gtcccagagactcgggaggctgagccagaagaattgcttgaacccaggatgtagaaaatgaaatagaggttcctcttcaaagggactttcctcccagtctaattcagaataggtagtaacctctcttagaaccaaaatttactcgaagacctgtgttaatattcttcaattctgctagctgtaataaagaaatcaggccgggcgcggtggctcatgccagtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcttccggcctgggcgacagagcgagactccgtctcaaaaaaaaaaaaaaaaaaaaagggaattcaataggccggggggggggactcacgcctgtaatcccagacacttgggggggacaaagtgggggcggatcacgaggtcaggaaatcgagaatatcgggctaacacggggaaacccatttctattaaattccctaaacaaaaagg

SEQ ID NO: 706911 - DNA, 341 bp, Homo sapiens
  misc_feature (245)..(245): n is a, c, g, or t
ttggtccacactgatgcacatccttcagtgagtaatttatctgaggggaatgatctgagtgtttcatagttaattgtgaacatgttatttacagctgagccttggtttctttttgtttaaatggtaatgttgtgtggattgaaggaaagagcatacacagaagtgcagtacagtgcctgggacattgaaattgctcaggaacggcaagatatcgtttagtgctattaacagacagtacaggctgngcgtggtggctcacacctgtaatctcagcactttgggaggccaagtcgtgtggatcacctgaggtcaggagttggagaccagcctgaccaacatgg

SEQ ID NO: 706912 - DNA, 146 bp, Homo sapiens
  misc_feature (3)..(3): n is a, c, g, or t
cantaagctctgcgtcagatgctgcgtgttccacagtattgaaatggtgatatttcaagtttggatgcatgagagccagagttttcagttcagcatgaaaagcatcatctcgagtgaaataaatcaggtcgatctgttccagagat

SEQ ID NO: 706913 - DNA, 838 bp, Homo sapiens
ccagctgttacggccccggagttaaggatgatgagaacacaacagtccgggttgaccactgatgctgctggaccaggagcatcactggtatctatcatgacagatacttgcccgtgctcggtgctacggatggattacaaaggagacgcaaccgtgtttttcattctccctaaccaaggcaaaatgagggagattgaagaggttctgactccagagatgctaatgaggtggaacaacttgttgcggaaagaggaattctttacaagaaagctagagtttgcaatcttcccaagttctccatttctggctcctatgtattagatcaggattttggccccaggctggcgcgatcacgggatcttggtatctccaaggtgggctgacttattccggcaattcaccaagacacgcaaaaacttgggaggcaatccaacaaaggtttcccacctaagggcccaccctttgtgaccgctggattgacggctgggcacccgagtgctgctagcaagcacaccagacttcagcagattcagaatttctttcttctgcccaagaccaaatcggccaatcattcctggcgaattcaaacctggccctttcctttgtggttgatcttttttccacccaatgcacccaggagttgtccatctttcctggggcaaaggtcgatcgaacacctacgaaaacattatgccctccccagtggcttgctcatctgtttccaatgcaggaaggattgtggcaaggggaagggcctgggacgtgagtacgcttctgtggttttaacgagtttgggggaccaaggtatggaccaccgacagtgtccaagggacgtccg

SEQ ID NO: 706914 - DNA, 645 bp, Homo sapiens
  misc_feature (24)..(24): n is a, c, g, or t
  misc_feature (26)..(26): n is a, c, g, or t
  misc_feature (101)..(101): n is a, c, g, or t
  misc_feature (119)..(119): n is a, c, g, or t
  misc_feature (125)..(125): n is a, c, g, or t
tgggaggggctgccgctgcagtgngnggccatgtgggatgccttgggaatctcccctccatcttcacttctccagaggcccttttctcctgcagcctgctncaaggggacagcggttanagagcnggggccctggttctttggaggcagggtggggaggatggcagctgggtgcttctggcttggaccgagccagcctcgttagagtattaagtgcaatgagcagttatttaagagctgatctcttccacctgcacccacccgcggcttccagctctgcctgcctctgaccgtattatagccggggccgctcattcggcgctgaggacctgtggtgggcacagtggaaggtagatgttttggtctgtttatcagactggagtcctaaccctttgtcatctttcttctgcccataaccctgtccccacacacttaccccagacacagcaacaagtggtctgttacttgttacttctcggtttcttaccataaagctcatctgacttttccactggatctgggggccccaaggcagtacctggtgctggacctgtttgccatcccccttcccttctgccattgctttgtactcagttgggctgtgctctccctgtggacctgattgatgtaaggaaataaaaggccc

SEQ ID NO: 706915 - DNA, 163 bp, Homo sapiens
atcaacacactggattgtggcgaggtcgtctcaggcaacgtctactcgaagcgctcgtctcacagcggtgaagctgctcctcgtacggtgtcttcttgtgagctgacgaacgttgagtcctcagaccaggaatggaaggagacccatatgtgtttcagaggaa

SEQ ID NO: 706916 - DNA, 283 bp, Homo sapiens
tgagtaccctcgatagggccaaaggggtgtaatccgataagcctcctggaggcgctctaaaacgttcttggtgacttatcgggctttggacaacgtcggtcgtcttagacaagttgatgggtttctgagaggctcttttaatacttgcgaggagataccggtgaaaatcgtctaaagctccctttctacttgaggaatgtgggtcctggttaggctgggtagagggaaagacatcctcaaggaggtctctagcttcttcttccggtccgttggccttatcgag

SEQ ID NO: 706917 - DNA, 132 bp, Homo sapiens
tatcgattacagaacaggctcctctagagggatataatgcaccgccaggtcctttgagttttacgctgtggctcgtaggcgcgtaagggccagcaggcgcgtacgggccagcaggcgcgtaagggccagcag

SEQ ID NO: 706918 - DNA, 227 bp, Homo sapiens
aggccaagtggtcttcccaggcactggtgaggctcttgtcgcattctccacactcttcctgggtgatgtcatcagggtttctggcttgcaaatcggcttggtctggttctagtacttcccgagtcagtgtatttctccttgatctgtcttcgttttcttcttattattcttatcagtgtcatcctcctcatcggaacccacatcttcactcttgggcttttctttat

SEQ ID NO: 706919 - DNA, 113 bp, Homo sapiens
cggcagtgtaacgacggccgtgtattgacggcagtgtacacgacggccagtgtaaacgacggcagtgtaaacgacggcagtgtacaccgacggccagtgtaaacgacggccag

SEQ ID NO: 706920 - DNA, 133 bp, Homo sapiens
ccaggctgcgttggtagaacagtgctgattagctggagaggcacgcatgctgatagctggagaggtcaggatgcatgctgagtagcgttgagaggccaggatgcatagctgatagcttgagaggccaggatga

SEQ ID NO: 706921 - DNA, 730 bp, Homo sapiens
tggcatagggaacaatttatggttttttaaaatgcagcaatctttttaatgaaatgtttccatcacatagtactgtgttccggtatgaatttcagaactttggagcaataaaagtgctctgcataagtttataaaatatgcttccgggatttaaaatttaacagaaaaatttccaaacaagctcataggtatgatctctaaaatattgatgtacataactatatgcactacaggaggaaatctcctcacgggtagtacacacacagtgtacaattttgaagcacaggtgttaagttaaatttccctttataagggttttcccctcaccattggggtgcataagctggctgacatacattgacacaaacagtgccccatttcatactgtgttggcaatacaaagtagaagaggaacttgtgaggaccaaattttaaagtagaaaatgaaaaaataagcgtggcaaaaatacagctgcaaagtgctttaaaccgagggccctttaataaaatagcttggcttatatccatacttttcatataacaggtgcacactattagcttaaaagcagagcagaccagtgttaccttataatattcggcagataagccattaaaacaaattgtgcccggaaagaagcaggtgcaaactttaaaaacctttacaccataggcctaagaatgcattctcagaagtgggaatccccgaaataacaaacgttatgggaacctg

SEQ ID NO: 706922 - DNA, 106 bp, Homo sapiens
cgcctgtggtagtgctgcgcctctccggaacgcgacatgaaggtgctccattgccgtcggcctcatcgcggggtccgtcttcttgctgctgctgccgggaccttct

SEQ ID NO: 706923 - DNA, 385 bp, Homo sapiens
tcaacttttcctgcgtggtatcaaagtcctaaaatatggctgcctgtaatccccgcacttgggaggttgaggtgggaggatcatctgaggccaagagttcaagaccagaccaggcgccgtagctcacgcctgtaatcccagcactttgggaagccgagacaggcagatcacgaggtcgggcgtttgagaccagcctgaccaactggtgaaaccccatctctactaaaaaatataaaaattagccgggtgtggtggcgcacacctgtaatctcagctacttgggaggctggggcaggagaatcacttgaagccaggaggcggaggttacaatgagccgagatcatgccattgcactccagcctgggcaacagagtgagactgtctc

SEQ ID NO: 706924 - DNA, 181 bp, Homo sapiens
tacgagttacgtatgttatcccaacacaccctactaatttgtatttagtagagacggggttcatcatgtaagcaggatggtctcgatctcctgacctcatgatctgcccactcggctcccaaagtgcttgggattacaggcgtgaaccaccgtgcccagcaagatggagtttcactcttct

SEQ ID NO: 706925 - DNA, 108 bp, Homo sapiens
ccacggtacttaatagtgtcacggtctgtgtgtagtatgtttttgcattaacgtgtagtggtctttcctttctatatttagtcctcctttctaaaatctcttgtaagg

SEQ ID NO: 706926 - DNA, 1044 bp, Homo sapiens
  misc_feature (696)..(696): n is a, c, g, or t
tattcccaaaaaaggattttttttttatccaattaacggcaaatgtagagaacccaaaaagggagccccagggtgtggaacaatgattctgtgggtatacccctctccccatgaaagaaaacaggggaatggagtggtggcccctatacaccctttatatgtggtctcatatctgtcggagctccccttggtctcacttctgtggtgtgcagccctctcctatatggtggcagcagggacccccactatcctttctccgcgtgggaaagcagtgtggtgtataaggctcgagactcactcacagtcgcgtgcacatatgtgcccacgacagtgccctctttttctccgcacaacatagacagagtatactcgtggggcggaaacgggggtaaatctgcgtgatgggccagaaaacacagtgggaggcacaaattagcaggggatatagacacacatgtgtgtgggcgcgcccgtgtgtataagcccaacgtcatggcccatatgtggaacgcgggatgtgtcttcaaacacacaaatgtgcggcaaccctcttgtgacaccacaaataaatagagtacaaaacacacccagatggttgtgtgtcccccaagagaggtctgagatctgtcgtcggctgcaaaccagccagaggggaacacacagctgtgcggcatcaccccagaaatcaccttgtgngcgggagcccacagcgggagagcgacagccaccaccagagagcgggcgacgactcatgtgcgcgacagcgccggggcgcacggggggtgtgaaaagatcctcccctttgctatacatgtcgggggaggtcggcccccccatatattctagtagcaaagcagcaagcgcggcggcgagaaacatcggtgcggcctttaggaccgtagtggcggcgagagaacaaacgcccacacaacgctataaaggggggatacaaagggggggagagaatccacaatcgcgtcccccacaaaaggcccacaaacccccttctccagagcgggtggtggcggccggcccccaacagag

SEQ ID NO: 706927 - DNA, 292 bp, Homo sapiens
  misc_feature (40)..(40): n is a, c, g, or t
cctgagtcctgtgtccaccagctgctgctaaatacctctnagaaactctgcttctatctaaggggacctacttctctcgggaatctcaatacttggaacaagaacctcctagacggaccctttggcataatgaattggaccaactgtaggttccaggactagagagccagcaatgcctccatgaacaatctcacccaattactctgctcaggaaacgaggtaactgatggacagccgaggcagccccttaggcggcttaggcctcccctgtggagcatccctgaggcggact

SEQ ID NO: 706928 - DNA, 359 bp, Homo sapiens
tgcacccagaagcagagaagggaggatgttcaaaggacaaggtatggcggggtcactactcgcactggagagttcacgcgagttaacttatgctgggggcaaagaatggaaagagctaatacacagactaagcaaaagaatgaaatgcgcagcctgaccagagacgtttacaatttataccaacttacaaatatttagggtgcccaccaacttcgagagaacagaccaaactaaccacatgaaggaagacctctgccggggccttctctccctacaacctcctatcaagaatcattaggaagcccaaacagcttcacagttccgggttcccggctgctgtcatatttgccggatttgtt

SEQ ID NO: 706929 - DNA, 419 bp, Homo sapiens
ttgctctaccgcttcatagacgaggcgagcaacaggcttccgtgacaacagcaaggtattgactgccgatccatctggcatagcgtcctatgaccaggcgcgattgcattgtcgcttctccaaatcaggcttcgcacagccttcctacagttacctgtgggctggctcatggtttcctaggcaattcgtgtcaagtgtgcgctctgtcgacagggcactccagcaaatgttaatggcagctcaccatgtgttcatagggaatatctgtgagtacactgtggaagctatggcaggataagctttgggaactctccggctcagaaagtacctcgaacatccaggagtcagctctctctcagaaaagctggagacaggcacacgctagtctcaacgctgcacactaagcagtcctaagatcc

SEQ ID NO: 706930 - DNA, 250 bp, Homo sapiens
agacttgctggaaccctgcaggcagagatgtgccactgcactccagcctgggtgacagagcaagattccagctcaaaaaaaaaaaatttaaaaaattagccaggcgtgtggaacttgcctgtggttctggctactcagggggctgaggtgggaggttctcttgagcccaggaattcaaggttccagtgagtttatgattgcattctctgcactccaagcgtgaagtgataagagtaagacccttgcctct

SEQ ID NO: 706931 - DNA, 835 bp, Homo sapiens
  misc_feature (39)..(39): n is a, c, g, or t
  misc_feature (94)..(94): n is a, c, g, or t
  misc_feature (112)..(112): n is a, c, g, or t
  misc_feature (127)..(127): n is a, c, g, or t
  misc_feature (132)..(132): n is a, c, g, or t
  misc_feature (139)..(139): n is a, c, g, or t
  misc_feature (151)..(152): n is a, c, g, or t
  misc_feature (171)..(171): n is a, c, g, or t
cccaaagcttctcacccagtattacttagttctgtgagnaagcttcttggtgcaaggggactgggaaacagggggacttggtgctagaaagctnccggtaaagcctagtganaatctctatgacagnaagcntgaggancagcacttctgnntgccttccacaactagcancaccaccacaaaatctggcacatcttgtgcatctcgttttgagtatgtagataatgtccaccctgctgagctgatttctggtgacccgcaagtgattagtcatgtatctccaccaaagtcatcaagcttttttgcagagttcgggatggacagtggttttcctaagaaaggaagctcaaactcctcaaaagttcaaattcaggaaacagatgaagcaagaaaaaagtttacgaatgcaaaatcaatctcatcagcccaatattttggtgatcagaacaaagctgatgctgatgctcaagtttcattgcagaaattttctggctcctctgctatatcaagtgctgatctttttggtcacagcgatgatcagactattgatcttgctgcgagtgacctcatcaatcggatctcattccaggcccaacaagacatctcttctctgaagaatattgcaggagagactgggaagaagctcagctccttcgcatcaaccttcatgaatgatcttcaggacaggatcctctgaaattgatgggttctgtgtttgagaattttcaagtttgctacattgcccatcaatatttgtgtagtgtaatgtaaaatgagtccatataaaattctttttgaagaaaaataaaatttaagacttctcagatctttgaca

SEQ ID NO: 706932 - DNA, 1198 bp, Homo sapiens
ggtaccgagcagttcgggtcctcgtcgcgcgtcgcggtcccctcggtgcgggctcgcgagctcgctagcctgtagcattcggcatcgcaccggcttgggtggcggcaggtcggtgcgccatcagttggttggcctcgcgaaacgcggttgcgaatggcaagccaaaatgtaccatgtaccggatagaatatgatacctttaggtgaactagaggtggcaagatgatagaggtattagtggcgcgcgcgagatcggtgaggatgctactgatgaacgtttgatagattggaggtgtagacgagaacggcatagcctaaacaccgcagttattgagaggcttttggcaatgcttgaagcggaagcggccgcatgaagtaaaccaggattatggtcttgatccagagattgctaatgcgaatagagtgaaggcagcgagatgaggtagctgaaggtaaattaagtgatcatttgcctctaggagggtatggaagagctggatcaggaagcgtcagacaaatatgaatgtaaatgaaggtcattaggcaatagagcaaattgaaatgtgaggaggtgaacttggaagcaagatacctgtgcatcccaacgatcatgtgaataagaagcaagagcatcaaatgagtactttacccagaggaaatgcacattgctgcatgcaaatagaagttcatgaagtactgttaccaggacatacagaacgttagcatgaagctcttgactgcaaatccaaaagagttcgcaaagactcaaccagatgagacggtacccatactccaagatggcagtgcactgaaatctggggccaggaattcaggggacacgtcacaaagtacaatacggcaatgacaagcatcaaagcagcgcgacagacaaaaaagtaatagcagcccacaaactgcagcccgccggctgcacacgttaaactcaaaaacgggagccaaaagggggatgaccaagagggaccgcaaaagggagacaacaggacgagccggaaaaaagcaaaaacggcgtcaagaaacaggagaacgagaggacaaacacacacggagagcacaaaaaacgacccgagagagaccaccgacgaaaacgcagaagaacaacgaagagagaaaagccaaagagagacaaagacacacgaaggaacacgaagccagcacccaacaaacagcaagaaaagaga

SEQ ID NO: 706933 - DNA, 410 bp, Homo sapiens
  misc_feature (18)..(18): n is a, c, g, or t
  misc_feature (32)..(32): n is a, c, g, or t
  misc_feature (75)..(75): n is a, c, g, or t
  misc_feature (97)..(97): n is a, c, g, or t
  misc_feature (122)..(122): n is a, c, g, or t
  misc_feature (153)..(153): n is a, c, g, or t
  misc_feature (173)..(173): n is a, c, g, or t
  misc_feature (240)..(240): n is a, c, g, or t
  misc_feature (256)..(256): n is a, c, g, or t
  misc_feature (352)..(352): n is a, c, g, or t
ggtagcggtgtagctgcncacgtcgcgccgcntaccgcacccaggttcggcccgtagcgtcatggcagcccggcnccatcttcatcgagcgccatgncgcagctgcggccgggagcgcgggntactgcttgctcctcggcttgcatttgtttntgctgacctcgggcctgccntgggctggaacgaccctgacagaatgttgctgcgggatgtaaaagctcttaccctccactatgaccngctataccacctcccngcaagcgtggatccatcccacagttgaaatgtgttggaggcacagctggttgtgattcttatacccaaaagtcatacagtgtcagaacaaaaggcntgggattggtatgatttacaattgggaatgtaagaccggacttagatattgcatacaa

SEQ ID NO: 706934 - DNA, 652 bp, Homo sapiens
  misc_feature (180)..(180): n is a, c, g, or t
  misc_feature (628)..(628): n is a, c, g, or t
aacaaaactctgtacttcagtcacttgtcacatctcctacagacaaatctactcctcaaagaattcttaataataaatgattctagtattaatatatggcaccttattatagacccacgggcaccattgcgcaactttcttctatcttgcagcctcatatacactcactcatgcaagaanctcttgtgaccggtagaccatctacttatttgttccccatgcttacaaaatcaatggaacactgaggcatttaagctcgaaggagttccgcttgcctgtcttgcaggtgctgaaatgggtacagcccaggattccagcctaggtcccattcttcactggccacagtacgtttgtgggcaagtcacttcctgttttctccccacagtttcatcttccagcttacctgttgcgtgccatgttctcctcaggcttgtccttggggaatctccacctcccatcctccaccacattgatcccatttctcttcctttttccattggcacaatttagcgcagtcccagctgtctcaacttgtggcttcctactcttactatttcaaatatgcaaaagcctttatcctgaagtggactattctcagcaagcaaagatacctcaattaccaaccaanatccatcctcttgagaagggcaga

SEQ ID NO: 706935 - DNA, 749 bp, Homo sapiens
agcggcttctccgcccggtcgcccctccccccgagcgccgtggcggttgaagccggacttcgctccgagtttcaggctcgtgctatggctagcgccgtcgtcgtctcccgttcatgtcggcatcatgatgtatctaccgggacctcatcagagcactgcatgagatgttgctccgatcatctacaagatccgggagatcgctgacgggttgtgcctggcggtggaggggaagatggtcacttaggacagaaggtatatggatgactcgctcattggtgggaaatgcctgcgctaaatgtcccgagggcgaagagtcccgaaagcccaggtaactcagctggatgtctactaattggtctgtgaaagaggcatcatctgtcacgaactaacgtttcagcaaatagaaggcctagcgaggaacgtacattcaacatgagttgcactgagcagtcatagtcaacacgtggagagctctggaatagaccatgatgatccgcagagagagatgtaccttcactctattgatgactaggggcgtgccagagacaaagtcaagcaccgatcctttgacgtgaactttcagagaagacgtaaccacggttctataaattcgtggtgaccggacattgaactccgagattgcgcatgggttgtcctctataaggactcaccgtagaagagagttggtgtagagacccatagtactgatttctcttttaagggcactggttaaacaacttgcgatcacc

SEQ ID NO: 706936 - DNA, 253 bp, Homo sapiens
atctttggaatctattgctcactttatgacactatggtgattattgttcctaacagaagagtctaacctaagaatatcgcccaattacgtgaaaaagctaactgaacagtaaacaatgacatttaatctcattgtaaaagaacatgaagcatagatgttccataatggggaagtcttgatctttcctgtagtttttggactgccaggtttgttttgttattgtttagaagatgtccttcatagattgttaccg

SEQ ID NO: 706937 - DNA, 311 bp, Homo sapiens
  misc_feature (6)..(6): n is a, c, g, or t
  misc_feature (15)..(15): n is a, c, g, or t
  misc_feature (58)..(58): n is a, c, g, or t
atctcnttttggganattttacttgccccacttgtgtttgaaaaaggtatcattaacntattagtattgtcttcacctgaaggatgtattatctaaactttgtttcttgttttgcttactttttgtcttaaaggttaaagatacacaggtggatataatatccgaagagttcatcatattccatagctaacattgaagtttatcatttttcactgtggttcttctttttattacctatatatgtttttctctgcaggccagatacttgagcattttttggttatatttatttttctcttagatgtatttat

SEQ ID NO: 706938 - DNA, 626 bp, Homo sapiens
tggtattaagttttaattccataatcataaacttaactctgcaatccagctaggcatgggagggaacagggaaaactgtggaacccaaggggaacgttgcagcgagagcacaaagattctaggatacttgcgagcaaagtgggggtggagggggtgcctcctccgtgagctacagaaggaagtgactcgtgggtggtataagataaaacacaagttcaacacttattccgagttggctccacagtctaagcaatggggtgaatcatatataggcggggctctgtgccattctccgtggcacccgaaaggcgcctcacaggggccctccaacaattaattacagtgccttctctttacactttgggccaaaccacacaacatgtgtcttgtgcacatttccaaaacacacctttcaggctctgtggggacaggtgtgtcacagatgtggacaaacaaacgtggggagaaacccacaattgtgagtgttgtggggtctcacacgacatttttgtcgcccaatgggggaacaaagagagtgtcccagcagacctcgcggatatgtgcctttacacgggcatgtagaaagggtttccctcatatcttttcacaaaatttttctcttccca

SEQ ID NO: 706939 - DNA, 612 bp, Homo sapiens
cagagtctttccgtctgaagccaccacctctgcttaccactttctcttccgatacaggcttcccgctagtcggcggagttcgtagagagaagagaactggccaccgtctaaaatccccccatctctggcctcactgtttattgggtcactgcgactatgcagattatatatttcggataaattattagcattcatctgagtgcttatttagggtcctgttgcaaatgtttcttgaatattttaaaattaaggagatgtttaaattgagtacactgaaatgtggatgactgttaatgtgaatgaactgctttcagaataagaacatttatttacaagttctttaaattgcaaagcttattataccattgaagcatttcatgtgaactttctgttttgaactaatctttaaattttatttgcattcaaagcatatttcctcctgatttgcccatttctcattgtttgattatcattttaaaatctgtaatgtctcattcaccttttaatttttccccaataaggaaatacagtttatgaggcacgcatagatactcttcctaataaatgattaaagagaaatacatgcatatatgcttcatatatctgtatgta

SEQ ID NO: 706940 - DNA, 114 bp, Homo sapiens
tgggagtgattcaaactcctcactgtaaaattataatatccttataaaacagatgcttgaaggcagcatgtgcgataagagtcatcaccactccctaatctcaagtacccaggg

SEQ ID NO: 706941 - DNA, 506 bp, Homo sapiens
tgaccttgatctctggcgcataatctgtgtcgagtggtctctgacattgatacaagaagtcatgagaggacccctccctgtccctcgccattactaccttaaagtactgatcctctctgagttaatctgccaggcctctaattttctccctgtgcgcccatttcagaactgtcttgagtgacaagttcctgatgccttctagatattttgcactattgaaagtgttccataaagtatattacatttgctccttttaaaggtatatacaaaacgacctcatatcaaaaactgggagaacagacgaaaaagaaatcatgccataatcttccagctgtaatacaatcacaggcagcattttggtttcttttcggtcacttatgtttcctctcctagctcctttcttacattgccttgaacttggttatttgggcacctcgggaacctcctcccctgccaacactggctagcactgaagcccaagcactgctctgttgcttcttcctgag

SEQ ID NO: 706942 - DNA, 190 bp, Homo sapiens
ttgcaggcggcagatgcaagcctttctgcaacccaaagttgtcctcgtaaaagcagaatggtgacttatggagcttggcccaagaaacatcccttgaccatggatctttccgggctggcccggctttgctcccgaactcttgcgccacttcaaatggcaccacccatgacgtcatcgaagaaccaattag

SEQ ID NO: 706943 - DNA, 114 bp, Homo sapiens
gggggggccccccccccccattgggggtttttttttccaatggcctttttgggggttttgaaccaccctttcccccctttaaaccccggaaaaaaaatttccggttggaatgga

SEQ ID NO: 706944 - DNA, 757 bp, Homo sapiens
tggcggctcaaactttattaaaatgcaccaggagccccaggggcccactagggaaggtaggtgaggggtccagggccccgccgggagcaccaggaccaggggggccacctccaggatgccaaaacccggctcctccagcgccaaccgtgttttccaggaggcggggggccacaggcgggctccggggttgaacccggctgggagaatacgtaaattataaaaaggtgcgggaggccccgtcccaccccggcccggggtccgcagccagcacgtggccacccctcccaggggggctccggaggcccgtgaagccaccgtggagctagggccttccagaaacggggtcccggggggctccaggcacctggtccctccctccctctctcccagctatgggggcagagcaccgaggctgggtgggtggggaaaggcagctgtggggtcgcggccatctccccgggggcgtcctttgggcagagaagccgggcggggggcggcctacgcgcagaggtgtcggcctggaccactgggcatgtactgggtcatggcgaaggtcaggcccaggattctgcaccaggccgtgcacagcccaaagatgcccaaggcagaaggttctcctgaagccacaccttcaccgtctcgtaagcacggggacttccaccaggttgcgcggggggtgaagcccaaagtctccatgaattccaagaagaggatccggtacccggggggttgacccctcgaacactcggggatccga

SEQ ID NO: 706945 - DNA, 180 bp, Homo sapiens
caagggaaaggtgtttggactaagactagaggcagtgcctacctccctaccaagagtgaggatcaagcaggtatagcaatgaacagagccctggtctgagctctgctggccgcaggctcaggagccagggttaaggccagagataaatgaagatttgagccattgataaatgccaatata

SEQ ID NO: 706946 - DNA, 822 bp, Homo sapiens
ggccgtcatggcgccccgaaccctcctccggcaactctcgggggccctggccctgacccagacctgggcgggcccccaccccatgaggtaaaacaccacatccgtgtcccggcccggcagtggagagccccgcttcaacgcagggggcaacggggacgacacgcagttcgggcggttcgacagcgacgccgcgagccagaggatggagccgcgggcgccgtggaaagagcaggagaggcctgagtaatgggaccaggagacacggaatgtgaaggcccactcacagacggaccgagagaaccaggggaccctgcgcggcaacaacaaccagagcgaggccggttcccacaccatccagaaaatgtatggctgcgacgtggggtcggacgggcgcttcccccgcgggaatgaacagcacgcctacgacggcaaggattacatcgccctgaacgaggacctgcgcccttggaccgcggcggacatggcggctcagaacacccagcgcaagtgggaggcggcccgccgggcggagcagttgagagcctacctggagggcacgtgcgtggagtggctccgcagatacctggagaacgggaaggagacgctgcagcgcacgcggtaccaggggccacggggcgccttcctgatcgcctgtagatctcccgggctggcctcccacaaggaggggagacaattgggaccaacactagaatatcaccctccctctggtcctgagggagaggaatcctcctgggtttccagatcctgtaccagagagtgactctgaggttccgccctgctctctgactcaattaagggata

SEQ ID NO: 706947 - DNA, 225 bp, Homo sapiens
  misc_feature (172)..(172): n is a, c, g, or t
  misc_feature (185)..(185): n is a, c, g, or t
ttggcggactcatggctgcacttgcaacagccagctcaggctgaactcatagccactgtctgcgcctgccctcagcactcagaacgggatgcactgccaggagcacgcaccacccacagtatggctcctgtgagcaaggcagatgcacagtccaggtgctgagcacaggaangcacaggaacctncagaagtgtgctctgggtcatgacatacaggtgctcaaag

SEQ ID NO: 706948 - DNA, 599 bp, Homo sapiens
ggccccagagttccttgcatactaatttcacccccaccccaccctccaggttagggggagcaggaagcccagataatacagagggacagaaacaccagcttgctaccccctcatacccctatacacctacctgcttataacaaaccatctactacggtgacgcacaacaggacccacagaaacaacacatggagatagcgacgtaaagcctagttgtcctcctcagactgaaaaagctcagtacagaagaacgaccacagccaatcgcacacacagtcgtcacacagcgcacacactcacgggcgacccaacagctgacgacaacgtactactcaacaatcaagtcgccatagggtccaccaagttcgtggaacgcatcctaccgtcgcgacgtcgagaaaaaaacccaccgagcctccgagtacagtgccaccacctagccaacattacctcgcgagcgagcaccatagcgacacacacgcttccagcacccctcccccttagtccgtctatcaggcagcaacaggaggcatagttcgagggagcggctgcaggaatgtgcgacctgaacctcgctcaagcgctccccatcaagaata

SEQ ID NO: 706949 - DNA, 100 bp, Homo sapiens
aggagattggaagcaaatttattaagaatgatggtgggggtggggggagggttttggttttttccaaagtggaccattgaaataaaggaagtgttcctta

SEQ ID NO: 706950 - DNA, 340 bp, Homo sapiens
  misc_feature (162)..(162): n is a, c, g, or t
  misc_feature (308)..(308): n is a, c, g, or t
gagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtattttnagtagagacgaggtttctccatgttcgacaggctggtctcgaactcccacctcagcctcccaaactgctgggattacaggtgtgagccaccgtgaccagccaatgtggccttcttatagtgtctactcaattggtcttttgttctngcccagttggttaacaaatgggataacgcctg

SEQ ID NO: 706951 - DNA, 359 bp, Homo sapiens
gacatcttgcaaaaaggacaaaagttaggagatccaatttcaaaacgtatacaaagctatagtaatcagaatagcatggtgttggcataaggtatagacatattaaccaatggaatagagtcgtagatcctaaaatatatctctacctctattaccaattgttttttgacaaggtgtatcaagacccattcaatgggcgcaaggaatcatctcttacaacataattgtgtgcttggtcgaccggatatccaacagtgtcatcacagatttaaattgcttccctgcttcacatcttatacccaaatattaactgataatataatcaatcaatctacattttagatctaaaagcttaaaac

SEQ ID NO: 706952 - DNA, 656 bp, Homo sapiens
gggttggggtgtgagaggttttctcgctctagggagattcttcaagcgatcactatgtcaacagacaccaggtgtttcccttccttcatatgaggaaggatcagggatcaaatactcattcgaaaagctaaagaggagacattcggtacccgttggaatagcgggttttgcagcaatagttgcatatggatttatataatgctgaagagcaggggagaatactaaagatgtccattcatctgatgcaccacatgcgtgtggtagacacaaggctatgttgtaaggagcaatgactgttggtatgggcgtattcgcagtgtatcgggaatggctgggcaaaagctaagccttagaagaagagatgctgtgttgggcttgtggaggagcttgctttagttagatgtcttattattaaagttacctattatcgtgggaaataaactaatttgatgggtttaggatggtaacatgggcattgtgaatatgggctttgctttgcttgcaggcgtttgagtttgactaggtgagcgagttactagtgagtaggtatactaactaggtcattcagggaagtgcaagttaacttatacatgtcatctgaaatgcacgtgatgggtgtggagaatgtccagcttcttaaatttttaagatgaact

SEQ ID NO: 706953 - DNA, 436 bp, Homo sapiens
tacgggatatcgtcggaaccacgcgttcgcctaccccccagggcagcaatgtattccggggctgtatgctggggtctgagggcactgggccattctgagaaatggagctgtagctatggcctagccagcagcccccagtgctcgctcagtgggaaatatcagccctaggctggtgtttttacaaatctctctcagatatattattttcatgacgaaaattaaggagcttgtaaattttgtaaaaattatgaatcgtatcaagtagttgtttacatttgacaaaataggaactatgccggcagagtccaaccgaaaaccccctaggtgagataggcagtaactgggcctgctgtctgcgcctttcgtagtgacagatgtggctgtagtgtttaggtgttggtcttgcttcttgtatggcattttttcaataaacttt

SEQ ID NO: 706954 - DNA, 322 bp, Homo sapiens
tttttttcagggggaattttcaatttttgggaacccccttgctcccaggggaggggaaaccttttttatttaacattgtagggggcaaacttttgttcgccccctttttaggaacagacccagaaaggggccaaaagggtttcttttttcctgcctgggattttggggttggcctttgaattggaggaaggttgggctttgatcagtaaatttggtttccccctcccttttttaaaaaaaaagcaggagccccagggccggctttttttttttcatttcacaaaaactttttttggtgtttttgtaaaaaacgttaatggga

SEQ ID NO: 706955 - DNA, 850 bp, Homo sapiens
  misc_feature (43)..(43): n is a, c, g, or t
  misc_feature (53)..(53): n is a, c, g, or t
  misc_feature (850)..(850): n is a, c, g, or t
cccttcctaatcctctcccccgccttttcaccccatccccccncctaggtggngacattcagctattttcttgactttgccgaagtcctaggcactcccatgccctcagagcctcattttgaatccaggcacttaggggtgctatttttccacatcaaacagctccctcccagtcaaagaattctcggtgacagtagtgaagataattttcactcctgcttacagaatgacacagcaaaatcatagaggagacgaatgaagccaagacaaccacccgaaaagactgatggctccttaacaatgatcttgataaaggaatgtatggatgaggcgtccatctcctatatcacctaccttactgtatgcctagtgataaagtatacacaaagttgcacctcgagcgcgaaaactccacaaccccccccccgcacaaaccatgctattacaccccacgcctcctatttccctcacgtccgccgactcctacccaaagacgtcattccccccctgacacgagtatatttattaataattatagcgactattacccatcgcgtaaaagggttatcatcaccacccagctctcccccacaccaccacctcctgccacccccccccccctcaccccgttactacacaacctcctcctaccttctatattctttgactcccaccacccagccagacctcccaactatacacacctcgacccccccacatatccccaccaaccataatatcccccactcgtattccccccacatcctctatccctttcctctatgcgcctttttcggtccgtttatgaggacccagatcctacatgttgcaccacccagacaaagcaaan

SEQ ID NO: 706956 - DNA, 822 bp, Homo sapiens
cctgcacaaaaaacaaaaacaacacagaaacaagcggtgtacacgataggaggagcggggtgagtagacgtacgagcgggctaggcgcgggtgggccttccagacgggtgtccgaggccggggtggccgccaacagaggggcgtcccagacgagtggtccgccgggccccctggggccctctcacccgggaattggaaaggcttcttagccggcatggtaaaaacacctggctccgccggggggagcccttggcccttgtgtcggtgaaggcgctcttacccgcggttctgccctgcgccccccccgggatgttcttcaccggcgcgcccccccttgtttagtctccgatatgggggccccccctttcgccaacagtccggtgctcgcttcagcgcccccggaactgtcccctcccgggcggggacgccctctcacacgccgcaggccttcggggtacacttcctcccgaacgcgccacgttcgtgcgctgcgggaccttccccggactctacccccggggagactaggagcccctttcgtctttagatatcttcgtggagactccctttattaatgtctttcggccgtgttgaacatgcagggaaacccctcaccgggggatacctggcgggcctccactcaaggggggaaccctccctcgccaccccgatgtccgcggtgctatctcgcttgatggcaacactgtccacgggggaacacgccttctcatatagtgcgcctgagcgcctcctttgcccgggcctgttgtaggttctgcccccccctgcccccccgagacccctgtttttcccccacaaaac

SEQ ID NO: 706957 - DNA, 258 bp, Homo sapiens
agtggcagcattatgcacaatgactgcgccggcgacgcttcagggggttcggatgcgaatggctgtagctacgagggctatgtggctgattgacgagtatgcaatgagcgattttaggtctgtatgttagaacctgaaggactagagaaggcaacaacatacaactcccatacatatagtccatcaggtggagaggtttctgaagaattatccctgaaactgccaacaaatgtggtagaagactctgcccgagcttct

SEQ ID NO: 706958 - DNA, 1237 bp, Homo sapiens
  misc_feature (1086)..(1086): n is a, c, g, or t
  misc_feature (1237)..(1237): n is a, c, g, or t
ccgaatggcccgtgcgcagtcctcacggagtggttttggccaaaaggcttgtggtagggggctctgacaaccacggctattaacttcttaaaggaacttaaaagaagggattccaacgcttatattgggaaggtggaaataatggcggccccgggacattgggtgagaatctttaagccagacacctacaaggcaaattccgacaaccaactctcacaccaacgatagacgcgcactactctcaggaacatacagggcgttggtcctacatgggttccatgaacggaccatgggaccccaagtccgacgacaattccctgtggccatctcggtgcgcagtggccgcgtcctgtgtgacaggcgcagctgtggggtgtcctcaaccttgccccgggttgggatatcccttgtgtgaacccctctccccaagtttgcctgcttccttgggcccttggaaagtttgcgacatcccaagttgcccacccaagccttttgccttaattacaacattcaactgtttggatcccacaaaacaacaaacacccaaacacaccacaacaccacaaagacacacccaccaaccacagacataacgaatcacacactacgcacgctcctccacgtaccgatacacaactactcaactgatagcgacgcactaacctctccagggggtgtgccccgcgataccgacatactcggccccctaatcgcgacggccggattatcacaaattcctcgtgggcgcgcgttatactccacagcttcgcgcatcgtcgcaacaccctcttgcggtttcccaaccaatactctgccctggtagtatagttcctcccttttagccagcctggtgctactcaccgacatagtccggctcctgattgcccttcccaacatgttgtgccccccttaaatggcaattggccattagtacgcgtcactattggtaaccatccggtccgatcggcactctgcactatacccaatggcgaatcggcagccgttaatctagagaaccgaacagttaggtgtcctcgtgccagcccttcaacggcacgccggggacgcatggtactagtaccccanttggggtgacctcagccatagaagagagaggaccctttatatttctgccagcctacgacacactcgcatgatgctgatacttacactacacgatcatcagatcatcttaatgatgtgctccactagctacagtcggaggacgcatctacgn

SEQ ID NO: 706959 - DNA, 757 bp, Homo sapiens
  misc_feature (423)..(423): n is a, c, g, or t
cggttcaccttcggtcaatgaaccagatctggacacacgtccgccaccggggtgcaagagacctgatcggaccgggacctgccggccggcttcaatggccgtggaacagtggaggacgaagagcgggacccgagccctgttgcaggaccagctctgccccctaattataaaagcagtagttcagattcatcagacagggatgaagacagtagttctttgtacgaagaaggaaatcaagaatctgaagaagatgacagtggtccaactgcaagaaaacagaggaaaaatcaggatgatgacgatgatgatgatgatgggatttttggaccggcccttcctacaggattcaaaaagcaggatgattcttctccaaggcccataataggtcctgcattgtcacctggtttcattgaatctacacanaaaagtgacaagggcagagatgatccagggacacaagaaacagacagcactgaagatgatgatatttattgacccatgcctggaaaagggccaggtaactataatgtaacggccggaagttgaaaaaaggggccccaaaatggaagaaaactgaccaaaggggagtatgattcatctaaaccccatgggagagagccatggttgactggacttcctccacaaatgaagacatttggctttgggccaggactttttaatagagaaagcgtgacccatttggggacgaacaatttgagaaatcttcccttgtttggggaggggaggtatgtaaaca

SEQ ID NO: 706960 - DNA, 674 bp, Homo sapiens
  misc_feature (113)..(113): n is a, c, g, or t
  misc_feature (143)..(143): n is a, c, g, or t
  misc_feature (253)..(253): n is a, c, g, or t
  misc_feature (270)..(270): n is a, c, g, or t
  misc_feature (332)..(332): n is a, c, g, or t
  misc_feature (347)..(347): n is a, c, g, or t
  misc_feature (356)..(356): n is a, c, g, or t
  misc_feature (388)..(388): n is a, c, g, or t
  misc_feature (589)..(589): n is a, c, g, or t
  misc_feature (593)..(593): n is a, c, g, or t
  misc_feature (618)..(619): n is a, c, g, or t
  misc_feature (626)..(626): n is a, c, g, or t
  misc_feature (635)..(635): n is a, c, g, or t
  misc_feature (646)..(646): n is a, c, g, or t
  misc_feature (648)..(648): n is a, c, g, or t
  misc_feature (654)..(654): n is a, c, g, or t
  misc_feature (666)..(666): n is a, c, g, or t
gaccgcgttataaagtaaaggaacccgagatctgcgcagtgggtcccttgccgatttctctcacctcacctttcaaacctaaactcgagcctactgttcaccggcctagcatngctctcgccatggctctcagcgatgctgancgtgcaaaaagcagataaagcatatgatggctttcattgaacaagaagccaatgagaaagcagaagaaatagatgcaaaggcagaagaagagttcacacatagagacacnggtcggcttgtgcaaancccaaagactaacagattatggaactattatgagaacgaacacgagaaacagattgagcagncagaagaacattcangatgtccanatttgatgaatcaagcgagactcaaagtcctncagagcaagagatgaccttatcacagacctactaaatgaagcaaaacagagactcagcaaggtggtaacaagatacaaaccaggtaccaaagtgctcgctggatggactggttctccagggtttgtgttaccagttgctggagccccgatctgattgtccgttgcaggaaacaaagatttccctctggtaaaggctgcagngcanaaggcaattcctatgtccaaaattnncaccaanaacgatgtngatgtccaatngnccaggngtcctacctgcntgagacat

SEQ ID NO: 706961 - DNA, 732 bp, Homo sapiens
  misc_feature (526)..(526): n is a, c, g, or t
  misc_feature (732)..(732): n is a, c, g, or t
gacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagcctttgcaaacactttttatgactcctgaatttaggaatgcattatataagtgggaatttgaagaatctgaagaagatccagtgacaagtattccataccaacttcaaaggcttttgtttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggncaagctgaaggactacgtgagatgtctggaatgtggttatgagggctggggaatcgacacatatctggatattccattggtcatccgaccttatgggtccagcaagcatttgctagtggtggaagaagctttggatgtcttattcaggcagaaattctggatggcccaaatcagtattttgggaacgtgtagaagaaagtgtgtgn

SEQ ID NO: 706962 - DNA, 572 bp, Homo sapiens
  misc_feature (113)..(113): n is a, c, g, or t
  misc_feature (143)..(143): n is a, c, g, or t
  misc_feature (253)..(253): n is a, c, g, or t
  misc_feature (270)..(270): n is a, c, g, or t
  misc_feature (332)..(332): n is a, c, g, or t
  misc_feature (347)..(347): n is a, c, g, or t
  misc_feature (356)..(356): n is a, c, g, or t
  misc_feature (388)..(388): n is a, c, g, or t
  misc_feature (487)..(487): n is a, c, g, or t
  misc_feature (491)..(491): n is a, c, g, or t
  misc_feature (516)..(517): n is a, c, g, or t
  misc_feature (524)..(524): n is a, c, g, or t
  misc_feature (533)..(533): n is a, c, g, or t
  misc_feature (544)..(544): n is a, c, g, or t
  misc_feature (546)..(546): n is a, c, g, or t
  misc_feature (552)..(552): n is a, c, g, or t
  misc_feature (564)..(564): n is a, c, g, or t
gaccgcgttataaagtaaaggaacccgagatctgcgcagtgggtcccttgccgatttctctcacctcacctttcaaacctaaactcgagcctactgttcaccggcctagcatngctctcgccatggctctcagcgatgctgancgtgcaaaaagcagataaagcatatgatggctttcattgaacaagaagccaatgagaaagcagaagaaatagatgcaaaggcagaagaagagttcacacatagagacacnggtcggcttgtgcaaancccaaagactaacagattatggaactattatgagaacgaacacgagaaacagattgagcagncagaagaacattcangatgtccanatttgatgaatcaagcgagactcaaagtcctncagagcaagagatgaccttatcacagtaccagttgctggagccccgatctgattgtccgttgcaggaaacaaagatttccctctggtaaaggctgcagngcanaaggcaattcctatgtccaaaattnncaccaanaacgatgtngatgtccaatngnccaggngtcctacctgcntgagacat

SEQ ID NO: 706963 - DNA, 829 bp, Homo sapiens
agcgggctgtacccgacccgggacgccctgctctcgcgccgaggggttcggcgcgggatacgtgcagaatccggactagctgagaacatgtagaatttccggacttggagcatacctactgtcgtcatctgcttcccgtgcgtgtgtagatgtggacaatatttctgcctacaaaggctgggactgacagatgactggtgaaatgtattggtttggaaaacttggttgcacataatcacagctatatatgaatagccaagtgcctaccttcctggagctactctatgggaatatgggcgtcacgaccacgcatggacaagtccaaagaccgacactttggcttctcctctgggtattgtggcgtcgcagacttcagcatccattgaatgccccaatggcgaaggaccgaacatagcgtaggtcgagtgtcggcgagtcaatcgcttgatatgtggccaaccggctctcaatcctcgctgcacgtgggcgccaagtacaaagggtggatcggttctagctgggcttgggcgtgggttctatacttggttagagtagacctgttcctttcatttgatcaatccagttgtgcgagaatcctacgacagaagtaacccggatatatatagataccaagtgcggatcttggcgcgaggcctttaatctcttcaagtccccatgggtaacgctaggagatttctgtggctttgcattcggaagggtggatccagagctgtctactaggaagatcattgtagagcaccagccgatggatacatagcgcatgcttgcttgaccgagaacttagaataggtaaagggccacagaccaa

SEQ ID NO: 706964 - DNA, 754 bp, Homo sapiens
ggcaagcagcgagcgtgccggtcgctagtcgcgggtccccgagtgagcacgccaggagcaggagaccaaacgacgggggtcggagtcagagtcgcagtgggagtccccggaccggagcacgagcctgagcgggagagcgccgctcgcacgcccgtcgccacccgcagttagccggcgcagtctgagctcaccagcgcagcgctgcctagtggagcgccagcgagcaagaagtctgaggggtcggctcgatgcttggccgtgggaggagcagtgcttggctccctgcgagtttggctgacaacgactggagtctgtcaatgccccccagaatggtgatcgaggagttctacaaccagacatgggtccaccgctatggggagagcatcctgcgccgacctactgcatcaccagcgcgtcgtggtccctctcagtgggcatcgttttccttgttgggggcatgattggcatccttctctgtgggccttttcgttaaccggtttggtgcggcggaattcaagtgctgatgatgaacctgcgtggccttcgtgtccgccgtgctcatgggcttctcgaagctgggcaagtccttttgaggatgctgatcctgggccgttcatcatcgggtgtgtactggggctgacacaggcttcgttgcccatgtatgtgggtgaaagtgtcacccaaggcctcgtgggggccctgggcaccctggaccagctgggcatcggcgccgggatcttcattggccaggtgt

SEQ ID NO: 706965 - DNA, 348 bp, Homo sapiens
attcattcatgaaaatttgactgagtattcatcataagacttggattttgtcagttaatgcttctaaaattaaacagctgcatgacaatttttcttctttctcagaattttaattgaattatgttgtagctagtgttcaaaaatgattaaactcccttacctcctcttgcacacacacacacaaatggtaactgtgtggtgaaggatgtgttaattaatttgatcatggtgatcattataaaatgtacacatatatcaaatcatcatgtcatacaccttgaatatatacaacttttatttgctgatcatacctaaataaagctggaaaaaaatatagatttgcaaagc

SEQ ID NO: 706966 - DNA, 168 bp, Homo sapiens
catgctgtcttcagtgatgggtgacagagtgagaccctgtttcaaaaaaaaaaggttggtggactcatgctctaatatataatcccaaatagggaattagatgcagagcagaattaaaacgaagtaaattcaaaaaagactatcaccaaattaaaatgttgatacaat

SEQ ID NO: 706967 - DNA, 371 bp, Homo sapiens
gcggtactatgcgttgcgctgggtatgcactggctctgcggtgggatacccgcacttctcccgcatgggcaggtatgccgtcgctgcacgtgggatcacggtagaagggcaggcacgcaaggcggctggtgtgagtgtgggcccaggaacggggagctgctcaggtcactgctagtgaactggacttcatcatccgaaagctgcatccggttctttaaaggaggggggtactacggactcttgcttacttgcgccgatgctttctcccatcgtgaacctgcgtccgtggtcacttgtgaagcagggttgctcactgggcaagtcgcgcttctccgattctcctccatagccactgtctgtgtccgtgtcgc

SEQ ID NO: 706968 - DNA, 170 bp, Homo sapiens
cacgacgacaatatttgacccgcaatctgcactgacacacatcactgtgctaaaacataacttgaccatcgtgattaaccgctccaactccaccgctgctaccactgacgttcctgaggccacagtgttttccaagtctcccgtgatactgggtcagcccaatatcctca

SEQ ID NO: 706969 - DNA, 180 bp, Homo sapiens
ccataaaccttgactaacactgtgggacacttacaaagtgtctcttgtgatactgaaaatgttcccaagaagcagagaaaagtcatgagattacatgagaaaggtgaattgcttgatatgtaccagaagtctgcagctgtcacttcaagataaatgaattcagtgtaagaaccattgttt

SEQ ID NO: 706970 - DNA, 974 bp, Homo sapiens
tgcactccagcctgtggcgacagagtcaagactccgtctcagaaaataactaaaaaacaataaaagtaggtgaaaattccttataaatccaggattggctctgagcagaactggcgtaagattcaggaacgaacaccaacacttccgaatccaacacaggttaggatgacaattggggccacaaattttagggaggagatgtcggatgccggagaaaacttaaacgtcgtctaaactgctatactcagaggaggaacatagtacgaaggtcacgtgacacggtcttggcggtaggcacaacatttcaagaactgtccattgcaatggctggtgggagtgacagactgcccttagcctgggtcacgccttcctgggccataaatggggcatccgctgctgctacggctacacctgtgggaacacaaattgacagcttacgagcagccaatgggttgcaagataaggcggataaaaaacacctacaggcgtacggggtcccactgaaggttccaagcaccactgacatctttcctggatgtgcggtaacgcaaacacgagcacagagaacgcagagagttactgaccgactatgcaagcactatgccccccttcacttaatactactacacatcgtctccccctatgactaatcacaaccaagtactaaataaccctgcagcgcactctgcggcctcgaacttccttcgggcttgatgacaccattgtcgccacgctgcaggcgttatacccaacaacgtgacaagcggctaggcccaagtacatgacccctcggcccttccccaccattcgagaaataatgggcacgcccttatacatcacatcggcttgaagaagggcaaagaccattgcatcataacaatgccttaccgacaagctgacgcttaaccggggtgtactcatgccgaaaaagacaacatgcctgacatactcagcatggtacccagaaaaacgca

SEQ ID NO: 706971 - DNA, 277 bp, Homo sapiens
gctgacgccgcggtgactttagaggtccccatctcatgctaccagtcgaagcacagatgtaagagtactgcgacacaatgactattagcgagattatccgagctcaaacaagatgagtgatagatcgcgggaagttgcttcgccacagccataacaccatcaatgttgagcagcagcatatggaggcttacttactacgacttcaggctcacccgttgagctctcgccctcgtcatcaatgacgactggtagcatgagatggtccgcctagcagttc

SEQ ID NO: 706972 - DNA, 439 bp, Homo sapiens
  misc_feature (33)..(33): n is a, c, g, or t
  misc_feature (174)..(174): n is a, c, g, or t
  misc_feature (426)..(426): n is a, c, g, or t
catctcagagggtcctaggaaggaccttgttanataatgaatttggctttggtaaaataatttgggaagggtctcaggaagtgaggatttgctctggattgagtgctgtcagtaagtggggacagttttgtgattgggtatcttaagaaatcttatcttgccgggcgcgggtgntcacgcctgtaatcccggcactttgggaggccgaggcaggtggatcatgaggtcaggagatcgagaccatcctggccaacatggtgaaaccccgtctctactaaatatacaaaaaattagcctggcatggtggcgggcacctgtagtcccagctactcgagaggctgaggcaggagaatggcatgaacccaggaggtggagcttgcagtgagccgagatcacaccactgcactccagcctgggcgacagaancgagctccgtctc

SEQ ID NO: 706973 - DNA, 768 bp, Homo sapiens
  misc_feature (24)..(24): n is a, c, g, or t
  misc_feature (95)..(95): n is a, c, g, or t
  misc_feature (114)..(114): n is a, c, g, or t
  misc_feature (118)..(118): n is a, c, g, or t
  misc_feature (181)..(181): n is a, c, g, or t
  misc_feature (206)..(206): n is a, c, g, or t
  misc_feature (216)..(218): n is a, c, g, or t
  misc_feature (220)..(220): n is a, c, g, or t
  misc_feature (222)..(222): n is a, c, g, or t
  misc_feature (233)..(233): n is a, c, g, or t
  misc_feature (278)..(278): n is a, c, g, or t
  misc_feature (292)..(292): n is a, c, g, or t
  misc_feature (295)..(295): n is a, c, g, or t
  misc_feature (310)..(310): n is a, c, g, or t
  misc_feature (312)..(312): n is a, c, g, or t
  misc_feature (369)..(369): n is a, c, g, or t
  misc_feature (371)..(371): n is a, c, g, or t
  misc_feature (380)..(380): n is a, c, g, or t
  misc_feature (395)..(395): n is a, c, g, or t
  misc_feature (405)..(405): n is a, c, g, or t
  misc_feature (458)..(458): n is a, c, g, or t
  misc_feature (462)..(462): n is a, c, g, or t
  misc_feature (470)..(470): n is a, c, g, or t
  misc_feature (480)..(480): n is a, c, g, or t
  misc_feature (485)..(485): n is a, c, g, or t
  misc_feature (516)..(516): n is a, c, g, or t
  misc_feature (560)..(560): n is a, c, g, or t
  misc_feature (605)..(605): n is a, c, g, or t
  misc_feature (648)..(648): n is a, c, g, or t
  misc_feature (732)..(732): n is a, c, g, or t
ttattcgtttatttttgttttttntgcattttaatatagaggtggccattacaggtgaggaaatgaatttttaagttaatttaaattcaaatgcnacatttggctcgtggcttntgtnttggacaacacagctgtaggccctgacctggtccagggcactttggtttaaaagctaactttnaggagagcaagtggtagaaacagcncttgggtttnnntncncagagagaaanggcagctgcagctgttggaaagggcaagaattagagtgggggganacttcgggggcgcnggntaaggttggccagcngnttgggcaggccacttgtggggggttttttgatgtggaaggtttgggtgaggagattntngaaggagcngtaggaaaggggcancaaagtgcangtgaggcagatcacgttgtagggcatgctgaagtttggtgttgggaggtttancagnaggggctntgtgtagagntgcanaaagtagttagagcgattagagattgggaanaggctgttgaagaggggactctcttcccagtccactggcttggntgctaccatgctgggcacaagggcgctgaggacagatgggctganatagaagccatggttaggatctggcgtgtactcggtccacttnagcagcgcccgctcaaactggatggaaaccttggtgactgagttggccggcagctgaatcagcatctccaggaggtggggttgnagccggtcctgggcaggctggtaatggatgtaactt

SEQ ID NO: 706974 - DNA, 903 bp, Homo sapiens
gaacgggccgatcatgcggtataatgtcgacgccaagaggcgtaagattgaggcgaaccacactctggtgcgcctttctctgtgaggcccgtaggctgggcaaaagtgacatcaaacggcctgttaaccgagagtaacggcccaccagaaggccaaaaactcggcgccagagtgacacacacgtccagagggctcaagaaaccacacagtccagcggcagcaagggcccagctctggaccctggcgctgaagggcccatgggacaccccccagctgttttgtggttgtgtggccccccagccaacccagcgcgttctttggccgagcgacgttctcccaggcccctgtaaacggcgtggaactcgccacaggccttgaccaaggaatatggtgtccccgtcctgggacaatggacacagcaaggatgacccacagcggtctttccgacagaagtatgggacacgcccctgggcacaaccctgcctggatgcaaccccacagagagattaagcggcaaaaaccccggtggcctccttatggggagaagaaaccatgacaaactcccctggatggcgcacacaagtatgcatcagaagcagccttgacatagacaaacgttcaattccaataaggctaacaaaggagaatatgttctcccggatgtatcacagggagcaaccctaacacatgggtgtgaacaaaaataggccgcgtgtaaatccacggcttctattcaatcactgacttctggacagatcagggatagaggcccattctgattacacaaaggcagtgccccgcaaaccactgatacaccctaataccaagcgtggtgttcagtgacccaaaacagcagagaaagatagttctaaggactcgcaaaaaaaagcacgcacccagcac

SEQ ID NO: 706975 - DNA, 561 bp, Homo sapiens
atccaggcgaccccggtaaacatatttctgctttcttgtctttcggatcatccgggaagggatagagacccaagaatccttaccatcatggcatagatgctctctagtagtcatggagtcaggaagacgggtagaatcccacatagtcattcaacagatgtatgcagctctatatctccactactatcacaacggctagtgaccatgccctaactcacaggtatgactatctaggtgctccggtaataggcgatgtggagacaactggtgcgtatggtgctccatggtcacaaggtggcactgccaacagtctaccacccggcacagtttgtgctcttcacactagcgctcatctcgcttcttctctaggttgtaggtgagctcatagtctgaattcacaaacagaatattttcaggcttgaggtctgtatgtagtcagcttgttatcatggaggaacttgacagcctggcacagctggaaggccatgtggcgcacttggtggatggggtagggcaggtagtagttgtctttgaggaactcgaaggtgctagggcccagaa

SEQ ID NO: 706976 - DNA, 383 bp, Homo sapiens
  misc_feature (11)..(11): n is a, c, g, or t
acctcacaaantccttagagcaaataagtcctcaatgtcaataacttgtttgcccagttgctcagcacagtgtatatacatgcctgtgttcctgactgcttaaaagctggctgtgtgtggtggctcatgccgataatcccaccactttgggaggctgaagcaggtgggttgcttgagcttaggagtttgagaccaccctggccaacatggcgaaatcctgtctctaccaaagatacaaaaattaggtgggcatggtggtgcatcctgtggccctagctactcgggaggctgaggtgggaggatcacttgagcccaggaagtcaaggctagagtgagctgtgatcacaccactacactctggcctgggtgacagtgagatcctg

SEQ ID NO: 706977 - DNA, 148 bp, Homo sapiens
cctcggcatcacttccttcatgggaaggtgttggcgctgatgtcgctcatggacggatcacactgcgaaccacacacgaacgctcacgtgggatgtggaggtcagaccatctcacgagactccctcaagctcagcaacacacccagga

SEQ ID NO: 706978 - DNA, 518 bp, Homo sapiens
atataaagcagctgacagggcctcacgggccacatgtagaataatgtgagcatcgataacaatgatcataattgattataaaccacctgactaaataaaaacccatgagtccatagtgatcgtcacagacagatatttattggccaccattagaggcgagtcataacaccaagtctttgctgtaaacatgggtcattatagtaccttgccaggaatatcacctaggtgataaaattaggacaattcaccattttggcacctttcggtaaattaatccaggcaagaaatcatcaagggttatgcacacagtgcccaggtatctctccgaaggctatgtgctcatggccaaaaacacaccttccaagggagagatcagaatgaccacccttggccgctgatcagacttagcgtcactaacagttggacacctggtgagacataatgggttaagaagcacccagcattgcctggcaattgttaaataagcttgagctgccgggtgacgtggctggccagct

SEQ ID NO: 706979 - DNA, 229 bp, Homo sapiens
  misc_feature (8)..(8): n is a, c, g, or t
  misc_feature (72)..(72): n is a, c, g, or t
  misc_feature (82)..(82): n is a, c, g, or t
  misc_feature (112)..(112): n is a, c, g, or t
  misc_feature (197)..(197): n is a, c, g, or t
  misc_feature (222)..(222): n is a, c, g, or t
ggcggcgncggcggcagtggcggtcccactggcaggcgggcaagaggggagtccgggcggcggcagcagtgnggagccgggngaccaccatggtaaagaagcggaaaggccncgtcagtgatcgactcaggacacagaggacagcggcagacagagaacctggatcaggagctcttgtccctggcaaagcgaaaccnaggtgactcttgaggagaaggagcngccttgt

SEQ ID NO: 706980 - DNA, 428 bp, Homo sapiens
tcattaggaggtgttcatcaacacgtgggttggaaagaaaatatggtacatatacaccatagaacactatgcagccacaaaaaaagagtaaaatcatgtcctgtgcatcaacatggacacagctggaggccgttattctaagcaaattaaagcaggaaaagaaaaagcaaataccacatgttctcacttataattgggagctaaacgctgggtactcacggacataagaatggcaataatagacactggaactactagagaggggagagagagagggagggatgagttgaaaaactaactgttgggtacgatgctcagtacctgcataacgagattattagaagcccaaacctcagcatcacacaacatacccacgtaacaaacctgcacctgtaccactgaatctaaaacaaaagttggggagaaaa

SEQ ID NO: 706981 - DNA, 213 bp, Homo sapiens
agtattcgttcaggaacgagaaaggtatcattgaggaatgctagtgtctcaatacatatgcatgtgtaatcacgagcccatgaacatgaataacgtgaacatgaggccaggaactgactgagaacattatgtcgtgcgacatttattgtatgcatgactgctatcaaagcagttgcccctgtcagcgtatgactgactacgcttactcgtggt

SEQ ID NO: 706982 - DNA, 199 bp, Homo sapiens
gccggacgaggaccccagaaactattatgcatctgatgagtctcaagggtcgtgtgtatgaagtgagtcttgctgatttgcagaatgatgacgttgcatttagaaaattcaagctgattactgaagatgttcagagataaaaactgcctgcactaacatccatggacatggactcttaccctgtgacaacaatgtgttc

SEQ ID NO: 706983 - DNA, 744 bp, Homo sapiens
  misc_feature (305)..(305): n is a, c, g, or t
ccttgacctgtgggaaatccttccgcaatttacacataggggaaaaattcccaactggtaaagaaaaaaggcaataagtgactggttgtcttacctttaaaatgccccataattcttaataccatatgggctaccaccaaatttaaactggagagagtttactagagcatgtttgtatctaaaataatgatctagtaggagaatcaggcattgatgatgtagaaagagaagagttagggaaaagagaaagacccttagagccttaacagataaggggtgatggacatcatacatagatcccacanagtagagaaggcatgtacatagataatattgggttgtatccctgtatacagaaagaactcactctttgttaaacagccctgaagccgtaataaacctttatcaaggactaagtcaccaataaatctccaatatctaaaggtacagatcacatggtaatccaaccagaatcagtatgaaaagacagccaactccatctaattacatggacattataaaacagttttctaaacaactcttggattaaagtggaaatcagtactagaacacagactgtttgaaattacccatgaaccacactccatttcaaagcttatgggatacaacccaagtcttaactcaaaggaaaattcagagctttcagtgatcttcttaatatatacggaagattgaaagtaaatgatctaagcacccagttcaagaaagtttaaaaaaattaaa

SEQ ID NO: 706984 - DNA, 141 bp, Homo sapiens
ttacctcctcctccaccctacctacttcccctacctcatcctctctctacttcctacttgtagagcacaggcatcttggctcgtgcctgagggaaggaggcggcgtgattaatgagtacaaaaatatcgctggatggaatg

SEQ ID NO: 706985 - DNA, 1300 bp, Homo sapiens
ggtcctcacgttggtgccgcggcgtctgatcctcgtggatatgctgaagtcgatctagggacggaatacagtccggcggtgagcgtgctactctctagctgctcggaagcgcctgtcgccagttcttgctcttccgtgctcgtcaactgcgtccggagaactactctatgcgtcgagactgttgtccctggcatatcagggaatacctgtcagacacacggattcatggtaggcttacgcatccctttcttgaaagatcaacccactgaagctggccatgattcggcacgttccattacttactaccgaccggtgtggggacacgccaggttaaaccagacgctggctacaatattctgtatccttgccacggacgctgacgtaactacgctaacctgctccttctggaggcttgccttattctctcctgaggccgacgcaatgatgttgaggctctctgggaaggcagatttcacctcggacaggcgtctctcggcagtaaactagcgcctcgacgtggaggaattccgccggagggctcacggatccgattgtcccgtgcatagcaatggcgaaacatccatccgatgggccgcgttcagaacgccatctccatgtaccaggcaagacttcccaaagaaatgccccgactggggacgaattggaggcgtggggtcacatacaacgcccgcaaggagcggcctgaatgggacataggctggcactatatgggttccccttggggaaggaggaatggtgtctgaaaacccatgggtacccctaatcttcgggcaatccttctcttttgaccccgtggcgggatcttctcgggcccgacaaaccgcggaccccagcggttccttcgtgatggaaccgtattccatgggaagaatctccgatcgttccataggaagttgaacgtgcaaaggtgtggaaacgcctttgttgagagttacagggttggagggtggacgcgatctgtggagaaaagccttccgaatgggggtgtggttgggggggcacagtggacgggctttgtgcgttggaggcggaagctaatcctccggaacaaagaaacgcgtttcaggctccgtccaacggcaaccgaacttaaaaggaaggcacttgctttgacgccccgatgggggaacctttcttggagacgcggccccctttggacggaagcctaattaaggggagttgctgtggccataaggctgtttttcacattctacgggcaatttggaaaggcatgtctgttacactattcgtatacgctagtgcttggggcacacattgg

SEQ ID NO: 706986 - DNA, 588 bp, Homo sapiens
taggaatctgtacctcgggatcacgtggctttgtgtaccaggcgtccagggagcaattaggagggcaatctgttaagtcttttgcctcagggcagagccattaggtgtgctgtgtatgtgcctcaaggggtgtaaataactaagctattcatgtactcatcagtttcctttcaaggcatctgtgaaacctttaatctgtggaagaatcagagaaagttgacctattgtattattatcctccctcacctgaatattttgataaagtatattttagaatttacagattggacattaagcacatgaactttaaattccactttccattttgatgtgaatgttctaaaagttccctatgatttaaatgtaagcagatctttaatgtctacagaagagatttttttttttttgttgatttattatctttcggagtgaataaattccatttactgatggctgagatttctcactgtcatactacagaaatgagcagcattccagtttgtttcctatattaattttggggcattattgaaaagaaataatcattcgtttccctttctaccattgcgcataaatgccatttaaatg

SEQ ID NO: 706987 - DNA, 461 bp, Homo sapiens
  misc_feature (110)..(110): n is a, c, g, or t
  misc_feature (117)..(117): n is a, c, g, or t
gccgtggcggtgaccggagcatgccgcccgacatgaactcgctggaacaagcggaagatctcaaggctttcgaaagaagacttactgaatatattcattgcttgcaaccntgccacntggacgttggagaatgcttcttatagtggtgtctgtctgtacagctactggtgcctggaactggctaatagatcctgagacacaaaaggtgtccttcttcacgtcattatggaaccatccgtttttcactattagctgtataactctaataggcttgttctttgctggaatacacaaaagagtagtccgcaccatcaattatagctgctcgatgtcgaacggtattagcagaatacaatatgtcctgtgatgatacaggaaagctaattttgaaacctagacctcatgttcaatgacagtccgcactgttgctagagaacctaaaccagtcttttctcaagtga

SEQ ID NO: 706988 - DNA, 1110 bp, Homo sapiens
  misc_feature (825)..(825): n is a, c, g, or t
ccacttattatttttttttctctttttgtgttttctgttgtggttgtattgtgtggttggttgtgtttgttgttgttttgtcgtatatgcttgtgtccacacaccgcacgcggggcggctcgcgagaggagaaagagagagggcgcaggaatgcagcgctcactatcttatgtaacctgctgtcgttctttcgcctcgccgctgtttttcttcgtcgccgcaggttgtcttacatattcattatctgttgggccttacacagtaggctctgtctcctctctctccaaggtgacaccctggtcccttttcgggctcccagaggactgccctttgttcccacagcaggacccccaagggggacccccgccgccagatggcgttccctggtccaagtggccactcccaggcctcgatccggtcaagccaagtcgccttggactggcgtgtccccactctaaagactggcccctaccccgtccgccctgcccccgagttgctcttcagtattcacggagacctgtgggaacgaggctttttcctccatgcggctggcaaattcggaggtgacttcctggtctatcctggggaccccctccgcttccaccccccttatatcgctccgtgctgggcccctgaggacaccactcccccgtcccagaacctggttgcttcgtgggcgcccctggagaccacgcgttacgaaagagccctcgctcctctggtctccgccacgcccgatggtaaaggtggtctacaccctcccctgccatgggccagcctgcaatggaactcacgagacctaggggatgtggctgtgtcggcacncagagcccttttggatgttccccagctcttctctgggaggtctaggacatcctcctacccttctccccgggtagtttttgattcacggtgtttcgaacaactaacatcttttttaatgtttttccttgtttccaaagcaacttattggctgtgtttttgtaggtacctaatttcaccctgtgagctttcccgagaatggggcctgggtttgattcatctgtttttctaaccgggtttaaatctcacggaggtttccataaaccttggtaaattaaaatgttccta

SEQ ID NO: 706989 - DNA, 2126 bp, Homo sapiens
  misc_feature (485)..(485): n is a, c, g, or t
  misc_feature (543)..(543): n is a, c, g, or t
cggacgcgtgggtcgacccacgcgtccgagcacgttgattttttacaaatgtaagtgtgcttgggaattcccttaaattttgtgcaataaactattttttggataaagcaacaaaaaaaaaaaacaaaaaaacaaaaacataaacaaagagagagagagagacagacaaacaaaaaaaataatacccacacagagagagagccccaatatgttctcacacagaagacaccacaagatatataatgtgagacacgcaaaaggagcgagggcccaattatgggaggcgacgccaggagtctgaaaagaggcagacagcacgagcaggcacgcgacgaactcgtccaaacaagcccggcgcgcagcaccgcgtgggacacacacaccggggcgcagacccaccggggcagcatacatcacgcgcagcaagaagacgaaccacccggcaacaacaactacaccagacgagtggcgcagtcgcacacaancccaaccacataaccgtgctcgcggcagcgacacgaagagagaaaacacgacagcagncaatcacagcgaacgcagagaactctcaaaaacagcacgccgcccctcacacacagacagcgccaccaaacaaaacaatgctgctcacgacagaacccccgtccacaccagacaggacgtgtaacacacaaacagagaggagagcctaacacacaaccccagcacagagaacgacaacaaacagtatacgtggactagaacaggacagaagcgtcacgagagggaacaaagaaattcacactcacgcagccgacgaagcaaagcaagagaagaaagcaaaaagaacacacccagagacagcgcacacagagacaacgacatgtacaacatagatacgacagacacacgcacgaggcacgaaacgccaaaacagagcgaaagcacaacaaagagaacaacaacaaaccacagaacgacgcaaacacgacgcggcaggaaacaccgctagaaccccacgcagcagcgacacaccacaccgacacggtaagcgaggaaagcgagccgggagagcggagcgagaaaagctgacagcgacggagatcagacagcgaggaagaggaggcagaggtacggaggaagagagaaagagagggagacagacgacgagcgggagagcggggagaggagggagagcgagagaggcagcggcgaagcgagcggagcggccagagagagcgagacgggagaagagcgacaacggagcggagaggggcaggagaggcgtggagtagacgagatagaggaagcgaggggaggagggaagcaggggggcgggaggcaggagccggcgagggcgacgagagaggggaccgagagaagggacagaagaggcgtggacagagggagcgtgtgggagcagcgcgagtcggaggagaggagcacacacaagggacaggaggaacaggaacacgagacagaggcaagtgaaggcagagcaaaacgagcgggaggcagcaggacagaggcagcagggcatgccaacgcaggagaaccataggaagacgaggagaaagagaaggacgcaaaagggaagggcagacgaagccagagcaagcgacggagagagaggcgagcagggaggggacacgacaggaggaagaaggacagcgacgtcaggagacagaatcgcagacaaggcggaacggaccggaagaccggagcgagacagagcacagagacacaggcataatgagagacagcgtagggaagtgacaggaatgtagacaagagagcacggtacagcgtaggcggagacgcgagacccagcggacggagatgcacaagcagatgaaacagggagcgcgacaacgagaacacagagacgcagatgacgaaagaacgagcacagatcgagtgagacagggagcagacgaagacgacgagtacggactaacgaagaacgaacgaagactggagactacacggatgagacaggtagagccgagtaagccggaacaacagaggagaacagtgagagacgcggacgagagaggtgaaacgcaacgcggaagagagacgagcagaccagctacaagcgaagagacgaaacagcagagaacaaagtgaacgaagggaacagacgt

SEQ ID NO: 706990 - DNA, 1346 bp, Homo sapiens
gcaggaatgggaggcatccaaaacgagaaggagaccatgcaaagcctgatacgaccgcctggcctcttagctggactgagtgaggaggcctggagaccgagaaaccggaggtcgtggcgagcaaaactccgtggcagactacattggtaccaagaagggacgcccgatggtcattacgtaggctttggcagccattcactcttccaatcatccacttccgtatggtaccttgcagtgcgcctcataactcattcgggcgaaaactacgtgtgggcatccaagtgcaccgcagtcgtatcgtgccacgtattgacgatatgcccgctcattgtcgtgctgacttcgacattgtgatgacagttcgacaagctattgtagacggagaccttgggtcgctaatgcctgcctaggatcctgtgtgatgaagcagaatctactcccatggggtcttctcgggcattaggggtcaatatagagttgagcaatcgcgaagtaatcagcaatcggacgttgcgaggcgttggaggtaacgagtaggaatccgagggcgtcgtcaaaaggggagggaagcgttgctcgttgcattgcagacgaaagaaaaccgagctgagcaggagggaaaggtagaacagggcccttacagagcccgcaagaattgccccaagctcgtgggtttggaccccgtgagaagggatcaggattgccaccgcaagatctcgagtgacccctctgcccaaacagaatacatttgagcacagaacaatacccagtgagccccaaaattattgaacagaaggcctgggctctgcgaaacgacaaccctgtaggaccgtgatgccttatggaccaatgtgtcacttggtgttcttcaaggccgagggaattctaggaagggacggagggcaacccactaagagtgggtacaacgacgaccagtcaggggttcgttgcatcgcaggggttttggagaacagcctttggcgtcgaaggaccgaaacaggcttcaaacaatggaaggcttcgaaaggagacgggtaacaaggatccgcaagggttaccctttgaggaaaggaagtcacgaagaccctgtgcaccattcccaattcgacgaacacaatttctttgaacagggggacccaaagacttttggtgaaggaaaaccatggacctttggacgggcgcaacgttaggagagaggcccagggcatctaacagcacccgctttcagcaagacattctggaaaggcacacagacgttcaaacgacggggaagttcccttttagctttgcacagcccttttggaacgttcagcaaaaagacctttggggaaacaaagagaacaccg

SEQ ID NO: 706991 - DNA, 224 bp, Homo sapiens
gtagtggctcaagagtggctgactcccttcttccaaatcagcccatcatagaacacctattgctgaatattatatgccataggcttacactggatccctcataattggagactttaaagtgttcaaaacttcaagcctggcctttgaagtaaaatccttttttttttttaagtacaattgcaatctttaaatatttctccataggctaatatttattcaatcct

SEQ ID NO: 706992 - DNA, 115 bp, Homo sapiens
ctcgctcttcagtctcaatgttggtcagacagcaggcttgctgggtttcagatacatttcttaggtcttccaggtcttggagtagctgcgtctctcgcctaagttcagagccagg

SEQ ID NO: 706993 - DNA, 700 bp, Homo sapiens
  misc_feature (10)..(10): n is a, c, g, or t
  misc_feature (12)..(13): n is a, c, g, or t
  misc_feature (260)..(260): n is a, c, g, or t
  misc_feature (265)..(265): n is a, c, g, or t
  misc_feature (299)..(299): n is a, c, g, or t
  misc_feature (320)..(320): n is a, c, g, or t
  misc_feature (406)..(406): n is a, c, g, or t
  misc_feature (433)..(433): n is a, c, g, or t
  misc_feature (540)..(540): n is a, c, g, or t
  misc_feature (549)..(549): n is a, c, g, or t
  misc_feature (557)..(557): n is a, c, g, or t
  misc_feature (641)..(641): n is a, c, g, or t
  misc_feature (651)..(651): n is a, c, g, or t
  misc_feature (669)..(669): n is a, c, g, or t
  misc_feature (683)..(683): n is a, c, g, or t
gcacttgcananngcggcctctttgggacggggatggtttgaggaaacacttttaaagaaaaaaggaagacattgaaaggttttagtttcttccctatctgcatgtcatctcatatagaaagcccagaattaggggctagaactccaggagagggtctcccgactcatctcttgctgacggtcaccaggatgcagaaatagggagatggttagtgggggccaaaagatgccccctcccaaggcttcgtggttccctcctnccgcnccctggaatctttggaggagtcagtgcctcactncagcaagtgagtgcctactgnatgcaggtagtcagccaaggcaaaagagagactaaccggtctcatgggggaacctcttgcgggaggccaggtagctgggagcgaanggttcccggcttgccctttgcttgctnggttggaattggaagagggagacttcttttttgttggtttttaattttaaaaacacaaagggcctaaaagaaatacgtatcttataaattttttttaattttttgangacgttcanttaaatgnattgtgcacgaatgaattctatatatataaaatatacatatatagctctataatttgggggaggggcactgtctcttttttccnctcatttttnaaattgaagtgttgttgncctttgtatgtggntcaaccatccagctccc

SEQ ID NO: 706994 - DNA, 316 bp, Homo sapiens
  misc_feature (19)..(20): n is a, c, g, or t
  misc_feature (36)..(36): n is a, c, g, or t
cccgccttttttacaaaanngggccccccctggggngggaaaattgggggttttttttttgggggggggttccccccccccgggcccccccaattcccgggggggggttgggggaaattctttttttggcttttaaacttttttttttggcccgggaaagggccccccctttttcccccggggtttttttttttaaaaaaaggggttttttttttcggggtttttaaaaaccctggggttccccccgggggggattggggttttttccccccaggggcccccccctgaaaaaaaaagttttttttttcccccccca

SEQ ID NO: 706995 - DNA, 277 bp, Homo sapiens
ctcctacaagcatctgcactctaggtatcagtactggagagtctcacccatggaccccacgcagcacgccacgtactccctcccaccccgagatcaagacacggaaaccactgccgatgggtgcaacgcactgcgcccgttttctagagccttccccgtccatctacaggcaggatgcggctgggaaaaagacaactgccaattctcgaaggctgatggtccgcacggatgatgaatctaccagaatctgttggctcccaagttgcgcgggataaga

SEQ ID NO: 706996 - DNA, 253 bp, Homo sapiens
gaaaagcgtcaggaatcagaaagcttattatcctagtgagacccaaggttccatttgctacagaagcctatgaaataattcctaggacaaagggtcactaagaagtcattcatcttttgggtaatagttgaaggagtcagaaaacagtcacaccagtagtttagggaaggattatagctgattgcgttatttttttttttttttttttgggggggaaggggggggggcccagagaggggaatttttttttttt

SEQ ID NO: 706997 - DNA, 535 bp, Homo sapiens
acgccgaccgcgctgtcaaaaggatttggattcctatcttaaaactacgatcgccagtcacttacctagtctgatctgcgcagcacctacgaggtatccaatgaacctgggaatcgctaccactctccagctacatcaatgccctggtgctctatgtcgggactcaggccattgggcacatcctaccacaagggccgcgcattttcaatgagcaccatcactccactcaggacacatgggataatcttcccagaattggggttgtggcactgggcctgccagcgggtcgatatctctatttatgaaggccaattgaaaatcagctccggtccccgaaatagccgacacttgcatacttcagtagcaccaggctgtaccttatattgcagagggcaaatacgggaagccaatacagagcacagatcacaagaagttctctgtgggcccgggtcgccttgtaacatgggccacatcctgggcggtacgaccataataacgcttcattgcgctgtttaaagacccagcgtttagtttc

SEQ ID NO: 706998 - DNA, 388 bp, Homo sapiens
atgtgtgggtgattagaggattccaaacgcagagaggaagtagttatacgtttccggtcaaccgatcaagcacgttactccggcacctcgagttcttggcacacgttcagctcgagtgatgctccccgggctccgatccagcaaagcttcggggaggagttccgtcagcacgacggcatggtgacgatcttgatgttcaaccgtcgcagggcttcgcctaagcaccgttacaatatgaccgaggtgtaatatcgtggaggggggcccgcacatggctaaggaacaatcacgaagatcaacttgtgtgtctatggggtgccccctacccccgtatacaaaggagtggaggaggggagggtcggccctctctatgtcctctctgcgtttg

SEQ ID NO: 706999 - DNA, 301 bp, Homo sapiens
ggcagcaggatcaggtctctctgcactctgtgctctgaggccctcagacgtttggttgccagacctctgtgcttcatgccccgccgtggttaatttttacacaccctatgcgacctttctccagatcctgtgctggcgagaccaatgatccttaaagaaggtgtggagtcttacccaaactgaggatttctgcaaggttcacaggttcaatatttcaagcttccgaagcctgtgaggttcccaatactgtcagcaacaaccttaggagaagacttaaaactatctgaatacatatgccgag

SEQ ID NO: 707000 - DNA, 929 bp, Homo sapiens
  misc_feature (438)..(438): n is a, c, g, or t
  misc_feature (515)..(515): n is a, c, g, or t
  misc_feature (547)..(547): n is a, c, g, or t
gtgaaggatactagtcagcagtattaaccaactcaacgctgaagacatggatgaaattgaaaagattgactattgaagaaagaactttattgcttgtgcacgatcctactccatgtgagaatgactcaccaggttcatgaacgcaatatcttcggagccgatgctctttgagacagaaattgtcacagaaggcgccattacgtgtcgcggtagctaggctctctgacacgaggacttacataaaacctaatcacataagcgcctctgtcaaccttctctcctttccccgtcccgcctgtctaacttccacaccaccctagaaccatcgcccactccccccttcccaccttcctgctaccccctcccttcattagtcctcatctccaccggctgcctccccaactttatctaatccccacccctccacacctcgcagtnccccggtacgccgcgttccttatacatccccaaaattggcgtactcgactcactctacgcccctattagtcgtcagncataccgcgatcctaatatgggacacattganatcgtgcacaggccccgacacgtaatcgtcacactcacccaccgacacgactacgcatcacttcgcgcttgtttctctcacgcctgcccctcccgcgcgcacaacacttactcagcacacctcgtttgcttacctgctatctgtgatggcgaatgatgttatctcgcatgtaacatcgctaaccacacgtcttcgccacccattgaagagatccatttctacgaagcgtaactgttttcaagccgataggcacattatcgcggacacctcggaggcgcgcactgccgccatttggtgatgagagagcagcgtctctccagctgcttgcacacctagcgaggcacctctcctctccgtgcgcgagaagtgcgctatgcccgcg

SEQ ID NO: 707001 - DNA, 996 bp, Homo sapiens
gctgtataattatatatggatatacacacatagaataaatcttagaattgtatgatatattatgcatgtctatgtgattacttacagtagttaatctcatgttgtttatgggacatttatattatttatagatttttgtatattacaaataaagctgctgtaaatacttgaaaaaaaaaaaaaaaaaaaaaaaaaaaaagaaaaaaaacaaaaactaagaaaaaagataaaaagaaaaaccacaaaacacaagagacggcggcggctctactctataaatccatgagtacgccgaaattacgcctgcctgcccagttttttaagacaacaaccacactccaagcagactggactacaatacataaccaccccccccccctacaacaaaacacagaagagcgagacaagcaacatcaacgagtacacaattacacaccaacacaaacaaccttgagggggaaccacacatagaccgcccccaccaccccccaaaaataacacacacccctcagcccaacacaacaaccatcccacgtatctacgagatccagtcgccccgccccccaccacaccgacgacagcgcaaaaaaaaggctcgacccccccccgccagctgacagacacacatacatcccccggccacaacacaaacatcacgcccccccagcaccagcaaacacacgcacgcacccagcaccaccccgcaccatccccccaaccacagacaacagccacccaccaacgcaacccacaacacaccagcacacgccagcaacacacgccaccacgaacacaccgccaaacaacaagcaacgccacacacacaccccaaaccagaccaccccgacaaccacgaaccaccaccagacccgacaccaaaccaaaagcacaccgaccgacccgcacacccgcacagaacgcccaacaacacacaaaacacgaccacaagcacgcgcacccaagccacccaccacccacaaacacacccagcaccca

SEQ ID NO: 707002 - DNA, 406 bp, Homo sapiens
  misc_feature (9)..(9): n is a, c, g, or t
  misc_feature (52)..(52): n is a, c, g, or t
acctcgggngagccctagtcacaccgagactagggggagggctgttttaatngtgggtttggccgactgacgactggagtgccctcctcggctgtcttagttgtagtcggaggtcatgtaaatcgaccttaaaagaatgcataagccataaattaaaataaaccctcatccaagggctgatccatacgtagacaatatccaacctggacaaaacgggcttcccttgcgagccgacctaaaccgcatcccccaaagaatagagactaaatgcaaagtaagtttcctagcaaatattttgttttcttgaaaagtgttgggttgattcgctgtgtgactgagacgccacagtgttcggagcgcttcagtgtcacccaggctctgggtgcgggaggtgggaggagaggaa

SEQ ID NO: 707003 - DNA, 238 bp, Homo sapiens
cacgccagataggcctatatctggctgtatgtctcttctgactagtgtgtactaagacagtgttgtgggtgttggtactaacactggctcgtgtgacaaggccatgaggctggtgtataatgcggccttgagagtgtgtattcaagtcggcgcacagtcaggtctgaacaggactccccatcccaaggaccccagacacactataggccgtgttctatagcagcttactgcagtgtcc

SEQ ID NO: 707004 - DNA, 126 bp, Homo sapiens
  misc_feature (18)..(18): n is a, c, g, or t
  misc_feature (99)..(99): n is a, c, g, or t
ctcacccaccacatcccnaacacaaaaccctcattcacccgacaaaacaccctcatgttcatacacctagcccccattctcctcctatccctcaacccncccccctgataccgggttttcctctta

SEQ ID NO: 707005 - DNA, 355 bp, Homo sapiens
ttctgcacgatccccggccgcacagcttctcaatatcatgaacaatttattaaatattactgctgttagataattgaattactcctacatgatgtattggtatatttcatgtggttgttttgcatcggtggtagtccgacgttacgtcggtgtgcattccgtgtataggccgagcaaagtgttgtgggaagtaaacttagatttactgccgactcatattttatatcgaacatggattttggctgtatgttctcggtctagcgtgtgtagcctgtagtaatagggtgaaatcagcttaattacagcccccctatgattgcataatacagcctcctattgtattggacatatttgg

SEQ ID NO: 707006 - DNA, 451 bp, Homo sapiens
ggggtgcagggtactgggtatacgagtaaatactggagactcgtggtcactggataaatttcctttggggactaggtcgcacagttttggaaacaattttaaaccctcccccttcacacacatacttatcaggtggtttcctagttaaaaacccaagtagctcagatcctacttttaaggtcggtgcagatttggcattggaatcaggccagtatgtttttcctcattttaaggcggtggggctctagttttaaagtggatataaagaactcagcaagggtttaatttcctactcatacttggggtgtgggaaacactaccactagttatcattaatcacctccaagggtctccggaaacaaaaagggtacctttccattaggggataatggggagtgatagtagtggtgcccagaaaacacttcctcacaatggtgcttcccaatcacca

SEQ ID NO: 707007 - DNA, 258 bp, Homo sapiens
  misc_feature (16)..(16): n is a, c, g, or t
acctcctaccccacgnttgcagctgcagctgccacaagtttaccttgcctctgttgactgctccagctatagggttttcctctaaaaagaaccagctgtattggatcagagctgctactgtgcatctcaccccctgtgcctgaggaacagagggagccagccattgccagagaaagagtccaaccatcaagaggtgcatttaagccaggtgaggtgtcttcctgccagcacaatcccagcactttgtgaaatcaaggc

SEQ ID NO: 707008 - DNA, 182 bp, Homo sapiens
gtccatcaggtattctatacattgaactttgttgtgatcaagaacagcagtccaagacgtgtcacacaatgagctggtttgatgggaactgatgggagcaagactggccatcttctcccatcagcattactaataagtggctcctttaacctctccacccttatcacagcacaagaacacct

SEQ ID NO: 707009 - DNA, 155 bp, Homo sapiens
atgctggtgcttgtcatcccagctactcgggaggctgaggcaagaggattgcttgagcccaggagtcaagaccagcctaggaaacacatcatgaccccatcctgaaaacagaaaggtgctagcagatggaatgctatctcttctgcattatcttc

SEQ ID NO: 707010 - DNA, 141 bp, Homo sapiens
  misc_feature (42)..(42): n is a, c, g, or t
ttatgtgagtttgggatagggtcggttagggtcccgtgggtngggcgtttcctctaattagtggtttctcatctgtttgtgaggagctagctaaaaaggattgggaagctgagaaagaaaagcttcatcagttcatatatt

SEQ ID NO: 707011 - DNA, 504 bp, Homo sapiens
tgccacccaggcgggagtgcagtggcacaatctcggcctactgcaacctgtgcctccggggttcaagcgattcttctgcctcagcctcccaaacagccgggactataggcatgcaccaccataccgggctaattttggtatttttagtagagatggggttcaccaaatcggccaggtatggtggcatcggtaaacagcggtgtttgtcgatgccaccgtctcaaactaacaggcttagtgatgtaataatggttagcagaggtacacttgtgaataaagagggtgggggggtatagatgtcgcgagcagcaacacaaagctttggcatatggcatactattaaacatgctgtacatacttttggggttcatgtggaacggaatgcacagatgaaggtcggtagggtgtactgttgaagagtttggttataaaactttggggaaaagaataaaccaagaatggattgggcccatcatttcaagaagtcccctctcctccacattt

SEQ ID NO: 707012 - DNA, 472 bp, Homo sapiens
ctagcctgtcccttatttctggaggcatgtcactggacacaaatcaaccatcacagtctagcgtgtcatgtggccaccatataaatttcttaaactgtacttaaacttcagataaaaacaataggatacctgggccaggttgcagagtggagaaatggataattattgtttaatgattaaagtttctgtttgggataatgaaaaagttttggaaatagtttgtggttatggttgcacaacactaagttattgccactgaatggtacacttaaaagtggtcagaatgataactgttttgtattatatgttttactacaattattaaaaaactaataatgtaatataccaaaaaccattgaactttaaataggtgaattatgtggtgtgtgaatcatatatgaagttgttttccattcagagaaatattagaatacaaagttgaagaagtctcccagaagtagaacaacaacag

SEQ ID NO: 707013 - DNA, 330 bp, Homo sapiens
gacacacctaggctgagaactatagtctatctccagggtcagcagcaacagaagtccccctgaaaaatactggccccaatcgctgcagactgacaacttaaaaggaactggttgaagaccaagacgagtttcctaaactggggcaagcggccccttcctggccaacaaaccgaggggcaaaggggcagggaccacagcagcagcagcaattccagaacttttcagtctcctccccttaggaaaacctaaagcccaaaaacaaacagaattcctaccaatgctggcccccttggaagggcagtctttttggcccctggcagcccctcatcc

SEQ ID NO: 707014 - DNA, 213 bp, Homo sapiens
  misc_feature (19)..(19): n is a, c, g, or t
  misc_feature (70)..(70): n is a, c, g, or t
tttagcaagtaccaatttnatggaccaagtattcacaataaattttatatcaccacaaaaaaacatcttnacctttgaaattgagaagaaaccgtggggagcataccttgtggagcatctctggtgtactagtgattagtattttggcttttgctcaccccacactccacttctcctctctcaatgatgcactaatcttcttccactgcgatc

SEQ ID NO: 707015 - DNA, 327 bp, Homo sapiens
ctgccttctgccttctgcctctcctctcctctcctctccctcaattctgcagcgttcttcagctttctcttagggttgagtatgcacaccccgctgtgcatacctgcaggtgccttgggtacacatgtgctcgtgttttgtgtgtgcacccctgcatgcatgtggattggtgtgcatgcacgcatggtgcttctgcgtgcaaatgtgcgtgtgttctctgtgtgcacatgcagatggaccagtgtgcatgcatgcatgcatacagtcatgcacggtgccttgtgtgcacacatgcatgccttttccgcgcgatcgcgcggtcgacgc

SEQ ID NO: 707016 - DNA, 332 bp, Homo sapiens
  misc_feature (14)..(14): n is a, c, g, or t
  misc_feature (83)..(83): n is a, c, g, or t
  misc_feature (113)..(113): n is a, c, g, or t
  misc_feature (123)..(123): n is a, c, g, or t
  misc_feature (131)..(131): n is a, c, g, or t
  misc_feature (133)..(133): n is a, c, g, or t
  misc_feature (143)..(143): n is a, c, g, or t
  misc_feature (151)..(151): n is a, c, g, or t
  misc_feature (159)..(159): n is a, c, g, or t
  misc_feature (193)..(193): n is a, c, g, or t
  misc_feature (197)..(197): n is a, c, g, or t
  misc_feature (205)..(205): n is a, c, g, or t
  misc_feature (208)..(208): n is a, c, g, or t
  misc_feature (236)..(236): n is a, c, g, or t
  misc_feature (247)..(247): n is a, c, g, or t
  misc_feature (253)..(253): n is a, c, g, or t
  misc_feature (280)..(280): n is a, c, g, or t
  misc_feature (285)..(285): n is a, c, g, or t
  misc_feature (294)..(294): n is a, c, g, or t
  misc_feature (316)..(316): n is a, c, g, or t
tacagattgctgtngcctttttcccctacattttttaaatgttctcatggttacaatatccagcataaagaggttgttcagcnattccacgttcgaacataaagcagacgagngccattatcngtatatantngaaataatanatatatangaaatctntaggaacaacagaagtttataaacaacagcaatngccngaggaaanaancttggagtaaagagttagttgcatccanatattctcccnaaaganaagcttctacaccaatgaaaagttgtntctgnatatgagtnccgaaaaaatcaagaggttccnctttatagtatttcct

SEQ ID NO: 707017 - DNA, 277 bp, Homo sapiens
gctgctgggagcacaggaaggacaagtggccaacccagcagggatccaggatggctaaaggaagaggggagcaagtccactaggtgataacagccagaaatgtactggggaaaatgggtcaaggaagaatactctcagtccagggaacagcatcatggcttatttttatcccctttggacctcagtacaagagtaatacttactttgcaggaaagttatgagcaatgcattagtagagcaaagtcatgagcgatgcatctataaagaaggagaatga

SEQ ID NO: 707018 - DNA, 107 bp, Homo sapiens
caaagaactgtacagtcattatattcttcctgagaataatttatattcccccaaaaactaaagggagggtatattttttcaaaattaaccgaatgggtggtatagct

SEQ ID NO: 707019 - DNA, 411 bp, Homo sapiens
gctccttattataatgctaattattgctatagggtatgatatccctggtatattcgctcttgaaatccttataaaaggacgtactaggcataatactaatcgcactgggataatactaatcagaattggaccatgtattaagcttagaagtgagcgaactagacgaggcgggcgctatggggagtggatgtcttggaggcgatgcgcgccgcgcggcgcggcccggaccgcgcgcacttttattttatgattgattattatgataaacctggaagacctgagatggattgctttatgatgccattttatatgggggacgactgggaggagggagcgcttgagctttgcccgacggcccaggcacggggccggagggcggccctgcttgccaacaaaccgctaagccttcgc

SEQ ID NO: 707020 - DNA, 247 bp, Homo sapiens
gtgtctactaataaaaaaaaaaaaaaaaaaaaaattttggggggccgggggggggttttaaaccccccctttttggagggttgacaaaaaaaatcctttaacccgggggggggggggttccaaagacctgacttaaaattccccctttgtcttcaaccgggggaaaaaaagggaattttttttaaaaaaaaaaggggggaaaaaaagaaaggaattttttccttttcaaaaaatttttggggggaaa

SEQ ID NO: 707021 - DNA, 236 bp, Homo sapiens
aaggccggcgacgttttctcgtaaatggattccaattccgacggcagcatcagcctggacgagatgtcgaaggcgctgaagagcggctgtcacggtcaccacgcgcaaggcgccagcggttcgggcgatggatcggattccttgttgtcgtcgagcggcgggtggacctcgaccacgacgaccgccgccgacggctcgaccaccaccaccgtcacctatgccgacggcttcaagat

SEQ ID NO: 707022 - DNA, 122 bp, Homo sapiens
tacgaatcgagctcgtaccttgagatcagtaggcggactcacgtagcgtagcacctcctcgcctcctcttcttccttcacgcagccaacacacatacccccagcaggcgtgaccgctccgcg

SEQ ID NO: 707023 - DNA, 180 bp, Homo sapiens
ccgtaagctggagaagagaaatgaagggtttccccacgcccagcgaactcttgggttcagctgtggcccatttactcaaggtcttgatgcatacagacttcaggtccccaatgtctgccttcagtctaacaccatcgttcaggtgttgtcctggtggtgatcctctcatttctgaatccc

SEQ ID NO: 707024 - DNA, 733 bp, Homo sapiens
  misc_feature (32)..(32): n is a, c, g, or t
  misc_feature (136)..(136): n is a, c, g, or t
  misc_feature (211)..(212): n is a, c, g, or t
  misc_feature (243)..(243): n is a, c, g, or t
  misc_feature (259)..(261): n is a, c, g, or t
  misc_feature (271)..(271): n is a, c, g, or t
  misc_feature (285)..(285): n is a, c, g, or t
  misc_feature (298)..(298): n is a, c, g, or t
  misc_feature (346)..(346): n is a, c, g, or t
  misc_feature (355)..(355): n is a, c, g, or t
  misc_feature (358)..(358): n is a, c, g, or t
  misc_feature (361)..(361): n is a, c, g, or t
  misc_feature (364)..(364): n is a, c, g, or t
  misc_feature (367)..(368): n is a, c, g, or t
  misc_feature (373)..(373): n is a, c, g, or t
  misc_feature (376)..(377): n is a, c, g, or t
  misc_feature (379)..(380): n is a, c, g, or t
  misc_feature (385)..(385): n is a, c, g, or t
  misc_feature (388)..(388): n is a, c, g, or t
  misc_feature (392)..(392): n is a, c, g, or t
  misc_feature (394)..(394): n is a, c, g, or t
  misc_feature (410)..(410): n is a, c, g, or t
  misc_feature (412)..(412): n is a, c, g, or t
  misc_feature (415)..(415): n is a, c, g, or t
  misc_feature (430)..(430): n is a, c, g, or t
  misc_feature (443)..(443): n is a, c, g, or t
  misc_feature (461)..(461): n is a, c, g, or t
  misc_feature (548)..(548): n is a, c, g, or t
  misc_feature (623)..(623): n is a, c, g, or t
  misc_feature (707)..(707): n is a, c, g, or t
ttctgccgctaggaggaggttgactaattggngggactagggcggggtgagacattatagtgttgcagttaaagaacatgggctctagatttagacagacttgcatttgactccaaatactagaacttaatagccncgaaactttggataagttaaactaattcctcaaacctgtttattttaaatctgtaaaatggttctggaaataaannttacttctcaagagtggtttttataattaantgggataaagtataannngtagttatcncagtacccaaagcnaaatacatttgtnataaataattggcttcaattactgttcttaccctaattcttgtcaganacctctttntcntcnttnctnnttctngtnntnntgccnacntctncnattgccgctgctactncnacnactattgccattccngcgggggtatggnggggggggggaatcagtnagcctgacatcagttatactttgaaaaggaaaatagcacagctggacagttaaacggcagagagaagagccaacagtaaattcttgntatgatccagccaagagatgtggagagctttagaacaatggctgtgataatgaaaaaaaaaaaaaaaaaagtaanccgggggcgggatagtgaatagcaattactttcctagagcgtcctttaaaaataataacaaacaagctacctagaattcacttnatgtctttttaaccacaaccattcta

SEQ ID NO: 707025 - DNA, 527 bp, Homo sapiens
cagaggatctcacgagtgcaacacacagaagacacatatcaaaaggagtgtcgtgtgtgtggataccaccagcgctgtcacactgcccatatctcaatgacttttaaaacaaaaaaagcgaaacggtggccagaggctgctcctttgttattccatgctttctaaatccaagtcgaatgactgctttggtcacacttttttagtcacagtaaaaaatcacgggcgccctctggcatgcatgacatgcgataatcagaaaaggtaccactcccgtgtatctagtttctgaatatgtctgttcacggaccacaagggcatgggtcaccaatccgaagtggatgggactaaaccattgcgccttagaggccctcaattcaactacgaaccctttaacagcaacagcattaatatacgcttttggagctggaattaccgcgggtgctggcaccagacttgtcctccaattgttactcgattttggatgggtttaaatatcccccattgaaaacgacaatgcaaaagcactg

SEQ ID NO: 707026 - DNA, 216 bp, Homo sapiens
ggaggggggcccctgattttgtttccccctgtagcagcattttttaaaaaacatagggttataaacaatgctttttttctgtatatttttttttttgggtgccccccttttttccgcccccaaatttttaaataattaaagtgccctgcagttagggttaaaaaaaagttaaaatattttttttttccataataaaattttggttttattttttta

SEQ ID NO: 707027 - DNA, 428 bp, Homo sapiens
  misc_feature (198)..(198): n is a, c, g, or t
  misc_feature (204)..(204): n is a, c, g, or t
  misc_feature (212)..(212): n is a, c, g, or t
  misc_feature (237)..(237): n is a, c, g, or t
  misc_feature (268)..(268): n is a, c, g, or t
  misc_feature (271)..(271): n is a, c, g, or t
  misc_feature (297)..(297): n is a, c, g, or t
  misc_feature (299)..(299): n is a, c, g, or t
  misc_feature (327)..(327): n is a, c, g, or t
  misc_feature (330)..(330): n is a, c, g, or t
  misc_feature (353)..(353): n is a, c, g, or t
  misc_feature (378)..(378): n is a, c, g, or t
  misc_feature (381)..(381): n is a, c, g, or t
  misc_feature (394)..(394): n is a, c, g, or t
  misc_feature (402)..(402): n is a, c, g, or t
  misc_feature (422)..(422): n is a, c, g, or t
catgcatgtagtccactccagaaatcatgctcgcttcccttggcacaccagtgttttcctgccaaatgaccctaaaccctttgtcctgcagagtcagggtggcttttcccctgactgtgtccgatgccaaggagtcctggcctccgcagatgcttcattttgacccttggtgcagtggaagtcagcacaaaacagtgncctggntgtgtccntggacgggtggacttagctaggganaaagttgaggcagcagccctcgaggccctcncanatgtttaggcaggcctcattttatcncncagcatgtgcaggcctggaaaagcaaanccnaatttcagggaagtccttggttnatgtatttgggtttcctttggagcnctntgccctcctgtcncccagtanagtaaataaacttccttggntcctga

SEQ ID NO: 707028 - DNA, 648 bp, Homo sapiens
tggaactttaaatccccccaaaaattgttttttatccagttaattttggatcccaaggggtttttgggaagaatttttggtacaagcgggggcccaggcttcaaaattttgggagacctccgaaagccagaacagagtgtgtatatataccagaaagaggcaccgggtaaaaacgggcgaatttgagagaactatgtctttaaagcacctccttcttatgaagaacgccctcaatcaacaaatattttccttgggataattaggcgcacaccagggggtttggagaaatttgagcctagccgaggatacgtataatatcttgggcactgagttagcagccacaccacccctctttaacaccggagaaccagcggatcgttcttcgattacccgcacagaggaaaaaaagatgcgcactactttttggccgggaaaaaaaaacaaacgacacatgtgagttttcccacaggcaagtcttggacaactgtgaacgcgcgatgcgccgacttctaaaaaatatcatttaccggagggggccgccctcgttcaccacatttgtgatatgaaacaccactatgtgccccgcgttatgagcaacgtggcagcacaaatgtgccgacccgtatctcttactagcggttctccgaa

SEQ ID NO: 707029 - DNA, 638 bp, Homo sapiens
  misc_feature (61)..(61): n is a, c, g, or t
  misc_feature (87)..(87): n is a, c, g, or t
  misc_feature (117)..(117): n is a, c, g, or t
  misc_feature (152)..(153): n is a, c, g, or t
ggctgcagagccaggccccatgtcggggaaagggatccaagcccggcccagggaccccatngtaggaggttcgcagctacactaagngctgtcagcttcaaagggccatggcttggnacggcggtcccactggagtgttctccgttcgacgnnggctatccacgtttccgcctcttcgccgggtgcaggcgtgagatcaatctgctgtgtacatgtgtgccgtggaccatttgttacatcccagggaggcccccgggggtcccaccttggccccccagggggcaccgtaagacatgcgatgggtttgcggatttgccagggacgacatgacatgaggccgggcatattcactgagagtgcgcaaggctggagtgtcaggacccaggtaggggggcacttgtagccaccgacttgcccggttcaacatggagggcgatggggcactgggcccagagatgggcattccaccggagcacggcctcctgagccaacttcacgctgcgttcaagctcgcgctccttctcgcgctcgcgctctttctcgcgttcccgttcgcgctcgcgctccttttcttcgcgcgctcgctgctcggctcgcgccgaccttctccaccaggtcggccgcttcttggccagttg

SEQ ID NO: 707030 - DNA, 172 bp, Homo sapiens
gagtcttacgcaatctgcaaaatcaaagccaagtatattgctgagcacggtggctcacgcctgtaatcccaacacctagggaggccgaggcaggcagatcatttgaagtcaggagcttggtaccagtccggcaaacagtgtgaaactccatccccactaaaaacacaaaaag

SEQ ID NO: 707031 - DNA, 574 bp, Homo sapiens
ccccatataaaaaaaaaggggccccgcggcggggggggccccccccccccaaaaaaaaaaaaaaaaaaccccccgtttttttttttcttcgccgccccccctctttttttaggaaaaaaaaaaaaaaagtgtcttgtttttaaataaaaaaggggggggcccccccccgggggcggggggggggggcttcttccccaccaacttttttttgtaaaggggggggggccccccccccaaaaaaagggggggcgccacacaaaaagggggggccccccccccccccccctctttataaaggaaggggggggtgtggtgggggccccccccctcccccccgccggggaataattataataaccccccccccccctatataaaaaaaaaagggcccgcaaaagaggggggggggaaaaacccccgcccccccccttttataaacagaacacaaaaggggcggttttttaaaaaaagaaccattgttccccccggtggtggacacagggggggattgggcccgaacctttttaaaaaagtaaaccggccagttaaaagccccatggacctccggaaaaga

SEQ ID NO: 707032 - DNA, 966 bp, Homo sapiens
atatagctctgttcggcagatatctcctttagatgtgtgcagcagcatgttttgctggggggcgcgcgccgctatcaaagctttgtgggaccagcggttgtttagaaagatgtgctgatcaccgcggctaatagccgcgtgtgtcattctgcccaagtggcgcggtgagggacttacacaacacacctggtggcccatacccttctgggggaaagcttcgctcgcgcacaaaattcataaggcaattttacaggtgaaaccaacagtgtggccgccgtgaattatagggcaacatatcctgcgtcgctcctggggtttatacgccccgtggggcacccaacgtgtccagagccactggcccgcacacgcggcaccaattggggggagtgcccctatataccgtgttcccctaaggagatccccttctgacaaaaggcggttgtgtagaaggaaagaactccctcctcctctcccggaagtcttttttatggaaggcgcctctccccaccgttgtttgatattttctaagagggcctccctcaagtcatcctgtgtcaaagacgcgcggaatttgctaataatgcttcgcctgaattacgccgctcgagtggcccaccaatacgcaagcttaattttgtcgagggaagaaaatatgtggggtagacaagcacacgggggtgcccacacacgccgcgcccccagatgtgggggcacacaacgccctggtgttgccccgacgccgagccgcgggctccagggggcacccaaataaccctacacaagccgcttcctggcgccagcacagtttgtcctccggcacacacgccctgtgccccaggcaactaaacatggcgtgccacccaacaccgcacgcgggtgctccctccgcaggagggtatcaccaaaggagcccgacccacacgggggtaaaaccctccttataaaaaaaaaatccgcaacatgaca

SEQ ID NO: 707033 - DNA, 191 bp, Homo sapiens
aaagaacaggatgtcttcccctgttggtgatcaaccaacacgaccgaggttggctccaccaatcaccatacacaaatggcctgtatcaaattggataaagtggattatcgtgccagtccctaaatcaatctgcacagtatcgttcaccttgtatgacaggatctgggtagcgagatggttccgagcatcat

SEQ ID NO: 707034 - DNA, 151 bp, Homo sapiens
gccaagagcaagactgaatgtatagcagagtgccttgttagagtggtaacctagtcttggaagcaattcagtggatgtctcataaagaggactagaacttaagaagcttctgtgctggctgaggtgagccctttcgggatatgtacatact

SEQ ID NO: 707035 - DNA, 250 bp, Homo sapiens
cggattttagcccgactagtggccatccccgccagttgcgtcacttgaccacccacgcactaactttacaagaccgtttcagcttgatcgttggcatgatgtgcgacaaatgggtctgcgtttggtatttggcacccaatgcctaaaaaaatcgataacgcaccgcgcgcctggttcaaacacctcttgtcggaatatcatccactcacatagctcaatttgcgcctgatattgttgtgccactctgcaa

SEQ ID NO: 707036 - DNA, 162 bp, Homo sapiens
tcttcagtgtcggcgcatgagctggatgtctaggcacagctcttagcctccattattcgagcctgacgctggcccagccaatgcgatctacagggtaacgaccacatctaccacgttatcgtcacagctcatgccttggtaataatcttcttcatagtaata

SEQ ID NO: 707037 - DNA, 149 bp, Homo sapiens
  misc_feature (34)..(34): n is a, c, g, or t
gtgaaatatgtgagggagggatttttgagttttntggagaggttagaaaaagagacgtattgctaatacccatttgaatcgtgagtcagcgttccatagcgtgttcaacattagattagttcaggtccattggatgcagatggagacaa

SEQ ID NO: 707038 - DNA, 247 bp, Homo sapiens
  misc_feature (49)..(49): n is a, c, g, or t
tgcgtccatggcgaggtgcacagactgtaagtgatagtcgcatatcctngtctataaaaaaaaaaaaagtggatcaaacatttctttaccagtggtcttttttttctaaattcagtctttctctggcttttttccccggctatggaggaagtatttggccttccctactcacggagaagtatggccttcggggtacactttctaaagcatttctgattggaatattttgggcacattcctcccaagg

SEQ ID NO: 707039 - DNA, 501 bp, Homo sapiens
  misc_feature (266)..(266): n is a, c, g, or t
  misc_feature (485)..(485): n is a, c, g, or t
  misc_feature (495)..(495): n is a, c, g, or t
attactgaattacttgttatgtagaactataaccatgggaaggtttcccttgaggaataacaaagcatgattcacagcttttctaggatgctttagactcttagtactaagtaaaattctcagttcagaatacagcccaggccaattcataattaaacctctatttgttctgatgatgcttccaaaatagaattgctaagttaaggaagtttggtatgttaatttacaccagtgatgaactcagctacgcagggcactaaccctantgttgcacacgctgggttcctgatcttggtgcgatgttttggttacatggcatctggcaggctttctgccatttgggtttcagaagaacatgaacagtatattattatagctcctttaattcttccacttttaaaaccaacatgttttttcacaagtgttggtagtgtttgtccgggtgcctcagttgtaacttgttgtataatgactgtctgtacctnatggcctccntaaatt

SEQ ID NO: 707040 - DNA, 155 bp, Homo sapiens
gggcgaattcctcctcctcctgggcgaattcctcctcctagagatatgtgtatatatcctattcatagatatgtggtgtatatatcacgtacatcagcagctcatatatcatatcacatgatatacagcaaccatatgtgtgtgtgtgtgtgtgt

SEQ ID NO: 707041 - DNA, 199 bp, Homo sapiens
ggagagcttacttaaacgcttaagagccccgtttgtgcaattcctggggatttggggagcgaaaacacacgccgggtagtggtgtgcacgagaatcttcataatgccccacctacccgtggataaatcgtccagacagcccgggtgcacatcgggtacagcccggcgcgcccagcgcgcccaacataccgccgtcacag

SEQ ID NO: 707042 - DNA, 502 bp, Homo sapiens
tggaattacctaccgatacccagcacgcagccgccctcgcccggcagcatgagccacgcatgaacggcaaggcgagcatgaaggcctatgccaagaagcctttgcgccatgccgtggagattcgcaactagacttttgccgtgccggagtacatccaattgctggataagcacggtgtggcgctggtggtcgcggacaccgccggcaagtggccgtacgtggaagacgtgaccgccaacttcatgtacctgcgcttgcacggcgacaagcagttatacgccagcggttatagcgccgaagcgctccagcgctggggtgaccgaatcgaacgctgggcccaaggcaagcagactgccgatgcacacctaatcgaccctcaccacacaccccgcaggcgtaaacagcgcgatgtgttctgctttttcgacaacgacatcaaagttcgcgcccccttcgatgcacgccaattgctgcaacgtttcgggctggaccaacacctgct

SEQ ID NO: 707043 - DNA, 394 bp, Homo sapiens
  misc_feature (137)..(137): n is a, c, g, or t
  misc_feature (376)..(376): n is a, c, g, or t
gatggctctaatttctggcttatgcaactgagtggtgccattgagagagactctctctcttgccttcttggttggcacactggggagaagcgagctgcagcgttggagaggcccatgtggcaagggactgagagcancctctggccaacagccggtaagcaaccagtgagcaaccgaggccctcagtcccacagcatgtgaggaactgagtcctgccaatgatcatgtgatactgaaggagggtctttctttagctgatcctacagatgagaatctagcccttgtgctgcctcatgagagacctggagcagaggccccagctgagctatgcctggattcctacccacagaaactggaagacaataaaagtgtcgtntatgtttttttattctgg

SEQ ID NO: 707044 - DNA, 165 bp, Homo sapiens
actgatctggcagggacgggaagcttatcggaggagcacggtcggggcgctgctggacggcatggcgtctgcctgggccccgtctctcctgtgggcccagctgtgtgaacctggaaccagcagctcccctctgcagtctgcgtgtgatcagtccgttcgcatgtt

SEQ ID NO: 707045 - DNA, 110 bp, Homo sapiens
acaacaaggccacaaacaacaagccactagggcgaaaacgatatcataatgtggcagggcgtccattatccgaacgatcgagcgcagcgaagctggtagcgaggaagcgg

SEQ ID NO: 707046 - DNA, 980 bp, Homo sapiens
  misc_feature (2)..(2): n is a, c, g, or t
  misc_feature (53)..(53): n is a, c, g, or t
  misc_feature (88)..(88): n is a, c, g, or t
  misc_feature (127)..(127): n is a, c, g, or t
  misc_feature (167)..(167): n is a, c, g, or t
  misc_feature (197)..(197): n is a, c, g, or t
  misc_feature (231)..(231): n is a, c, g, or t
  misc_feature (247)..(247): n is a, c, g, or t
  misc_feature (283)..(283): n is a, c, g, or t
  misc_feature (291)..(291): n is a, c, g, or t
  misc_feature (348)..(348): n is a, c, g, or t
  misc_feature (360)..(360): n is a, c, g, or t
  misc_feature (362)..(362): n is a, c, g, or t
cnttttgctgcatgaacaatgaaaattaacctctgcctttaaatggaaaaatnactttctgtagattgttatacagctactatgaagngctcttaatgaagaggaagtggcagtggtctatatgtanactgaaaaaatatcattaataaagttcaaagactgatggnatttcattgcccttaaagatatgaaccagntctgttttatgcttttctccaattatactaactngcagttgaaaaggatntgttttggagagtgttattttcttaccaagagaccnggtcaagnatccctatacttttccaccaaaaaaagattaaaatgaagccatttctataaatttantggcactttatntnttatatagaggaatggcttctgtttgattttctggacaccatgtcagtcaagatctactttctgtgtaaaaatgaataagtcttgcacataatccattcgtgttgcataaggttgcaaaaacaattaagtgggaaatgactcctaacttatgtgtctactctgcctagaaagaaagttttgaaggcatctatatatatttcataacaatgtctgttctttatggatttgatccataaatatttatctatctgaaaactttgatacttggaatgttttccttagagcatttggtgctccaagaaaaaacatttggtgctaagagttgcagcactgatgcctttccctaagttaattctattttaaaaatttatatttccttcccaatgagatgcagagtaaaatttgagaccctccattgactagggagcagcatctgtcatctatggttaattactattttgacaaaaatatagaaggtttaaacccccatgtatttcagattgttagagaaagaagtagtttgcttatatttcccttgaactttattctaaccatttaaataataaattattcaatatttgttataataaatccttactagatacaagaaaaaaaaa

SEQ ID NO: 707047 - DNA, 158 bp, Homo sapiens
  misc_feature (40)..(40): n is a, c, g, or t
  misc_feature (97)..(98): n is a, c, g, or t
  misc_feature (151)..(151): n is a, c, g, or t
tgttggcgccttcattctcatcccgttagccgcgttcttncttacggccctgctgtcaataggacatccttgtggagcaccgatctgtgcaggacanngcaccaggtgctgggctgggcagcagcaagaagaggggtccccgcaggctagnccacatt

SEQ ID NO: 707048 - DNA, 216 bp, Homo sapiens
  misc_feature (1)..(1): n is a, c, g, or t
ntgttaggtacacgtcctggacttcgtcaacgatgttagcgggccagcgcttcgatacccaggaggcgcaggatgtcttgcggatcggccgggccgtacacaatcatttcacccttgttcaccacctgaccgtcatgcaccagcacctgcttgtctttggcaatcaggaactcgtgtttttcaccgtccatatcggtgatttccagacgctgctta

SEQ ID NO: 707049 - DNA, 163 bp, Homo sapiens
cctcctgcgttcaaacaattctcctgcgttcatctatcccatagtagctgtggattacacggtgcccactcaccaagcctgtgctaattttttagtattttttgggtagaagatgtgatttcaccacgtttggccacacacctctggcctcccaaagttgctc

SEQ ID NO: 707050 - DNA, 939 bp, Homo sapiens
gactgccggtacggaaaactcgctgctgccccaaccgtggcttgacagggcttggtctctgcaagtggctctcagccccttcttctttcctgcctcaccttccaattcgttgccgtcgcccgtcccgcagctgactgtttccggagtttgcaccttccccatgttccggggcagggagtccgcaaaaggaagaatcggcacgacggttccctcatcattgtccgaagtgactaaaagaagctgatgggaagcattgggtgtggggcacaccaaggagcaggccccgggatttctcggacaccactttttctggcccggctggaacgcaagggatattggctcatagattgcaccctgaaagctccttcagaaacaaggccagaaacgagtttttccaaaacctacggacccaagaagataactggatacataccccgattcacttttcttggaggcaatgttgactgacacgccatggacctgtgttgtccagattccttgacatataattaattctccatggacgacataacattacagattccggaaggggaatagggactccagattatggggccaatttcttcaacgaaattttctccttggaatcagggctacacggtgtccaagaacatctttgacgtgtttaacaactaaaatgattgaagcgcagtcaacattaataatgcagacggggtccttgtaccgtagaagggactcaggttgtcacggggcgtaggagacccaaggtacgcacagttaactcctatcaaggcgttggcaccaaggcatcatggagtcatcctggccagatgtctctcataataatggcaagataatagggactaaacatgtgacaagggcacacggcaggggcagcaccgcaccgcacgccaaaccacacctggttgcgaaatgcacgcgctcacacacccggga

SEQ ID NO: 707051 - DNA, 354 bp, Homo sapiens
tgaagagtatgataggccatgttcataagataaaacttctgtactgacctggaatatgggctgcaccccacagactggactggaagacatggagcattagatcagaatcgccatgtttctcacggactccaacaacatcaaggaagtacttctgtttccatgccatgaaacccgaagacaagacggagaatgtaacaaccactgatacactggaaagcacaacagttggcacttctgtctagaaaataacaattgcaagttgtataactcaggcgtctttgcatttctgcgacagatcaaggtctgcaagggaattcttgtgtgctgctttccatttgacaccgcatgttcgct

SEQ ID NO: 707052 - DNA, 371 bp, Homo sapiens
caatcatgaactcccctcttcgctttccagatcttcagcaaggacttattcagactccaggtccaaggtgatctacatggagcgaacccggggagtgtgatctccctctatcataaatccaagatcgccgaggcagttaaaagacccgggcacacccaaccagttcctgagggacttcctcaaaggcgaagtgcagtttggctcctggttcgaacacattaagggctggcttcggatgaagggcaaagacaacttcctatttatcacctacgaggagctgcaacaggacttacagggctccgaggagcgcatctgtaggttcctgggccgtccgctgggcaaggaggcactgggctccgtcgtggcacact

SEQ ID NO: 707053 - DNA, 705 bp, Homo sapiens
gcacaaacaagatgtggaaggaggagctgaggcatgggttatctttagctacttggctatcgctcctgctagatgtacgagaccttaggtttctctttgaactgcattctactagccatcagtaggctgggtgggtgatggaagggtgtctggatccatagatagcagttagcgatatgtttgtcttgtagctcaacctggttagtggcctcctaatcgctcatctcccctatggtggcagaggtagcagctcacatggaaggctcaattccaggtctgggcacatcgcctggcaggcccagagctatgggcatgtatccgccaggctattccagtgcttacagtcacagcaccttaactttagcatagagttcgaatccttatccacttaaaattggtagaggagtattgtttgcctgccagttactcgaatcctggctaatatacgtattatggattccacaggagtggtatactagtaaccgtgccctcaatagactggcgcttacttagaattagtcactgacctacagctgcatttgcatgacaaaacgtagaagtctagctccacgcgaaaaggaaaactcgcacagacaggtagaggcgacaaagacacacacagcgtgcagcgacaacagacaaaggaaaagtcgagaaggagcacaacgcacgtacggaccacgaaaggggcagcaaagaacaaca

SEQ ID NO: 707054 - DNA, 427 bp, Homo sapiens
ggccgccacagtttctcggccggcgtcgtctcccattttgggaggattctcaaggttctcagatgctccaatgccacctcggctctgctagcgtggccgccgagcttgcgtgccgtgactgctgcccggacatcgcctcttctggaggctgaacaagaggtgactcgaggttgcgcgcacacataaggcgccggggctgcaggggccgagaaggacgtagcctccaaaatctggaagctcactttgcgcgcatcgagtcgttgctgggctctcacatttcacgggcccctgggtcctggctgacgggctcttctcggttgctggatactcagtattcatgggtggtgcccctgcgtgcgtaagtatttgcacagcttccgtggtggcgttcctagggtggggacagagcttgggtgcagagagggct

SEQ ID NO: 707055 - DNA, 193 bp, Homo sapiens
taaaaaaaaaacccccccctttttttgaccccccttgaaaaaaacggggggggaaaaaaggggttaaaaaagctccccccccggggggggggggaaaaaaaaaagggggggcccggggaaaaaaaggttggggggggcccccccccccaaaggacccccccccggggggcccccccccaaaattcaaaaaatg

SEQ ID NO: 707056 - DNA, 236 bp, Homo sapiens
gcgtactctgctctcggacggcggctgcatccggatccacagtgctgcagcactcgcgtcctgcagaacgcgcataagacgctcctgctggcaccggaggaggcatcgcagaggctgcagaaccaggaagagaacatgcagaaagcactaagcttcctgggcccctcaaccccagctggaaattaagaacctgtcgcccgaaacaccaagtgacggccatagcaattcccctagca

SEQ ID NO: 707057 - DNA, 798 bp, Homo sapiens
gatacttgactggacaacaacgacaacaacgcccgacacacagcaactctcgcacgtacactgttaccttgtcgacacaaaacttccggaccaagacctaccccttgttttactgttttccagtacttctgacacaactacccacgatgtgatggcacgtatctcgacacgactgttacccataaaacctgactgacaccttgacccggcacgacactgttcatgccgatatattctgactccactcgaccaccttgacttgagacggagctgatcgacacctactccatcaccgatgggggggcattacaccacacgttggcctattactgtctacttgacctacggccatgggacgacggtaaccacctacaatttcacattggacgactgtacacgtatggatagggtattatcgattctcggattctagcgattacctatacggacaccaccactactactactacacactaactactacactaccgactacttctactccggctacgtccgacactaaccttggcactaacacactcacacaacactcgaccggagctctttctcttacgcacgggaccccggacacccaacaaacaaatacatatcctaaacatggtttccttctgcacagcgacactaccttacgcttttacattgggtggccaacctaggtcacacaaaccgttactaatcacatgggacttatccctggatgggcttggaacacctatcatcgaacacgcacctaacggggaccttggagtactagggcacacggaccacacaaaagag

SEQ ID NO: 707058 - DNA, 1666 bp, Homo sapiens
  misc_feature (6)..(6): n is a, c, g, or t
  misc_feature (845)..(845): n is a, c, g, or t
  misc_feature (1089)..(1089): n is a, c, g, or t
gtcttntttcttttcttcttctctttctcttcttctccctctttttcttctttttgtcttctttctgctgtcgcagttgctgagagcagggggggccagaggagggagggaagcggaggggcgcgaaacgatagtcctctagcagatagatctctcttgttgcggaatataactcacgataatgttctgttggttgtcataatacagtggttgtagagcgtcgtggtccgtgagatgatcaggtgttctccgacccgcgtgccgtggttggttgatatggtcggtctcgtcatttctttttgttcgtggtgctagcatattcctccagccattcccgccaatgtgggtggtgggtttcttccccctctcctccccccccggtgggtggtgtcagcctcctctgcttctccccgaaatagatatagtgtgtgtggggggttcctccacccccgcaccgcgccttgtgataagtttgctcctttcctgtggaagagtgatggtgagaagaaagaattttttgagaagaaaagggcgcagcccatgcacagaaacatttggttcgtttcacgaacacagaaagactgtgtgttcctttatgtataatccgtcctgtgtggaccacacccccggggttgttttccgccccgcccccgccgtggtagaaaaaggatgggggttgtatcccccctccccccggggggggaaccccacgggggacatttgtggtccccccaccccccgacggaaataagggttttaaaagtgggggattcggaggaaccaaggtgaagcccagccatcccatgggaagagtttttgtaaagaatgaccccgcgcattttggncatttggatgtggaatctccccacaatatctctcggctttgggctcggggctctttttttgaaataatttgggataatataggctcttatacacccgtcgggaccacctcctgttataggcgcccccgcgaattagttttagagggtttttatataatataatagaggttgaaacccactggggacacaactcggatatctcttctctgtgataaaatatgtctcacactctctgtgagatggnctcgtgctcccccctcagatttgagatagtttatatctgtgagcaccgcagtttggctcccacaccagagttagactctctttagagagagaggcctcgggcccaacatctatagagagagtgggggggagcacccagcagagaaatattcttcttgtatacgccacacaacactctcacaccattctctgtggcctcccacgcaatttgtgtacacactctctctccacattctctctcttgcccacactccaaaaagcccttgttttaaagaagttagatttatacgcccgctcgccattatagattatacactctcccgcacaattgtacacactacactctctgcgctttatggaaaatttgtggggagaaaatttatgagaataatatattgaccacggagttatattggagaaatttgttatatatgagatgagaacactctttgtcacataataagagattcactatttatcttcttaaataccacatttgagatataaagtaaaggcactggttgtggttaatctggtttatttttgttcccccagttaaataaatcataaaaccttga

SEQ ID NO: 707059 - DNA, 190 bp, Homo sapiens
taggtgttataactcatagaggaacggagtccactgctcatccgagatgtagcagaacatgaagcgccgaacgtggtaggcatgcagcagaccacaaaggcgatgaccactgcacgtaggacacgcacgccgtgccgcaagggcctgtgaccctgccaggctcgatggaccatgctgaatgtgctgtgct

SEQ ID NO: 707060 - DNA, 275 bp, Homo sapiens
  misc_feature (231)..(231): n is a, c, g, or t
caagagttcctctctaatctaagaagcattgtcaaatctagggtcccagcctgccatgaaaagctgattcgctactatgggagtgaaaagcccttatggagcttttacttattacggagactgctcataaagtgccttcacctcgcttgctatcattagccagtcctagctccaaattaccaccaattgctccttttcagagagtctttatcccgcctaaagtccctaatnactcctatctactctgcttttcagatcaagtaaccagctaacct

SEQ ID NO: 707061 - DNA, 111 bp, Homo sapiens
atcatcggctgagcaataaatcagaatttcgtcccgaatgttactcacctgttagtcgctgccctccaacacaggttcgctgtggaaatcactgccatatatacccatcta

SEQ ID NO: 707062 - DNA, 271 bp, Homo sapiens
ctgtaatcaccatttctaccactagatggcgcaggtgagcttccctggttcaatgcatcaagtgttaagagacggggttggtggggacttaaatttctctgtctctactaaaaatacaaaaattattcaggcgtggtggcacatgcctgtaatcccagctactctggaggctgaggcacgagaatcacttgagcttgggaggtggaggttgcagtgagctaagatcacgccgctgcaccccagcctgggcaacagggtgagactctatctc

SEQ ID NO: 707063 - DNA, 177 bp, Homo sapiens
  misc_feature (150)..(150): n is a, c, g, or t
cccgttataagtatatcacgcgtgcatcattatcttcatcatcactggctcatctgcttcattgtcactgtcgctgctgtccgtggctatgttgccatgcgtgccccagaagccaccgtttgaagaagttgttgccgtaaggtgtctcgntgtggtaagggtactcttcgttgtcat

SEQ ID NO: 707064 - DNA, 1875 bp, Homo sapiens
ggctgggtcacgcctgtaatcccagacatgcctaggcacagtaggaatccttaattgtagtcctttgaaggatgccgcggtcgctagatcattgcattcagtgccacgaaacttgacaggcttcacacggtctacagtggttgagtccgtctgtgcttactagtaaataaacgcagaatatattgacgaagagggaaagaagaacagagaaaggcgagggcctcgaatgggcgggtggtcgcggagagaaagacagggtgaagtcgcagagaggagcagcgatgggtcaccactaagcgtggtctgccctgtggagctccgaccgatgtgtgctcgcggtgagcaaagagcgggcgataaaaactactgggccccgggtgaatcaccacgccacttcggcggaaaagggtgcagggatcggacagtccggcgggaaataccatcgcaaccgagggcgactatacagacgcggtggaccaatgtgtaacgagagaacgaaactcgtccgcgaagaaaaagaggagccaggagggcgttaacaacggtacacacaattacacatacacgagagaacaattagagagcgacaggaccccaccaggaagggaaaaccacccaattaggccagaacggggaccagagaacacgaaggcaagaggaggaaaccccccacagaaagagagacaccagcaaggaccggccaccaagcggggccaacgaacaatagccacacggcagagggccaattatgaaagccctaggcaagcaacagagagagtaccagcacccaaccagaaatgagcaatccgccatttatggaacgacaataatccaaaggaaccacaggacaggaacataccacccgagcagcattgcaacgcggcacgagcagcataggacacaaaagcacgaggaatatccaagacgaaagaaccacataacactaaaacagaatcacacaacatacaaaacacacaccagccgccagaaaccacatagaagcgaaacaaaacacaaaccaatcaggaagagagaacacaagcagaccatccagaacataaaacaagaaccaagaagaacacagcagaacgacgaagtcacaagtaaacaaccaaagggaagagaatcacaataacatagagagacacacaaaaagaacaaatagaacgacgaacgcaaacacgaacaaaagaacgattcagcacccagaaccacaacagccgcaacacaaagacaacagcccagcaacacacacaacaagacaaacaaatacacacgagaatacaacagactaccatagaggacatacacaagatataaacacagcaaagtacacagaagcatcacggacgacccgagacaaggcagaacaaacccaacatacaccccaaggcccagagaagacacaacagaaccagcaacacaggcaagcccgacacaacaagaacaaaaaaatcaacacaggagaacaacgcagccgcaacaccacacaagacaactaacaggaacacacacagaccacacccagcaaagcggaagagagaccacacaacagcaggacacagcacaccaggcacgaagcgcagaccacaatgagcgcgagcagcacaaccaaacaccgcgcagcaacagcgagcacagacagcgcaaatcggcgaccaaagaagcgacgacagacaacagggcaacacacagaggaacacacacaactaaacgcaggacataagacgagagcgaaaaaccagcagacatcaaccagggacaacgcaccaccagaacatagaacgcaacaacaggacaggcacaccgcaccatcgcggcaaacgcccgcgaccacaagtaccaccgagcgcagcacacaagtacgtacacact

SEQ ID NO: 707065 - DNA, 100 bp, Homo sapiens
aagctcggtaccgtctgctggggaattccttcagtgatacacacaaccaaggaatttctgcctcaatagcttcattaatggcagcagcagcagcaggacg

SEQ ID NO: 707066 - DNA, 611 bp, Homo sapiens
tctggagaatctatcgtggctgctggttggtggtgatgtcgctgttcgtggggggcactctgggggtgttgtctgtacgtcctgctcctctgcaagcgctgctggagactgtccaccagcgcctcaacagggccatggaggaagcggagaagaccaccaccacctacctggacaacggcacgccaagccagcccaagacccagagttccggggagaggaccccagagtgccaggatgcgggagacggaacgccttccatgtaccacacagctccacgggccagacgggtcatccttcaatgaagagcggcgcatgtaagaagcagagccgcaagaccgcaggaccagggtcgacggtacacactgacggagggggacatagcaccaggctgaagacatgcccggatcacgacagctgaaactgcacgaaccctcaaagaataggtcagccataccacgagttgtgaactacagaggcgaagccaagactcaaggcaaccgacgacacccgaacacgagacaacagtcatacccaagagacactcatgggccaatcgttccaggccccacgggtgaagggcccaaagcgagacgatacagagaggagcaccc

SEQ ID NO: 707067 - DNA, 174 bp, Homo sapiens
ccttccccaaaaacccacccttagcctcggaaggtagatcccaggttaggggtttttctaaatgggggtttttaaattttcagggtttgctcctgggaggcagccccaaaaagggcccttaaatgtactagctggatgtgacccagttttaataaacaggttttttaatcccga

SEQ ID NO: 707068 - DNA, 180 bp, Homo sapiens
cgggtacttggcggccacgccatcccacggatcgctttcaagctgcttcatgccgaggctgatgcgctgcgtgtcctggttgatgcggatgatctggacccgcaccgtatcaccgatcgcgatcacttccgacgggtggttgacgcgcttgtagctcatgtccgtcacgtggagcaggcc

SEQ ID NO: 707069 - DNA, 347 bp, Homo sapiens
gcgtgttacatcgtgtgcccagtgtcccttcacacttagtagccccgggaccagattatagccggcaggtcagctctctgcgcgcgcgatgtgctcgtgtgatggctttgtcccctcataggggggtgtccccccagaggcaatgctgcagagcaaattccatgccagatgctctgggctaggacaggctgaggccgggcttgagaggagagcgctttacatgccaggagagaacccacgcacatgcacaccacaaagagacaagagaactcaactcacaccacagcacacctcaccacaccacacctgaactgcaccatacctcagcaaatctcaccacaccacag

SEQ ID NO: 707070 - DNA, 948 bp, Homo sapiens
  misc_feature (34)..(34): n is a, c, g, or t
  misc_feature (36)..(36): n is a, c, g, or t
  misc_feature (71)..(71): n is a, c, g, or t
  misc_feature (143)..(143): n is a, c, g, or t
  misc_feature (152)..(152): n is a, c, g, or t
  misc_feature (187)..(187): n is a, c, g, or t
  misc_feature (203)..(203): n is a, c, g, or t
  misc_feature (229)..(229): n is a, c, g, or t
  misc_feature (239)..(240): n is a, c, g, or t
  misc_feature (249)..(249): n is a, c, g, or t
  misc_feature (258)..(258): n is a, c, g, or t
  misc_feature (286)..(286): n is a, c, g, or t
  misc_feature (299)..(299): n is a, c, g, or t
  misc_feature (309)..(309): n is a, c, g, or t
  misc_feature (328)..(328): n is a, c, g, or t
  misc_feature (339)..(339): n is a, c, g, or t
  misc_feature (347)..(347): n is a, c, g, or t
  misc_feature (349)..(349): n is a, c, g, or t
  misc_feature (358)..(358): n is a, c, g, or t
  misc_feature (366)..(366): n is a, c, g, or t
  misc_feature (369)..(369): n is a, c, g, or t
  misc_feature (380)..(381): n is a, c, g, or t
  misc_feature (387)..(387): n is a, c, g, or t
  misc_feature (389)..(390): n is a, c, g, or t
  misc_feature (395)..(395): n is a, c, g, or t
  misc_feature (398)..(398): n is a, c, g, or t
  misc_feature (400)..(400): n is a, c, g, or t
  misc_feature (433)..(433): n is a, c, g, or t
  misc_feature (442)..(442): n is a, c, g, or t
  misc_feature (445)..(445): n is a, c, g, or t
  misc_feature (466)..(466): n is a, c, g, or t
  misc_feature (470)..(470): n is a, c, g, or t
  misc_feature (472)..(472): n is a, c, g, or t
  misc_feature (494)..(494): n is a, c, g, or t
  misc_feature (503)..(503): n is a, c, g, or t
  misc_feature (517)..(517): n is a, c, g, or t
  misc_feature (521)..(521): n is a, c, g, or t
  misc_feature (561)..(561): n is a, c, g, or t
  misc_feature (603)..(603): n is a, c, g, or t
  misc_feature (610)..(610): n is a, c, g, or t
  misc_feature (624)..(624): n is a, c, g, or t
  misc_feature (626)..(626): n is a, c, g, or t
  misc_feature (631)..(631): n is a, c, g, or t
  misc_feature (639)..(639): n is a, c, g, or t
  misc_feature (646)..(646): n is a, c, g, or t
  misc_feature (649)..(649): n is a, c, g, or t
  misc_feature (676)..(676): n is a, c, g, or t
  misc_feature (679)..(679): n is a, c, g, or t
  misc_feature (690)..(690): n is a, c, g, or t
  misc_feature (702)..(702): n is a, c, g, or t
  misc_feature (705)..(706): n is a, c, g, or t
  misc_feature (723)..(723): n is a, c, g, or t
  misc_feature (738)..(738): n is a, c, g, or t
  misc_feature (836)..(836): n is a, c, g, or t
  misc_feature (936)..(936): n is a, c, g, or t
taaaagagaggcaattttattcttccaaaaaatngnagcaaagagggtgagcacaggagcaccctggcacntccccatcctaagcagggtctgagatgaggccaggcctgacgtgggcttgggagaagctgacggagctcccngtggccttngggagggaaccaggcagacctggaagtggaacttngttgttagcaccaggngccgcccacagctgggctcggcaacngggcagcacnnggccctgtngcctccccntgagagtctggggaggggctggtggcanagggctccctgcnggaggtcccntgaatgactctcagattcncagaccccctntgcccccncnacccctgtnaacctganaangggctcgtgannccctcnanncctcnggncnagatgagggtccgagatgtgtggctgggcttcnggcggcccnggngctgccgggctttctcctgcntganangctggtccctggtccccccgcnggccaccgncttccaggcctggncatnggggccggtgtcgtgtagtggcttcggggcttctgggccnctgctgccttctcgggcttggcctgcccgccgccctggttgngccagcngttgtcttctttgntncctgnccgggtgnggctggnagngtttgttggggccgttgtcggccaggntanagacttgggcngtgtgggcatcntcnncttcacatcctcatccncaatgtcaagagccngagacttccgggctttcttgatggggctccgcgccgccccggcttcctcttctgcttctcgggcctgatgtcgtcctcgatgatgagttcgatgcccncctccgaacgccgcccctccttccagtcctcctcccggtgcggggtctgtggccggggcttccggggtccgttcttctcccgggcgttcttgaacggggntggcgtgtgggg

SEQ ID NO: 707071 - DNA, 384 bp, Homo sapiens
atgagagcagataccaagaggtagagatggccaaaaggttttaagttccctctattctcttgtacaatgcagtgccaagtaataccctggggttactcacactgctatggcctctagttgaagataggagtgctgtggtttttttcttggcaagaaattgtggaccaggggtgatatccaatcacagtcctctggcctcatttgggacacagagggcaagtatttttttaaccctattattttacaaaaatattaaaaggcaagcaactggacatggtggctcatgctgtaatcccattgtttatgggaagctgaggtgggaggaccacttgaggccaggaattcgagatcagcctggacaacatggtgagaccccatctctac

SEQ ID NO: 707072 - DNA, 939 bp, Homo sapiens
gggagcgctttatgctggccggcggcgctgggaggtggagtcgttgctgttgctgttgtgagcctgtgggcggcttctgtgggccggaaccttaaagatagccgcaatggctgaaaactggtgatacatgaaacagatggctgccctgtgaggccacaatatctgtcatcaaattgagtattattttggccgacttcaattttgccacgggcacaagttctctaacaggaacaagataaaactggatgaaggctgggtacctttggagaataatgataaaaattcaacaggttgaacccgtctaaacaacagaactttaactgtcaacttgtggaagcattgagcaaatccaaggcagaactcatggaaaatcagtgaaggatacaaactaacaatcagaaaggtctccaagcagaagccctacctgaagtgactgatgagtactaacaaatgagtgtaacacaaaaccaggactctgtcttatattcaacaaggcgttcccaactgatgcacatctcttgattgaccctacacacgactcggttagcaacataacagcgtccaggtactacaattattcaagattgacgcaagaaccatttggcttaaagccactctaacggggaatcaaatacaggtggcggtaagaataaggcacttgaaattcgtgctaaacgaaaatttggtatgaagcacccctgtcgccaacaagttatcatggaacaaggacctgctaaatactttctacaggcacgatttcgctttgcccacacaacacttgacgcacgggaaacccacatcacgggcgaagcctaactatagaagctaacccacgggccagatggccaccatatgttcgagagctgctggctggatcctcaacaaaacgatgacctcgggaatcgcgggagacagacacccgtgcaacatatacgttct

SEQ ID NO: 707073 - DNA, 393 bp, Homo sapiens
agcctttccggcgggcatttcctcaaggcctccggaggctcccctccagacaggcatttcctcaaggcctccggagtctcgggctccagacaggcatttcctcaaggcctccggagtctcccctccagacaggcatttcctcaaggcctccggagtctcccctccagacaggcatttcctcaaggcctccggagtcttccctccagacaggcatttcctcaaggcctccggagtctcccttccagacaggcatttcctcaaggcctcacgagtctcccttccagacaggcatttcctcaaggcctccgtggtttcccctccagacagttattttctcaagtcctccgaggtcttccctccagacagtcattccttaaggtccttggaggcttc

SEQ ID NO: 707074 - DNA, 167 bp, Homo sapiens
tgtctcttagctgactagccttttcaaactttcgagagtctttcattatcatcatctggaatagtcacctgaatgagttaaggtcttcaacacctgactgcagtagtattaacatagggtgatgaactttctttatctagggagggctcttacgaggaggtgctctc

SEQ ID NO: 707075 - DNA, 1072 bp, Homo sapiens
ggctaggaagccagatgaccctgagagcaacgaggaagaaggtgacagttcaggcggggaggacacagaggagagcgacagccctgatagccactcgtgacctggaatccaagcgtggagagtgaggaaggaaaacgagaatgccagcataaatgatgcaagacggcatgactcctggtgaaaggtggtttgataagcggcaaggaaagacgctggtaaagctaccagagacagagctgccctatcactgttcggcagcccctgtaatcctatgaggaaactgatgatctctgttgttagtgacacgaatcgacttggcaaaggaagccacgcctttttggtgcttgagctggaagccggaagtttcatcgagtgttgcgaaaccaagcccgcaggtctccgaacacggaaggcgtaaaccaaacgacaaatatatttaacacacacaacctgcttatgcgcttctccattttttagcgacgtaacggattaggccagccaatctcttgcgcctacacagcatgaagcgcaaagaacataggaaccctaccacacaagtgccacttatagaattcacacctattggtatatagttgccaaccatataattaattcaattccatctatggccccaccaataggttacacccttgagagatccttggacaacgattgacacggctatgtcaccaaatgtagaagattgaactctagcgaaaagagttcgcagagttgctaattggacatatggtgaccaggaaacaatgcatcttcggacgcaccacaagcactagtgcccggtcgttggtcgaactttgggccagtggcgggtgtggcaaaatcggtagcctacaagttttgtaattagctggaataaaattcgaaacatagggcaataaggtatgagtaaacccacagagtatatacagacaagtatcatagatgcagcaactcatagtttggtttaagcaaaatatggagcccataaagatatgatgagacttacaacggataaagagcatagattccagccaagcagttagcgacacagtcgcggttagaacacgacaag

SEQ ID NO: 707076 - DNA, 105 bp, Homo sapiens
ctgctccacaggcttcctggccgcacccctgtactcgtggcagcgagttcctctttgccttctatttgtggtactgcccggactccccgtgtgactcctctacga

SEQ ID NO: 707077 - DNA, 126 bp, Homo sapiens
gcggcgactctgaggatcccatgtacatttaaacaggatacgcacaataatagagaaagtcagcgggtcatgttttacaggaaatataaaaaacaaaacaaatgaaaacatttaaacattaaatgt

SEQ ID NO: 707078 - DNA, 198 bp, Homo sapiens
ccttcattacactttctaagtttgggggactaaagcatggggaagggggggcatgaacgctcatcattcataataaaacaaggtaaaaaagtattacggcgaagattatgaacagtttgcattacataatttacacgaaagccatgctagtcacctccccttttgttggactggcgacaggaactgggccattctcct

SEQ ID NO: 707079 - DNA, 792 bp, Homo sapiens
ccggagggtgtatgtgaaggccgccgtggtgcgtggtcctcggcgggtttcccctcgttgtgggaagtgttgtggagaggtggtgtgcttgtttttgcgggcggtctcttccaggggggtgctttaccgtgtttggcgccctccgcctcgctcaccgtggtgagagagtggggtctgtcgcccccgcgtccccgctactggcttcccgcattttggttttttcgcgtctagggcctgccaaaatggggtcggaggccggcttccctggccgccccgcccggaaacctatttcaaggtggggccgtggaattggccatttgataacaacaaattattgttgcgtataaacgaggcattttagggggcaacaagagtgcagtagcaaaacacttgtctctacgcgtgtcacccgctcattgagcacccaaagggacgtcgccccactttcttactacccatggcatttattccccattattgaccttctttaccaccatcgcgtattcacacactaaatctacggtcaagataattattctttctttttgataacacacagaatttataaagaggcaaatcttttatttggtaagccccccacaagatatacaacataatttcttttcgatttcggggacctctgcagtattcaccagacgcccgtagtaaaatcagtacttgttattacaataaatagagaggagaataatgcagatgttactcgttagtatttcggggtgacattccctacattagaagagaatatatctaacaaaatcaatagacaggaaa

SEQ ID NO: 707080 - DNA, 983 bp, Homo sapiens
  misc_feature (12)..(12): n is a, c, g, or t
  misc_feature (24)..(24): n is a, c, g, or t
  misc_feature (871)..(871): n is a, c, g, or t
tacggtaggtangaggctggggtngaatcggacgaggccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaaactaaataacaaaaaaaaaacaaaaaaaaaaaaacctccggggcctttttgtcgggggggggaaaaagggttttgaaagggccatggtctatgttgttccggcccctttttgtcncaaggggaatcgcgggccccaaaggggcgataatcgaacccgtacttcttcttcttcacacgtccaacgacacagcagccccaaagagaggaaaaacaacgaaacacaccac

SEQ ID NO: 707081 - DNA, 224 bp, Homo sapiens
agccaatgtgcctgctgggtgtgcatagcgggctgctgcttcatcccacttctgcgtggatgccctgcaggacagtggaccattactgtcaccaactgcatgagctctcctggtgcacctacaagcgtagtgtagagactcagccagtacgtggcagggagcctgggtgcctgcaggaagctcctttccactctctcatccacgcttcacgccatggtggcagg

SEQ ID NO: 707082 - DNA, 898 bp, Homo sapiens
  misc_feature (786)..(786): n is a, c, g, or t
  misc_feature (788)..(788): n is a, c, g, or t
  misc_feature (796)..(796): n is a, c, g, or t
  misc_feature (800)..(800): n is a, c, g, or t
  misc_feature (804)..(804): n is a, c, g, or t
ccacgcgtcgcggacgcgtgggtcgacccacgcgccgggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtccaaaaaaaaaaatcgagngntcaattcngggngggnaaagggggttgaaatggcaagggcaaatgttcctggccccttctgtcaagggggaactccggcccaaagggggaataataaacggaggtccgca

SEQ ID NO: 707083 - DNA, 891 bp, Homo sapiens
  misc_feature (813)..(813): n is a, c, g, or t
  misc_feature (823)..(823): n is a, c, g, or t
gaacctaggctaggtacgaggctgggtgttcacgcgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaataacaaaaaaaaaaaaaaaatcggggtctttattcgggggggaaagaggtttggaanggcatggctngtgttctgaccatttttgtcaaggggaactgcggcccaaggggcgaaaatcgagccgactataaaagg

SEQ ID NO: 707084 - DNA, 451 bp, Homo sapiens
cgacatctacgtgtgggaagaatagggggtgatcttctcgggagaaaaaaagatgaccatcatggtaagggagaaattggtaatccatgcaccaggaatactactggtacgtgaatgtgctcgagcccagcaccgtacactgaacaccaaggctctcactcttgagtctagggcaccatatatataaaggagtccggaccttgtcacggcaatcctatggtacgtagtcaaatcaaactgaaatccggaggcctggtgtgagaacctcacgagcggacaccgggcatataatatctatggcacacccacacagccagggccaaagtggtcacggcactctcctaacagagccaggctcttctgagtggcactcctttctgaaggaccatttatcacttgcacctccatcagaaaattacctgagatctagtgagcgcagaggttacgggtt

SEQ ID NO: 707085 - DNA, 809 bp, Homo sapiens
gctagtacgaggctgggttcgaatcggccgaggggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgaaaaaaaagtcgagcggccgttcacttagtagtagta

SEQ ID NO: 707086 - DNA, 486 bp, Homo sapiens
ggtgactctacaggatctttaacggtctgttacccacccgctcaccctgctgacgttgcaggcgcacttgcaggtaatggctggcgccaaaaaagatcgagccgcccacccgcaacacaacgcttcaccgtcgcgccagtgttgcacctgtggctgcgaggtgcgcttgaggtagaaaaacagcgacgccagtaccccggcatagatcgccgtttgcagctccaacaacaaggtgacgacacaggtcaggctcatcaccacaaattcggcgcggctgacccggaacagcgcacgaatgccgcggtggtccaccaggccccagcagatcagcaggatactcgccgccatgctcgggatcggaatatgcgcaatcaacgctgcgccaaataacgcaaataacgccacccacagctccgaaaacaaccccggcaatggcgaacaggcacgggaacagaccgtcggggtaccggagctctgattccgtat

SEQ ID NO: 707087 - DNA, 890 bp, Homo sapiens
agggccggggtaatcggcgaggcaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaaacaaacaaaaaacaaagaaaaaaaaaaccgggggtttattgggggggggagacagggtaagcaaggcctgggcaaggggtccggaccgtttggcaaggggaatatgggccaaagggggaaaaagaaacggtac

SEQ ID NO: 707088 - DNA, 430 bp, Homo sapiens
tcggatggtgcgcttccctcctgccaggtaagacgggccacgagctccgggaggtgtgtgacatcagctgcggaagcgagcagagctcagctgaccagggtgatgtgaatgatgccttcttcagctctagacctcagctgtgcaggcaccctgcttgcctaggccccaagttgcagtcctcagagcagagcaggcctcatgtgagcctctctaggcctggtgccaccctgaggctgggcagccccatataggagagaaagcgcgaagaaagaaggaaagaagaagagtccaaggcctggccaatgtgtttggtcttcccaaagggaagaagaagagggtcagcccagtcacgagccgaggccaccggtcgaaaagctgatggccgccccccagtgagaataagcgcgtgagcggcagtgagcggggcgca

SEQ ID NO: 707089 - DNA, 776 bp, Homo sapiens
aaactttaggctaggtacgaggctggggttgaatcggccgaggggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggatgcagagtaagttatgattatgtatttactatcttatggtttttcttttccc

SEQ ID NO: 707090 - DNA, 438 bp, Homo sapiens
  misc_feature (29)..(30): n is a, c, g, or t
  misc_feature (34)..(34): n is a, c, g, or t
  misc_feature (53)..(53): n is a, c, g, or t
  misc_feature (65)..(65): n is a, c, g, or t
  misc_feature (77)..(77): n is a, c, g, or t
  misc_feature (147)..(147): n is a, c, g, or t
  misc_feature (192)..(192): n is a, c, g, or t
  misc_feature (201)..(201): n is a, c, g, or t
  misc_feature (214)..(214): n is a, c, g, or t
  misc_feature (240)..(240): n is a, c, g, or t
  misc_feature (243)..(243): n is a, c, g, or t
acgaagtacttcgtggtgggtatagcgannatgncatgattaccggtcatcgntttattgacatntggcaggccatnaaacctcaacgaattggccgtcaagaatggcctgaggtcccgatggacgaagacttcaaactcggcaccntgaagcgtctgggcctgcctcactcgacccaagctgacgtcggtnaggcctggnaggccatgctggnacgagtgcgcgactggcacgatttanacncccgctttaacacggagatggagaaacttatcgatttcgtcacgcgtgaccattttcacgagctggacaatggggagatggcatgagtattgacgtcgacacggtgtctgacctcatccgggatgtgagtgccagggttatcgatccccggttccggaccctccacgatcatcaaatccaccagaaaaagcccgg

SEQ ID NO: 707091 - DNA, 947 bp, Homo sapiens
  misc_feature (30)..(30): n is a, c, g, or t
aaggcaatgacttacggctaggtacgaggnctgggtggcgggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagtaagtttatgattttgaatataaattatatacaacaaaaaaaccacactcaacaacaaaaaggcgggcgctctctacatttacccgggggcacactccgcccacttttttcacaaggcgccaaagaacattacacgaacggcgcacaaacgagcggaaccgctcgtctgcgaagcacactggggcacggaccacagacagcggaaaatgtctgaccac

SEQ ID NO: 707092 - DNA, 743 bp, Homo sapiens
  misc_feature (13)..(13): n is a, c, g, or t
  misc_feature (16)..(16): n is a, c, g, or t
ggcagagatcgtncancagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacagaaaaaagacccccaaaactatttagtaatattggctgatctaggatataagttttttcaag

SEQ ID NO: 707093 - DNA, 492 bp, Homo sapiens
caacgatggtccttcagctcggcatgttgagtaaagctaattgccagtcctgggcgggggcaaatcctcaagcttgatgtgtagggaagggagggggcctgaataatccttgaggagtagtagaatagcagatggaacactgagaagttatttccttgaggatagatttccacaattgaaaggaaatgggaggttctaagaggcgggttagtggcttgtactatagcatagcctgcccttgctgatgtgtggcgattaggcctggtggaactgccatcaataaatcaagcgtgatcagggtgaggaacagggaagaaggaaatgtggggaaatgggatgaacatcaggtggatcagagagaggcagtcatgagggtcaggtgtggtatctggaataatgtgggaggctggattgaagtccgggccaggaacaatggtaattgtgggacttaacaaagagtgagtacagctgaggaccatcgttggggttacg

SEQ ID NO: 707094 - DNA, 442 bp, Homo sapiens
ctcaaactctaaaattcctgggctcaattgatccccccgcttcggcctcccgagtagctgagaccacaggtgccaccaccacatccagccaatcttcttattttccgcagagacagagtcctactacgttgcccaggctgttctccaacactgggctagtgatcttcctgccttggcctcccaaagtgctgggattacaggcagtttggttgagcccaggagtttgagaccagcctgggcaacatggtgagacctcatctctacaaaaaatgcaaaaattagccaggtatggcggtgcatgtgtgcctgtagtcccaactactcaggaggccgagacgggaggattgcttgagctcgtgaagttgaggttccagtgagccatgattgcaccactgcacactacagcctgggtgacagagggagaccctgtctccaaaaaaaa

SEQ ID NO: 707095 - DNA, 680 bp, Homo sapiens
  misc_feature (9)..(9): n is a, c, g, or t
  misc_feature (542)..(542): n is a, c, g, or t
  misc_feature (559)..(559): n is a, c, g, or t
  misc_feature (564)..(564): n is a, c, g, or t
  misc_feature (566)..(567): n is a, c, g, or t
gaagcttanggctaggtacgaggctgggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaanaaaaaaaaaacacaaanaaaanannaacaacaacacaaacaccacacaacacacaacacaacaaaagaaacacaccaaaaacccaccctacaacaaacccgcggcgcctccttctcgggggggcgaccacacagatgg

SEQ ID NO: 707096 - DNA, 951 bp, Homo sapiens
  misc_feature (640)..(640): n is a, c, g, or t
  misc_feature (951)..(951): n is a, c, g, or t
ccacgcgtcgcggacgcgtgggtcgacccacgcgccggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataccaaaaaaaaaacaaaaaacaagaaacaaaaaaacactctgtgtggggcgcgcgccctgaggccctccagagaaaggctctttcagagacaccctctgcgcggttggggccgcgcgggggcgccgncgagttggtgtcaggtgtacacaagtgggcccaacgagcggtgtgttcccataaggagagagactccgggcgccaacgagactcaagtgggcgcttgggtctttcctcccccctattataatagagaagcgccgcgcggcggggcaccaccgagagaggggggtctcttggtggacacaattctccgagagagtgggccgactcccgagggggggcccactcgacgggggccctttatctaccgcgggggggtccccgaggggaggaactctccgaagattcaaatttgtgccgcgctcccggggtggtan

SEQ ID NO: 707097 - DNA, 525 bp, Homo sapiens
  misc_feature (15)..(15): n is a, c, g, or t
  misc_feature (36)..(36): n is a, c, g, or t
  misc_feature (52)..(52): n is a, c, g, or t
  misc_feature (75)..(75): n is a, c, g, or t
  misc_feature (101)..(101): n is a, c, g, or t
  misc_feature (118)..(118): n is a, c, g, or t
  misc_feature (131)..(131): n is a, c, g, or t
  misc_feature (152)..(152): n is a, c, g, or t
  misc_feature (184)..(184): n is a, c, g, or t
  misc_feature (317)..(317): n is a, c, g, or t
  misc_feature (460)..(460): n is a, c, g, or t
  misc_feature (475)..(475): n is a, c, g, or t
  misc_feature (494)..(494): n is a, c, g, or t
ttaaaggagcactcnctgaaattttacctcaatatntattaatctaaacctnaaactaaaacattaaatggaaantaaacactggaaatgaaacttgttcnaaaattgcaatagtggnatgtgtgtgtctntggcccagcattggaggctanatgaagataactattccaggaggtcaagcttnagtgagctgtgataaatcactgcactccaccctgggcaacagggtgagatatcatagctgtaattccaacgctttggggggctgaggaaggcggatcacttgaggacaggagttcaacatcagcctggccaanatggtgaaacctcgtctctagtaaaaatacaaaaattatccgggagtgtccaggagtggtggcaggcacctgtaatcccagctactcaagaggctgaggcaggaaaattgcttaacccgggaggcagaggttgcagtcagctnagttcgcgcactgtnctccagcctgggcaacaanagtgaaactccgtctgccctccgtctgtctg

SEQ ID NO: 707098 - DNA, 292 bp, Homo sapiens
  misc_feature (150)..(150): n is a, c, g, or t
  misc_feature (180)..(180): n is a, c, g, or t
  misc_feature (259)..(259): n is a, c, g, or t
  misc_feature (292)..(292): n is a, c, g, or t
ggatccacgccttttttttttggaagtaaagcagctaaacatgtttctataggtgagtgtggcctcacaccctcccttcctgtactttgtttgggtgcggaaggacccatggagcccatagggattccttaaaaaacaacagctagttcncacgcaaaccccagaaaccatgatcttgtnaatactgtgttttgagttgggcattttcactcttctgccttaaatccctgaccccatgcagctgacattttaatacgcntcaggggaggggaaacattgtaaataaaatctn

SEQ ID NO: 707099 - DNA, 228 bp, Homo sapiens
  misc_feature (186)..(186): n is a, c, g, or t
aagagatggagtcttactatgttgaccagcctggtctccatctcctggcttcgggcgatcctcccatgtcagcctcccaaagtgctaggattataggcatgaggcactacaccagccaacagaagtttttatattaaaatttactttttctagctgggcacagtggctcacgtctgtcatcccagnactttgggaggctgaggcaggtggatcaccggtcgggagttt

SEQ ID NO: 707100 - DNA, 666 bp, Homo sapiens
tgggtcttggtccaaaattttataaaggttcttaaaaagcgcaacatccaagactcccaaaatacaggtggccaagggaagaccctggtaatggctggtggagagagatcggggtctggggcgctatgggcagggcggttctgggtcttcccacctctttctggttctgagcaatggggggtggggggcgacaagatattctcatctcttggagtgtgttcacaaacaagggcctcaccggttgtgtacaggcgcagagggcgcttcttataggcgcgccaattcttatacaccaggtttgaggtgctccacagaggccacgaaaatagatatctaacacctgtgattcgcccacaagaaaacaccatcgtggtgctgagacacaaccccggtgggcgcgcacagcgcatgaggcacagagagaacgacagtccaacccaggggcacccccgggagagggagaccaacacaggcgccaacacaaaaaatctcacagggattaaaagccccttggggcaccgagagaaggatacccacaagaacaccaaaaaccttcagaaagcttggggcgcccccaattcttccaaggaagagaacaccgaaagaaaaacacaaaaggagggccccatccgaaaaagagaaaagcccctccatagaaatatcggg

SEQ ID NO: 707101 - DNA, 137 bp, Homo sapiens
tctgaggtcgatctgaggatcccggaagctcataaagatggctgatatcgcagcctgtacggtcatcccgggctcgatgccggaaaaacaccttgggcccgccggaagggcaggcacatgggcataggtgagcggaa

SEQ ID NO: 707102 - DNA, 857 bp, Homo sapiens
gggaccctgggggtctggacgcgacgggggggagatgaacgcccctccagcccttcgagtcgtctggctcttcgagggcgagaagaagatcacccattaacaggacaccaggtacccaattgctgtttatcaccatcaacaaagaagcccacacatgggaaacttcattaactcacaatcataaagacgccgcaggtgctatgtgtggctacaaagtcccccacccttttgacgcacaagatcatcatccgagtgcagacacgccggattacagcccccaggaagcttttaccaagcgccatcacagacctcatcagtgagctgtcccttgtgaggagcgcttcggcggtggccaataaaagacaagcgccccaggaacacagacggatctcgatgtagggcccagaggggggctctgctcgggcccttggtttggaacgcccccccggggttcccactctttaaacccccttttttggttttcgtcgcccccccctttttttgttcgggaacaacccccgcccccacacccatctgttttgctcttccgccgcagaggaaggggggagggaccccattactattgcttctccacccaccaccgcaaacaaaaatgacaggcgggggggggcgcgaggcggaggcagcactcctttatttcatcaacacagacacgcgcgacaccgcgcaccccagcacacaacaaaacaacatacgacacccgacgctacgctcccacgaccaatcacacaaccactacaagcaccgctcgtcgccacctcagcgcagcacgcgctcgtcagcaactagcgtgccgaagtcgtacgatggacctgcaaacactaaaacccaaaccg

SEQ ID NO: 707103 - DNA, 366 bp, Homo sapiens
tatcagtacaggtggagcgaggacaacactagagcgatcctccagtagccgagcgtgcatacctgcctgccggtcagacgtgtatgcaccactgcaacgcatgcctccctgaacaagttccggcgacacgttgagcacagtgctgagcttccaaatatcgtaaagctggagcctggtcgacgtgtatcactcactgcggtgcatgcctccctgaacaagatccgtcgacacgtgagacaccgtgctgacctccaaatatcgttaagcatggagcctggtcgactcttggaggatcctccagtacccgagcattgcattgcatgtctgcaggtcaacgtgtattcaccactgcggtgcatgcctccc

SEQ ID NO: 707104 - DNA, 1137 bp, Homo sapiens
  misc_feature (538)..(538): n is a, c, g, or t
ttttttcaaacgccctgtgaaacataatacacaaaccccctcttgggagggagactttattctcgcaaaatttggtgccccgcgaaattttgggcgtaaatagaagtttttccctgaattcctctctacccaccctttcccggatatcttggaggttgtccttttgggcttcggggaaaaaccagtgcttgtccagaatgcttccacaaaccggaacacattgactccacgagacttcctttggtgttgatatgccccgggattttttttttcccagccaggcttatttaaaactggtccgaaaccaaattccccagaatatggatcccctttcttccggtttttctcccacttgtggtcaacacaacatcgtgttggatgaacaagaaaggaagtttacccccagtgccccacaaagagcgacttcttttggaaaaattcatccaatttttccaaaacattggtttttctttccacccaatatgggtccccagcaccaaagtattccagaaggcgtcttctacaccaggcgtgaacncagagctttttttgaaaccctgtgcgcgggtattaatagcttttgcgcgagattttcgcgcccgcttatgacacatgggctcacagaattctcgggttttaagaaagagtccagatgtctttatttgcgaaaatttttctacgtgagaggtgtatggaacccagagtgttacattcttgtccaccaccagagggaacttggacaacacgcgttcttctacaccacatgcgtggactggagaaaagttctcagaacccttggtggatctctcccgacttccaaggtgaacccgagggataacccactcgaccaatgtaccccggtttggattcacgtgcacaatatctgcaagccccttttgtccagcaccccgctgatgaggcaccctgcgtgccacacaccgatgcaagccccttgtgtttccgggctttttttaaaaagaaaaattgtagcacctgggcgtggtgcacagcctgtaatcccagcccctcaggaggcttaggcggggaggatcccttgggcccaccagtcccacctgggccaaatagtgagagacccttgtattttgtaaagtaataattaaaatataaaaatattta

SEQ ID NO: 707105 - DNA, 1665 bp, Homo sapiens
  misc_feature (951)..(951): n is a, c, g, or t
  misc_feature (1108)..(1108): n is a, c, g, or t
ggtttacatcacctcaccccattattctttttagttcaactaactttaccatgccaacgtaaccagaactggcagcaaattgcgttgcactctttaagcgcagatagagtcagcactacgctacgctatcactctatggctcacactctaaatgctgggccaccaagaaaaccacttatgaagcccacggacttgctgacactgcaccctcactctccacgagcacaccctcttaagcacaatctctcctctacactgactcttcactacttgacacccattctctaccaataccgccgcctgcacttcgcccctctagcacttcctcccacactctatactcacataaagcactgcctcgaacctacaacacagcagtccaacccactctcatctacacccctcaaagtctcctccactacataactcgtgctacccaaacagtcaacacacgcacactcaggcctctccacaacctgagcctcacatcaacacaatacaacctggccacccctcgaacactataatggctcataactcgttcgaccctctatcaaacgactcccatccactaacgcttggccttaaattattcaaacacatttgataatctgttgctctcaaaccgtccttaaaccactgcgacacgactttatacccctttataacgcactaacaggcgatcccacatcactcacggactcacccccccaatactaagccaacggtacaacacactacaccacacacgtaaatacacacccactaataccttcgcacacccactccctggctccgatcacgctacacacgccctacccccaaaaccgagcatgcgacaagcacacaacgagcccatagaggacgcacacaccacaccctggcacagcccacacttgcctcccacacgccgcgcgcacacgccaatcacgcccacacgcccacatagancacacgcgcacaccacacacatccgaactaacaactcacattctcacaacccggaagctcgcacccaacctcgcccccactcggcaaacttcacacccctctaaaacacattgacccatatctcatctatctacagacctcacctctacactatcgngaagcgacgaccccatcaatccatctcaatctcagtcaatattcaacttcatcacccagcatctgcgcactctcatacaccccccccagcttccctacacgctcttcccccagttctttggcccagagccacacatctatcaccctctcgacacagtgttctcacaccaccacactatattcaccttcacactatccctcggtatctcccactacaggcctaacattgtatccccagaccttctaatatcccccatccattccaaacgacaactatatcaacatctcaaccccatctatatcggacaacataccaacccatcaatatcatctccacccatttcacctaaatatataccagttaccccacaaaaatgatctattcatcttcaaccacttcctctatatcgtagacactactatcatacacctattaatacatcatacacctataagaggctcgacacaaagacataatctagcgcactcaaccaagcattacaccacataatactattaacatcataaatccatcaccatctctacatcgaaagccat

SEQ ID NO: 707106 - DNA, 105 bp, Homo sapiens
tcatggtacatggtaggtatacaactttgggattgtcattattcttactgtgtacttgtttgtggctattgctattcaggccccttatacttgggaaacggtgat

SEQ ID NO: 707107 - DNA, 890 bp, Homo sapiens
ccacgcgtcggtcgtacaactacgtggtaactggctccagagagcccaccgccgtgatcggacgtgcgtgaccgtgagcactttatcttcgtgccgaagacttaaacctgttgattgccaacaacacgagattagagatctatgtggtcacccgagcgaggggcttcgggctgtcagaatgagagtgggcattgtactgggaagactgagccgtgttcagtgggagcttttcacggccctaaaggtgcgagaagcagaggaccctgctgatttattcgttgtaacagcggaatgtacaagatgcctgcactccttgggacgttactaatacatgacgttcggctgacagtcgcagtagagcatcaattgacagcgatgccctcgactgtggcaaaattggtactcaagggaacgcgtccactttgggcactgctccacttcaaagaaggaacccgggaaagttattggggcaatcaatttgaaatcgcgcttgtatgcttgccacgggaattgacttgtgggactcctagccggttccttcgtaattggaatgggggcgcttatatttcaaagcggagttcactataccaaagcataaaagtacttccggccgagataaccgttaaaatggataagcctctacagagaggacacgttatccataagctacaatccccggccccttgtgaagggtgaagcctggacactgtctcagattctaggaattgtctccaaaagggtctccccttaactaattgggctatgtcccatagagacaaaccattaacgtaaattctgacagattgggatcttaaccccatgcggacacccttcaagagagggctggacaccgggtaataaaacccctaaatgaggggtggatcctcatc

SEQ ID NO: 707108 - DNA, 789 bp, Homo sapiens
agcggaggggccagcgagcgccggccgcctccagccatggagtggcgaactcaacttgctgctctacctggcgctcttcttcttcctgctcttcgttacttttcctcctgtctcttcgtggtcatcacgcagctgaagacactccggtggccagacgacgtgccgcgggcgctccagcccgggctgcctctcggctgcaccgcgagccttggggcttctcccgatgagcaaggcggtgtgatcccgcagtgctgggcacttggcgggagggcgccgagctgcgcgggcgctgggctgggtctccgcctcgattctccgtgctcgcgggctcccagcttccagagccgagctgctgcccttgactggtgctcaggggaccacagctgcaatgacagtttggcgtcctgcagaaaagaatggctggaacaacgggagtatggacagctttctgcaaactgcagcaccacgtggtatccatgacagtttaacctgcccatcattcttcctagacaagcacactattgcaagagtcagggtgttcagaactggcttcagatcttatcaggacaatcttggttgttgcactaatttccaaagcttgtaagtgcaatggatctgcagttctacttggcaagataaccattgcaagcttgaatgagaaatgacatcacacttcacacctgcaaaaatctaaacatgtctaatacagtagattcctatgttctgaacttcaattatagggcacaggtggtagaatgcagaactgatgccatctgagtgccattctac

SEQ ID NO: 707109 - DNA, 1057 bp, Homo sapiens
gtctgggcctaaggaataaggaatgtcgccataccgatagtccggtgctgcggctgtccaggaaaacgtaactgaggatgaagattcaacctagaattaagctatatactttgtgtttacctatgtacctgattaccactttcacaaactctacagacagatcaaatgtggatgagaacgtaatcgctgatcgtcagatcaaatagacagttatgaaatgtgccgaagtatcaaagggaagacaagacttgaaaacaaagaaaatagctagtgggggcgacacgagtagacactcagtaaaagatatcattccacaaacgcatacgaggagtagtagagcgggagagtccaccatttagtgggacgccatcactggggagtacatgccgggggatacacacataaggggagatgctattggtactggacatgagaacgccaggggtgggcagatgcttgccgcggaaaaggataacaatagcgcacgcgagaggggccactacacgccggaaagagctgcagaagcaaccacaagaacccggatgggtcgaatactaagttggggggcacttcccaaaggaggccacacaggtgggaatggacgagggaagccttcacagaggaagccaaagccgtatatacatacaataacaatgagtcttctcggtcaccatgtgtgtggtatttaccaccccagcggaacgccttaaaaaaagataaagaaaagttccaaacataggttagcccccatggacacattaaaaaggtgtgcgcgtccccatatcataaaggtggcctaaggtaaggttggggtaggaggcgtgttagagtaggacttttgccaaacaagcaaggatggccataatcacggttttatcgccctaagcaacaaaagcaaagtaggagcataacaaagattctacccagtaaaaggcacatttgttggggcatggtccaggaaccatttaagcctacgtgtaaggtggttagaattagttgaaaaaaaggggttggcagaaagaacgagatatgtttatagacggccacgcatagaatt

SEQ ID NO: 707110 - DNA, 439 bp, Homo sapiens
ctagccacatgcaatactgtgaggtgggtctgcactttctcagtctttttacttccagtgacttctataccagatcagctaagcagttagccacgcccttgagtatggagccactcttttagcacgccacagggattgtcagagcagtgctgggagccctgcctcatgatcaccgttcttcacaatcagctttccctccatgctctcccagccgtctcctgagcgtagccgtctgacagcgcctgccaatgtttggcttatgccctctcccgaactcattgatctgtaaagcagctcagatctcttctccttcttcagctaaaagtacaggactcccacattgccacaggcattagtgcaaggagggtccggggcagagaagtcttgtatggtttgggcacctaccatgcagttttctggtgccctctggtcctgcctg

SEQ ID NO: 707111 - DNA, 211 bp, Homo sapiens
gatggtacgcaatgtgacggactctcaccggagacaacaataggattgtgatcacagagacaacatgcaagaataagtcagtaggcatcctagtttccctagtgcttaggtcggttttgtccagattgtctaatacatttccctaagtgggactaagttctggagagaagctcaaaagcaagaacctttctcccccaggcttcagagtcct

SEQ ID NO: 707112 - DNA, 825 bp, Homo sapiens
  misc_feature (361)..(361): n is a, c, g, or t
  misc_feature (416)..(416): n is a, c, g, or t
tggccaaagagcaaattaaagcaaggcctatgtaaaaacagggactctcaaaatcctggtacacggtttcgccaattcaaaggggcccaaaattacaggacgcaaccgtaaagaaccatcttgcaccaaaaagagtgtgctctgagagactccgaggagggccaaactctcgtgcataggatgaagccagctcagtcacattggacctcggcatttcatactcgtgattagaggaagcacgatgagaagaggagcgctttcctgcgaacgaagattgaacaaaccccaagaggcgtgggtgctcccataaaaaaaagcagatggcgtttcaaaagaaaacagcataggagaagacccacangagcgtgtattataatttttcagataaacaattaactcattattgccaccggggngaatttgacccattttctaacactcattaggtatgaccttcaattctcttccagaaatactggggacaacgttggctcaaaggcgtggtttaaaataattataacttacacgtgtcttggggcaaaaagcttctttctaactcgttgggccctaagggggggaaactacagttccctccccatggtttctaatggtgtcacaacaaccaactcgtttctttacagctggacctctcaaccaaccaagggtgcggttaaaaacaccacgaaaggttggcttgaatatgggtggctttatataccctttaaaataccaacttctcccataaatttcaaagggctaatacgaaggtctcaaaagaattaataaccggtgttcccacaattttttccccttaagggcgcggga

SEQ ID NO: 707113 - DNA, 186 bp, Homo sapiens
atgtctcctcctcggcgggatctacccccacggctgtcccacgggctgcctcggtgtctggagagcagggcacgcctcccaaggtccagctgcccctcaacgtgtgagctgccctttgtgtctgtcggggtcctgtgcctgcagccctccctcctgcctgggctgacctgtccacgtgtggtttcc

SEQ ID NO: 707114 - DNA, 238 bp, Homo sapiens
gtgggcggattacctggggccgggagttcgggaccagcctggccggcatgccagagccccatctctactaaaaatacaaagatggccgggtgtggtggtgcacgcctgtggtcccggctactcggggggctggggcatgggagtcacttgaacccaggaggcggaagaggtggaggttgcagtgagccgggatcgtggcactgactccggcctggggaacagggtgagaccctatccc

SEQ ID NO: 707115 - DNA, 300 bp, Homo sapiens
ccccccggactctctggttatgccgcccccttttcatgtaaaagcagcagcagggtgggttttctaatgggccacctaaatagttcgggggaaaaagggcaaaagttggtctctgtgggaaaagtggtattccctcacaattccaccaaaaaaccggggccggaacaaaaaaatgtgaaaccccgggggcgcccagggggtgggcccacctccttaaatgggggttgggctccctgcgcggcttttcaagcgggaaaacacctcccgcccacatgtctataatagaaagggcccccgccg

SEQ ID NO: 707116 - DNA, 267 bp, Homo sapiens
atccttaggcgaagatgtggatggtcaggggcttgaacacagcatcactggcggaggttcctgttgagatcgcagattttcttttacaatccagatgactttgacagtttcaaaccggaatttctgagaaccagaataatctggagccatggccatattttttccagtccatgcccgagggaccattcttggccttggatcctattaatcacgggtttgaagggtggcggtggcatccatagaaggagaactttcgtggatcctttc

SEQ ID NO: 707117 - DNA, 291 bp, Homo sapiens
aatgttgaaataatagattagttgggttttcacatgcaaacattcaaaatgaatacaaaatttaaatttgaacattatggtgaatttatgttggggagatggggattttaccttaaatttatttaaatagggggattccttagaaatggtgtgttacctgccaagccatccttgtttccccaatggtttttccaaggaaacacccttccctccttctgccattactatggccacttaagtgtatctgcagctcttcatttaaaagggggaaggggaattacctgtctctca

SEQ ID NO: 707118 - DNA, 191 bp, Homo sapiens
cacccgatgccccgagatgtccatccgcacagtgttccggcagagcaaattccggcatgtgtcggtacagccggtcacgaacgaacagtgctataaggacatacgcgtgatccgtgttacctgggacagcaccttctgcgccgtcaaacccaagcttctggcggtgattgtggagagagtaccgagctcga

SEQ ID NO: 707119 - DNA, 649 bp, Homo sapiens
atcctccgagccaggtgcggtcttagtaatctcgtggtgcagccgttattcttaagccggtcggaaaagcgcagtattctgagtgggagtgacccgattttcgcagatgaatgtagaaatggtcttactatacatagactgcagggtatggaagaagatagcttggtaaaaaggtcgatggagaagagtgaagaagatagttcagaaaatcggggaagatttgtacatgcataatggtccatagactaaatggcatgatgtataagagttttcctgtagcctggattctacgtgacaagattatatgcagtatcccacagaaagtaaggcggaagtctcttaagagattgtcgttgcttggcatcataagcgcgagatggtccccgcaagcatgttccgttatgacggagtgcctgggtcagaacacaataatacaattcgcctttgataagtacaaaggattctgagaagcactggctcgttcccacgtgtcaggagttctggggagagattacttgggaagtggctctttgggattcaggtatcttttggatgaatgattccaccgtagattaagatgatagactagggtgagtagccattttggcctttgggttattcaagaattcatggtggctttggagaataa

SEQ ID NO: 707120 - DNA, 381 bp, Homo sapiens
  misc_feature (44)..(45): n is a, c, g, or t
aattagggtttttataaaaccaaaaagaacttggcaacaccccnnaggtaccctttagaagcctccaattgctacagcctgtgaaggattggcctgtgaccaatcagaggctgaagtggagtcttagctcatggtcaagcagaggctgaagtggaaacttcttgtctttttatcacaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattctctacttctaaataaaaataaaacaaaatacaaaccgttaa

SEQ ID NO: 707121 - DNA, 186 bp, Homo sapiens
ccatatgggcacagtgccggatgaagtgtggagcattctgcggacagcattggtggttggacgactcactgtggggacattgaatactaccctagagagaggtgatactgtcaaagaaaaactctgcatgatgctggggtgacacaaagactctgcaaagtatgggatttactggggtcctcatca

SEQ ID NO: 707122 - DNA, 1090 bp, Homo sapiens
  misc_feature (627)..(627): n is a, c, g, or t
  misc_feature (737)..(737): n is a, c, g, or t
gaatacttggtttgctctgactcaagtaaatgggtttgtgagcacgctgaaagcctctacgcctggagaggggggctgcgtctggagtcccctggcatctacagaggcgcctacgatggtgaccgggggagagagcttcaatcctgcttccaaccaatcgctgcacgtatcaaccagagaacgaccgtcgcaagatttgcaatgggcactacagacgtcgtatggaagaatgccactagaaaggataggcgcataaggttcgcgtgtcgtaggagacagcacaagaagggtgcgaagtgtgcgctgtgcggagaccacagaagtaatgacactgatacgacgtgatgtgatctcagctccaggatgacacgcgtgcaagtagactaggatggtacagtctggaggcctgacggcatggaagtccaaagagactgagcaagaatgggactggagacggaagtaacaccactctagatgtcttgctgagacagggcctctttgcaaccctcaatatgccaagcatccacctacgcaggaatgattctacacgacgttcactcgatgcgagagcatcacctgtcatgaagaccgtgacgtgtgccatggagatatctgtctgtgccctgnctttagtgggggctagtgccgtgagtccaatcttagcagggtgtgtgtcgctaagcagcgaggggtgtccaataggcagggcagagcatggcgtggtcaagctgcgtaanctcacttggagcggatcacagtcatgtcgtgtcatccacggaagcgacgctacagagctttctccgccgatcatggtggacgtgcaccagtgggtcaagcacttggtgcagcttgccagtcttgcaggatgccaccatggggacagttgcctctacaattgaccaacggatgccgagcttgacacggtgaagcataccccgagaagttgggaagaatcaacaggtgcacttccgccagtgatggcaatagtgacggggacgggggaccactggtgcaccattgacactgcgaaggtcgagaaagcgaagcaaaccaggatgtacacagagggcaatgctgggatcaacggatg

SEQ ID NO: 707123 - DNA, 884 bp, Homo sapiens
cttgttgaacaccgtgcgtgttcattaaccccccagaaatattttgttcaagagagacaccttttctccaaagcgggcaaactttttttacccaccctacaagataaatctcccccccccttttggaaatttgcccccaattccttcgtaacccccggcccactcccaactccggtccgccatgagcgaattggccgcgcccccccaaccaattgtattgcccacgccgttatctgttttagacccgtcctttatcggatttaatcctcctagaatgtccaagtatgccactcctctcccaggtgggcgaaaacccacggaaggaaagggtgatgagtccacattttccgcgccggtcgattccccccacgaaccttctgtgcgacaccaacagtgaccctgtttctgggcaaaacaccgcctatggtggagcgtgcagctaccttttggcaggcgtctgttatccccgcgaccttaaaattgattgtctcagggttgtgagcaagagtggactcgataggatttatttggcactccgatcatcactccccgactacgttaatgattgctgcccaccaatcgtataccacgtcttgtgttctcgccccccctaaattccttctagcggctatgtctttactgcccgcgaatgcctttacaaagctctcttatcacgagttttcatacttaaattgttttagctcaccaaatgttttgtgtcacaatacactccagtgttagcctcctaacacactatttctcaggcccaatcgacgccaaaaatccttcgggtagtttacaacgatttcgaatgccttcattttgacccgaccccacttagtttctcccctctgggataaaacaaataaaatttcgcgacatgc

SEQ ID NO: 707124 - DNA, 288 bp, Homo sapiens
cttttggggtctttgcttttttttcagttttggcagcttttgttgagatatcttgaagctcagagattctttccatagccatgtccggtctactaataagcccatcaaaggcattctgcatttctgttacagagttattgatctctatctacttcctcttttttttttttttttttttttttcccggaaaaaggttttggttttgttttccgggggggggaccaggggttaaataaaagttaatggggccctaattttctgggcttaaggttccccacaaaaacccca

SEQ ID NO: 707125 - DNA, 243 bp, Homo sapiens
gtcgctcgtcgaaggcgtgtcaccctgacggacgtgatggaaaccatcgccggctacctgccggaggccggcgaagaggtggacgcacgccacgacattcagcaaaacgaggacggtagctggatcgccaacggctatatgccgctggaagatctggtgttgtacctgccgatgccgctggaagaaaagcgcgaataccacacgctggcggggctattgatggaacacagccagcgcgtgccg

SEQ ID NO: 707126 - DNA, 101 bp, Homo sapiens
gttttcttctgccatctgtgacagcttcttgatctgtccccaggggtctgaatggcaaggagtgagccccaggatgacccaggacaagcggcagcaacagg

SEQ ID NO: 707127 - DNA, 1004 bp, Homo sapiens
atctactaaatgagtcgccagacgagccacatcgctcagacaccatggggaaggtgaaggtcggagtcaacggatttggtcgtatttgggcgcctggtcaccagggactgcttttaactactggatacagtggatattagttagccatcaatgaccccttcattgaacatcaactacatggtttacatgttccaatatgattccaaccatgagcaaattccatggacaccgtcaaggctgagaccgggaagctatgacatcaatggaaatcccatacaacatacttccaggagcgagatccctccaaaatcaagtggggcgatgctggcagctgaggtacgtcgtggagtaccactggacgtacttacaacaacatggtagaaggctggggctacatatatgcagggtggagagccaaaagggtcaatcatactactgcacccctctgatgatgcccccatgatacgtacatgggtgtgaaccatgaagacgtatgacaaaaagacatcaaagatcatcagaaactgacatcacatgcaacaacaaactgcataagaaaccctggaaaaggtcaatccatggacaaaataaggatacatcagtggacaggacatcatgaacaaaagcacattgcacatcaaatgacacccagaaagaatgatggaatggacacctacgaggcaaaaaggtggagtgaagaaacagacaagacaacataccaaaaaccatcagttcacctgaactcaaaaaggacggctggaccaagcgctgaaacaaaaaggaaaaacctgaacattaaacgagacacaccaacacaatgtgaaaacgattacacaatggacaaagaagaaactaaatgaaacaaacacgtaagaaaaaaaaaccatagaaacatagaagacagaaaacagagtaaaacagaaagaaagccaaagaaaaaaggaaaagaaacaaagaaccaagaacaaaaaagaaacaaaaaaaataaaagagaagaaacacac

SEQ ID NO: 707128 - DNA, 252 bp, Homo sapiens
ccagcagggcttgggggcttggccctcgaagccatgtggtgggcaaattcagaaactgaagccagcctcggcgggaccgaggtcccggagccaagctgtacccatgctgggcgagtcccatatttgaggagctttctggggagaacatgcgttgtgcggcgtgaaactggggctagagggaaggaggagcctgttgtccctgggaggccggctgatgcacgtctgggaatgaataaagaagccttctggtta

SEQ ID NO: 707129 - DNA, 100 bp, Homo sapiens
  misc_feature (62)..(62): n is a, c, g, or t
attcaaagcttctaaccgatgtacggcggacatgcgttgtggttaatttggtgttatttttngttccacaagttaaataaatcataaaacttgaaaaaaa

SEQ ID NO: 707130 - DNA, 163 bp, Homo sapiens
agcctgggcgacatgagcgagactcctctcaagaaaaaaaaaaaaaaaaagggaccaatttcttgataaatgcaataaccaaataatcctcacaacctttcccttgaccaaagcagcccaaacccaaaaaattccttccccaatgattccaaattaggttccc

SEQ ID NO: 707131 - DNA, 647 bp, Homo sapiens
  misc_feature (533)..(533): n is a, c, g, or t
agggacatatatctgtgcattaatactatgaaagaaaataggccaggcacagtggctcaagccagtaatcctaaccctttggaagaccaaggtggatgaaattgcttgaggccaagagttcaagaccagcctgggcaacatagtgagaccccatagctacaaaaatgttttttttttcgagacagagtctcactctgtcgcccgggctggagtgcagtggcacgatctcggcttactgcaatctcctcctgcggggttcacgccattctcctgcctcagcctccctagtagctgggactacaggtgcctgccaccacgcccggctaatttttttgtatttttagtagagacagggtttcaccgtgttaaccaggatggtctccatctcctgacctcgtgatccacccgtctcggcctcccaaagtgctgggattacaggcatgagccactgctcccagccgctacaaaattggttttaaaaattagccaggcacagtggtgcacacctgtagtcccagcctcaggagactgangtgggaggattgcttgaagccggaggtttaggcttcagagagctatgattgcaccactggactccagctttgatgaaaagatgcaggcctgcctccccacaccctccccccggg

SEQ ID NO: 707132 - DNA, 163 bp, Homo sapiens
tatctagaggatccctttcttgccacgactcggttactgtgaatccaccaggtgcagcccatgaaggggccacctgcctgagccagagaccctcgggctgtgcagcctgaagcccacatctgcctctggacctcaggtgcgctggggaaaggaaggcaaagtg

SEQ ID NO: 707133 - DNA, 170 bp, Homo sapiens
ggaccgtatctctaagcattacgcaggtaatatcttttaagaatatgcactatcagatttacgcacgtaaagccaacggatacaggcttcagatttactatctgagtccaaaacaatttgtgctatcccaggtgggtgatccttctagaagtcagactctgcagggcatg

SEQ ID NO: 707134 - DNA, 238 bp, Homo sapiens
atagcctacccctcccttgttctatccctatcatgcttcattctcgcaaactccctctgcctacgagaaagagacctcagatcgctcattgcctcctcttcggtcatcccctataaccctcgctgctaagcatgcattgctcgtccaaagccccgctgaagcttcacctggcgcagtcattctcataatcgcccacggacttacatcctcattactattctgcctagcaaacccaaaa

SEQ ID NO: 707135 - DNA, 2515 bp, Homo sapiens
gggttagagcccaccttcgccttgataagaaagatgaatctttgttggtccaacactaagtaaggaggaaaaagagttggaaagaagaaaagaattaaagaaaatacgagtaaaatatggtttacagaatacagaatacgaagatgaaaagacattgaagaatccaaaatataaagatagagctggaaaacgtagggagcaggttggaagtgaaggaactttccaaagagatgatgctcctgcatctgttcattctgaaattactgatagcaacaaaggtcggaagatgttggagaagatgggttggaagaaaggagagggcctggggaaggatggtggaggaatgaaaacgccgatccagcttcagcttcggcgaacacatgcaggcttggggacaggcaaaccatcctcatttgaagatgttcaccttctccaaaacaagaacaaaaaaaactgggacaaagcacgagagcggtttactgaaaacttcccagaaactaagcctcaaaaagatgacccagggaccatgccttgggtaaaagggactttagagtgaaggctaatcatagaaaaaaaacctctagtttttttaaaaatagaatttggaaacttattttttctccccaaaagaatcagcagcacaggggaactatgtcacagtttacctcttcctgattcagaaatgtgtatggtttgcagcttttaaaaaccatttttttaaaactaataaatagtgactgaaccaatttatgcagtaaatagactaaagttcacagggcacggatgagtttatcaaacttcgttattttatcttgtcatttacaacatccatataagcaactagccatataagcaaaattcatagaactactaatgacttaagtgtacatctgttcttgtctccatatattcatgtaagatgcacaacaaaagaaacatcagaagtttataaaaataaatctgactatatgcatcctcatttattccctttagaacctaggtaaaaaatgttgcgaaaacatgggtagtggcgcatacattttgttatccttgaaatagcctaagtaatgttattgaagaactaatgaacaggtaacatattgtagaaaattagtctttcattgttttcttctgtgaagaatctgttgctatgtactgtatattcagcatttatatttggtttgtttcatagctaatgaggtatttagatatgaacaactgaatacatattgaaatagtgtgctggcttttgtagttttgataaagaccattgcaggcaatggaattgtgccagagaaatctgatttctagtacaaaaggaatacttagccagggcctcaagctcaagatacttattgaaaacatcctcaattgcaataaaaacattataacatgaaaaagagtgattttttgaaccggtgatttaaatgtattgatctgctttgaattttcaagcagccagaattttctagtttaaattggcagagttataacaaaggagagcctcaaatattagacaattgcagtgcggctttctgggcacaggtgtcactgctctgccacctatcactattctttttctgttcagtttttctctcaggtgtttgctgggaaattaacactggaactgacccttttctggcagtgaatgtaagctctagctcccccatctactataaagaaatgtcttcgagatgtagaaataaggaatattctgaaaataaaaattatacagtagtaaagataattcagaaagaaaaagctacctgttagaatttccagtctaaatggcacagggtagttacggagaaaaggggatggagaaggagaaactatgactaaagatgagaggtatgaacgagttgtcaggttcctatgggcttaagctaggacaatcaggccctaaactccaaatttggataaaatatctctttgcattcttcttggccacctgcatagtctgacacatacgtatgtacagttagacttgcaggctgcaggagtgccctgcattgttttcttttaattagaaataaaaagtattagtctaaatgtggttctggtgctggtgccctgtatatatgtaacaatataggacccctccaaataggttttgcttctggtgaatcttggtcattgggttagtatatgactgtctataatattttccatttgtattattatattggggaaaacattttttatcattttctattaagaaaatggaaaacttaaatatggtgttaaaaatggaaatatatgtgatatttgcattattaaacccctttgcagatctaaagtctcagggttccactattagtggttaaagtactgaataatgtctgggtctatttccatctgtaaaataagaatatttgtctcacgtgtctgtcatgaatagcaaatgagaaaatgtatataaaagcactttgtaaattgtaaaagtagtacagatgtgagcttctatttgtttagaagcataaatgtgaattatatacagtttgaaaaaaaaaaa

SEQ ID NO: 707136 - DNA, 366 bp, Homo sapiens
gggaggcgaagattccagtgagccaagatcacaccactgcactccagcctgggtgacagaatgagactccatctcaaaagcaaaaaaattcaatatgcgtttatcataagacccagcaaatgctcttctgggcatttatctcagagaaataaagtaaaatcttatgttctcaaaaatacctgtatatcaatgtctgtagcatcttgcaattgcccaaactggaagcggccagatatccttcaacaggtggatggttaaacaaactgtagtacgccataccctggaataccattcagcaataaagattaaaaagctattgatacatgcaacaactttcagaggattatgctgcaaataaaaaaacag

SEQ ID NO: 707137 - DNA, 2492 bp, Homo sapiens
gtttaaacatatccattgcctttatttctggttagggtggaatgacatactctgcagcatctaaatgaaatttggtgatgctagttaaggagcactctattttctgtaaagtaggctgtacttattgacaaggcaagacaacatagaaaaatgaatgtaagttccatgtataaaggtatatatattcctgtatgtatttgatgcatctgacaggtttttcttttgcatcaatctttaataaatcaaaaaattgtagagtcctaagttggacacagcagatttcaatgtgtttagactctaaaataagtcctctgctcaacttttggtaacagatccagcttcagcttcggcgaacacatgcaggcttggggacaggcaaaccatcctcatttgaagatgttcaccttctccaaaacaagaacaaaaaaaactgggacaaagcacgagagcggtttactgaaaacttcccagaaactaagcctcaaaaagatgacccagggaccatgccttgggtaaaagggactttagagtgaaggctaatcatagaaaaaaaacctctagtttttttaaaaatagaatttggaaacttattttttctccccaaaagaatcagcagcacaggggaactatgtcacagtttacctcttcctgattcagaaatgtgtatggtttgcagcttttaaaaaccatttttttaaaactaataaatagtgactgaaccaatttatgcagtaaatagactaaagttcacagggcacggatgagtttatcaaacttcgttattttatcttgtcatttacaacatccatataagcaactagccatataagcaaaattcatagaactactaatgacttaagtgtacatctgttcttgtctccatatattcatgtaagatgcacaacaaaagaaacatcagaagtttataaaaataaatctgactatatgcatcctcatttattccctttagaacctaggtaaaaaatgttgcgaaaacatgggtagtggcgcatacattttgttatccttgaaatagcctaagtaatgttattgaagaactaatgaacaggtaacatattgtagaaaattagtctttcattgttttcttctgtgaagaatctgttgctatgtactgtatattcagcatttatatttggtttgtttcatagctaatgaggtatttagatatgaacaactgaatacatattgaaatagtgtgctggcttttgtagttttgataaagaccattgcaggcaatggaattgtgccagagaaatctgatttctagtacaaaaggaatacttagccagggcctcaagctcaagatacttattgaaaacatcctcaattgcaataaaaacattataacatgaaaaagagtgattttttgaaccggtgatttaaatgtattgatctgctttgaattttcaagcagccagaattttctagtttaaattggcagagttataacaaaggagagcctcaaatattagacaattgcagtgcggctttctgggcacaggtgtcactgctctgccacctatcactattctttttctgttcagtttttctctcaggtgtttgctgggaaattaacactggaactgacccttttctggcagtgaatgtaagctctagctcccccatctactataaagaaatgtcttcgagatgtagaaataaggaatattctgaaaataaaaattatacagtagtaaagataattcagaaagaaaaagctacctgttagaatttccagtctaaatggcacagggtagttacggagaaaaggggatggagaaggagaaactatgactaaagatgagaggtatgaacgagttgtcaggttcctatgggcttaagctaggacaatcaggccctaaactccaaatttggataaaatatctctttgcattcttcttggccacctgcatagtctgacacatacgtatgtacagttagacttgcaggctgcaggagtgccctgcattgttttcttttaattagaaataaaaagtattagtctaaatgtggttctggtgctggtgccctgtatatatgtaacaatataggacccctccaaataggttttgcttctggtgaatcttggtcattgggttagtatatgactgtctataatattttccatttgtattattatattggggaaaacattttttatcattttctattaagaaaatggaaaacttaaatatggtgttaaaaatggaaatatatgtgatatttgcattattaaacccctttgcagatctaaagtctcagggttccactattagtggttaaagtactgaataatgtctgggtctatttccatctgtaaaataagaatatttgtctcacgtgtctgtcatgaatagcaaatgagaaaatgtatataaaagcactttgtaaattgtaaaagtagtacagatgtgagcttctatttgtttagaagcataaatgtgaattatatacagtttgaaaaaaaaaaa

SEQ ID NO: 707138 - DNA, 2461 bp, Homo sapiens
gggttagagcccaccttcgccttgataagaaagatgaatctttgttggtccaacactaagtaaggaggaaaaagagttggaaagaagaaaagaattaaagaaaatacgagtaaaatatggtttacagaatacagaatacgaagatgaaaagacattgaagaatccaaaatataaagatagagctggaaaacgtagggagcaggttggaagtgaaggaactttccaaagagatgatgctcctgcatctgttcattctgaaattactgatagcaacaaaggtcggaagatgttggagaagatgggttggaagaaaggagagggcctggggaaggatggtggaggaatgaaaacgccgatccagcttcagcttcggcgaacacatgcaggcttggggacaggcaaaccatcctcatttgaagatgttcaccttctccaaaacaagaacaaaaaaaactgggacaaagcacgagagcggtttactgaaaacttcccagaaactaagcctcaaaaagatgacccagggaccatgccttgggtaaaagggactttagagtgaaggctaatcatagaaaaaaaacctctagtttttttaaaaatagaatttggaaacttattttttctccccaaaagaatcagcagcacaggggaactatgtcacagtttacctcttcctgattcagaaatgtgtatggtttgcagcttttaaaaaccatttttttaaaactaataaatagtgactgaaccaatttatgcagtaaatagactaaagttcacagggcacggatgagtttatcaaacttcgttattttatcttgtcatttacaacatccatataagcaactagccatataagcaaaattcatagaactactaatgacttaagtgtacatctgttcttgtctccatatattcatgtaagatgcacaacaaaagaaacatcagaagtttataaaaataaatctgactatatgcatcctcatttattccctttagaacctaggtaaaaaatgttgcgaaaacatgggtagtggcgcatacattttgttatccttgaaatagcctaagtaatgttattgaagaactaatgaacaggtaacatattgtagtattcagcatttatatttggtttgtttcatagctaatgaggtatttagatatgaacaactgaatacatattgaaatagtgtgctggcttttgtagttttgataaagaccattgcaggcaatggaattgtgccagagaaatctgatttctagtacaaaaggaatacttagccagggcctcaagctcaagatacttattgaaaacatcctcaattgcaataaaaacattataacatgaaaaagagtgattttttgaaccggtgatttaaatgtattgatctgctttgaattttcaagcagccagaattttctagtttaaattggcagagttataacaaaggagagcctcaaatattagacaattgcagtgcggctttctgggcacaggtgtcactgctctgccacctatcactattctttttctgttcagtttttctctcaggtgtttgctgggaaattaacactggaactgacccttttctggcagtgaatgtaagctctagctcccccatctactataaagaaatgtcttcgagatgtagaaataaggaatattctgaaaataaaaattatacagtagtaaagataattcagaaagaaaaagctacctgttagaatttccagtctaaatggcacagggtagttacggagaaaaggggatggagaaggagaaactatgactaaagatgagaggtatgaacgagttgtcaggttcctatgggcttaagctaggacaatcaggccctaaactccaaatttggataaaatatctctttgcattcttcttggccacctgcatagtctgacacatacgtatgtacagttagacttgcaggctgcaggagtgccctgcattgttttcttttaattagaaataaaaagtattagtctaaatgtggttctggtgctggtgccctgtatatatgtaacaatataggacccctccaaataggttttgcttctggtgaatcttggtcattgggttagtatatgactgtctataatattttccatttgtattattatattggggaaaacattttttatcattttctattaagaaaatggaaaacttaaatatggtgttaaaaatggaaatatatgtgatatttgcattattaaacccctttgcagatctaaagtctcagggttccactattagtggttaaagtactgaataatgtctgggtctatttccatctgtaaaataagaatatttgtctcacgtgtctgtcatgaatagcaaatgagaaaatgtatataaaagcactttgtaaattgtaaaagtagtacagatgtgagcttctatttgtttagaagcataaatgtgaattatatacagtttgaaaaaaaaaaa

SEQ ID NO: 707139 - DNA, 160 bp, Homo sapiens
cactcatcaggtcctggcttggaagtactggctgatattatcttatcctctcatctctgtggttttctctgcatagtcaaatcatcattagcttagtggcatacgtagtagcatttcactagttgcatgatatgtcattccttcttttgatttcccattc

SEQ ID NO: 707140 - DNA, 745 bp, Homo sapiens
gggttagagcccaccttcgccttgataagaaagatgaatctttgttggtccaacactaagtaaggaggaaaaagagttggaaagaagaaaagaattaaagaaaatacgagtaaaatatggtttacagaatacagaatacgaagatgaaaagacattgaagaatccaaaatataaagatagagctggaaaacgtagggagcaggttggaagtgaaggaactttccaaagagatgatgctcctgcatctgttcattctgaaattactgatagcaacaaaggtcggaagatgttggagaagatgggttggaagaaaggagagggcctggggaaggatggtggaggaatgaaaacgccgatccagcttcagcttcggcgaacacatgcaggcttggggacaggcaaaccatcctcatttgaagatgttcaccttctccaaaacaagaacaaaaaaaactgggacaaagcacgagagcggtttactgaaaacttcccagaaactaagcctcaaaaagatgacccagggaccatgccttgggtaaaagggactttagagtgaaggctaatcatagaaaaaaaacctctagtttttttaaaaatagaatttggaaacttattttttctccccaaaagaatcagcagcacaggggaactatgtcacagtttacctcttcctgattcagaaatgtgtatggtttgcagcttttaaaaaccatttttttaaaactaataaatagtgactgaacca

SEQ ID NO: 707141 - DNA, 944 bp, Homo sapiens
  misc_feature (279)..(279): n is a, c, g, or t
  misc_feature (944)..(944): n is a, c, g, or t
gacgggcgtggactcggactccgtatacatgaatactcagatacgagcatctgcggggcacttcgacttgctactagttactagattgtggctcgggctcgggttgttactgcaggggacgagaaccaactatcgttgtgtgggccacggtcgaccgttgtcgggtgaacttgatacggcccacacttcacgtcggcggccgacggtgcacgagccacttctagacgcggtgacttctagtggtgacttgctcgttcgctagttgtgcagcatgtacangggcaatgtcggcatagctgagtctagatggaaaccgcggagacgctggtcggcgtgcgtaggctcgaaggaacggcagtagtccgcgcagtcgcgatagccgctgaacgttgacgcgttacgcctcgcctccgcgggtggtgtctccccacgatgctctggaacgcttcgggaagttctcggcatcgtggccactgtggatgactacaagtaaagtagggaacgaccgttgcacctcgcattagaataggccccaaggcgtatgcgtagaaaggacgccgagcttgtacattgtgctcgcgagcgccatggggtaagagtaatagtcgtgtgagcgtgtccccctaggctaagaaggatcgttccatactaagcggtgaaacgggcgggaggtccggaggggttggacaaccgtttattccaccgttggaacttattgcgaacgccaccgtttgtaagatagtttggggcaaccccaacttcagattgtggcgtcgtgacctcctcagtaagacaggtcggattctgatgataccgtacagaaagtcaaatatgtgccgtctttactcggccatctcaggagagcgccggccttagattcgagcccaaagttacatcccataaagccggacgtaggggttcaaccccttccacaccttgtgacn

SEQ ID NO: 707142 - DNA, 434 bp, Homo sapiens
  misc_feature (273)..(273): n is a, c, g, or t
accttgcacgtcatcatagacttcatactagagagaagccttacaaatgtgaagaatgtgaaaaagttttcagtcgcaaatcacatcttgaaagacacttgaggtgacgttgcccttgtttttgagaatgccctactgtgtaagtggtagtgttctttctttttttttttttttaagacggagtctcacctgagcgagcctctgcactggccttatttattattgttattaattttttgtttttgagacggagtttcactcttgttgcccagnctgcaccgcattgccgcaatcttgtttcactgctccctctgtcttgccgccctcgcgcttctcttgccccagtctcccacgtatcttcttctttcactttcctcccaccccttcttgcttcacctcctatctatcctttcctgccccctctctttcttccc

SEQ ID NO: 707143 - DNA, 563 bp, Homo sapiens
tagacctgtacgtcaggtcatcagagcagttgtaggtatcgtctgttttctgagaacaccaaactttcttcaagatgttgatcaatatgactagtgctcagaaaaaaaaaatcccagcactttgggaggccaaggcaggtgaattgcctcagctcaggctggtcttgaactcctgggttcaagcactccacctgccttggcctctccaagtgctaggattacatgcatgagacatcacacccagtgcttctttttttaaaaaaaccaaacagctttgtgagatctttattttattttattcatgtatttatttaagagacagagtcccgctatattgaccaggctggtattgaactccaggcctcaagcaaaagttaccttctatgtatagaaaaattaaacaatatttcttcttttctgagacactgtctcactactttgcccaggctggagtgcagtggtgtcatcactgtctgcagcctcaaacttgggatcaagccatcctcctgccttggtcccccagtagttgggactacaggtgtgcaccaccacacccagctaac

SEQ ID NO: 707144 - DNA, 1255 bp, Homo sapiens
gtgacgcgtgggaaacacaaatggtcggatgatgccggtgcagcagtgtggtgggccctggggtgccctgtgtggccctgggatggggaacctgtggtggcttcctgctggaggtttcgggcagtggcatctgtgggccggggtctgcgtgcgtgtgacggggcctggggccatgaggtcgcggagcatcgctgtgaggcaatggcctgaggataatggagttggatgccctgtacaccaatgttgggccgccttgtgtcaacggacatgacagatcaagtccctggaggagatctactcgtcttctccactgtcccaattaacggaattcacgacgactcattgactttcgttcctggtgggcctcatctcaacggcattgaaggtatttcggcaagacttatggccatgtgcagacaggcaaggacacctgttaccgggacccaggctaacaaccaggggtatcaaggggcaatacatgtatggctactcgggggacctacgaatggggcccacccgttcgggtccttggctgttgttacaccgtggcattccaatgggaagtggtgagcacaacccggaccaattcccatgttagtgtgggcaattacattccgtgtggccaaaggcactccttccaattcagatcccgcccggttgctgcgcaagacaggggctaccttggggaggaacacacgcggactccggggcaaggcgacccgaaggagtgtgtgtagcgcgtttgcaaacggagttgaccaatgggcccaggcattggctgcgatactgattggacatggggtcagcaggcacgtttcaatttacggcattggcagacccaaagtgggttagcatacttttgtgcaatatgatacttctcagaaaagactttggtggacttaaaggaaaaggttggctacaattgactcgggtatgggatattcagaattgacacgttgtagttaacacgacgcattcaacgcaacccgtgtggtgcacattgatcgtcattgggtcaagccaccttgtgagcaaaacatatcgcggccgcagagggaacacagcccgttattggagttggccccgatcgacattaagtgaaccttatacagggtttaccttgtaaagcgccccggaaaccaatactgtggcaaggcgtagcaacattggtgcatttcgacgcgagacggattgtacagccactatataaacggcaagtatacagattgacgacagccgttggcgaccgatgaac

SEQ ID NO: 707145 - DNA, 257 bp, Homo sapiens
cagcaattaaccaccaatgccagctattcaagaaaaagcaaacagcagcagcaacaagcaatgatgcagaaagcaaccacattactccattaatttttgaaatagatgctgtcaactgatggaccgtggcaagattgaaggcttttgtaaaacctatcaggtgaataagcccatgaacaaccagaagcaaaagaaagaaaacccgaaacatagaaaagaatttaacaacaagattactcagctaaacaggtcgacgc

SEQ ID NO: 707146 - DNA, 241 bp, Homo sapiens
acgaggagatagcaccatgcacaccagccttggtggacagagcgagattccactcaaaaaacaaaaaagtgggttccttcttatctaactaatctgtgtggagtcatcggcaaagctctccagagtcacgacacagggatgatctggacaaataagtgatggggagtaatgatgataatcacataactgctaagatccctcattacgcctatataccagcccggtgccctgcctcaggtga

SEQ ID NO: 707147 - DNA, 497 bp, Homo sapiens
cgtcagctatggtgatgctgttgagctaacaggtggctgcaaggctcgagactgcttcaggaggagggctagctgccagagaaagcaaccacatttttttttttgttaaacggagttgggctcttgtagcccaggctggagtgcaatggcacaatctcagctcactacaacctccacctcccgggctcaagcaattctcccgcctcagcctcccgagtagctggaattcacagggatgtgccacaacgcctagctaactgttgtcacttttagtagaaccggggttccaccatgttggtcaggctagtctcaaactcttgacctcaagtggtccatgtgcctcagccttccaaactgctaggataacaggagcgagccaccgaacctggccccaaccacattttttggaggcttgggacttacagcctcacctgctgaactccaggaggcacaaggaactgcagattgacttaactaccattggccagtgatttcct

SEQ ID NO: 707148 - DNA, 102 bp, Homo sapiens
catctgctcactacctcttccctgtgctgttacacagtgtcattgtgatgttaaattacagtcatattcttgcttctctccaaaaaaaaaaaaggggtcccg

SEQ ID NO: 707149 - DNA, 778 bp, Homo sapiens
gaaatggcggatgacgccggtgcagcggggtgggcccgggggccctgtgtggccctgggatggggaaccgcggtggcttccgcggaggtttcggcagtggcatctggggcctggggctctgcgtgccgtggacgtgggcctggtgtgccgatgtgccgcggagctcgcggaggcaatggccgaggataaggacgtggatgcccagtcaccacagttgggccagcttggtcaacggaccatgacagatcaacgtccctggaggagactctatcgtcttctccctggcctattaaggacatcagagatcattgatttcttcctgggggacctctctcaaggatgaggttccgaagaattatgccagttgcagaagcagaccccgtgcacggccagcgcaccacggttcaacggcactatcgtctgactatcggggactacacactgcgccacgtagcgtctcgcgcgtgtcaacgtgctccaagggaagggtgagacaacacggccatccacgtggaggccactcaactccttgggccaaagctcttccagatcagtaccccagatgccgcaagaggcgtactgaggggcaaacaagaatcgcgccaaggccccgacgacctgtacgcttgcacacggctgaccacagggacgcgctctgccggcctcttgactgactgagaacaggacatcaattccactcgaagcccacgggggcactagggcatcagggcttccgacacctgctgcgctaggacagcgtgcctcatggatggaatgg

SEQ ID NO: 707150 - DNA, 332 bp, Homo sapiens
tcttcccctacagttataaaaagaaaaaatatatagaattattccaaaaaaattatttttccattttttattgtggtaaaatacatgtacttaaaatttaccaccttaagcatttttaattatacagttcagtgatattaagtacattcacattgttttacaaccatcaccaccatctatttccggaacatttttcatcttgcaaaactgaaactctatacccattaaagtccatattcttccatcttcccagcccctggaaaccaccatctactttctgtctttgtgattttgactactttatgtatgtcatgtaagtgaaatcatacagt

SEQ ID NO: 707151 - DNA, 86 bp, Homo sapiens
aagctgttaactcaacatctatttcatctttttagctcccttcctttttctctgctcaataaatattttaaaagcataaaaaaaaa

SEQ ID NO: 707152 - DNA, 127 bp, Homo sapiens
cggtccctgggcttagctagagaaggataaagggcatcctgtgaagctcgtgtggtgtttgtttttggtcctgattagaagctgaagctgtctatcctctacccagctaccactggcagacccaggt

SEQ ID NO: 707153 - DNA, 335 bp, Homo sapiens
aagttttcgtggcagaaatattaggaattgtatgcactgtaaacactgaaaacccactagtggttctgtggttcccacgttgtggttttgacaccaggagcatccttgccactgtcaaacgccggagatccgcagatctgtgttgtaacaggacctccccctgaccctgatgcatggcagttgaagaagtctttccgtgtaagcgaaaagacttggaggaaaaggtggagatatgcgttgtatcaacatccttttgctctggaaccacgtagagacttgggagccagttgggtggagcattcgttggatgaggttgctcgggttaggaatatcaa

SEQ ID NO: 707154 - DNA, 126 bp, Homo sapiens
ttttttttactttaaaaaatatctagagatggggtcttgctatgttgtcaggcttgtctcaaactcctagcctcaagtgattctctggtctcagcctcccaaagcgtgaggattacagcgtgagac

SEQ ID NO: 707155 - DNA, 1773 bp, Homo sapiens
ttggtgtgtgtggaggttcgtttgtcgctgttgagatgctgtgcctctgctggctgttacgttcacgttcagtcgctctgcttggttcgctagttacttttgccatgcggtggtcgtctcgctcgtgtttctatgatgtacatcacacctgttctgggtgccgttatgtgttccagacccactcgtctatcttgtggtctgtcttatccacagcgtttgttggtgcgcctgttgtttggtcgggcccattcatgttgttctgcgctgttctcccgtgcccaagtggtttatggtatcaccagtgttccccgcctctcacttgctaacctggttgtggggcaccttcccggtacgcgccttaggatttcttgtggctcccccccagaattgttccagtcgcctgctgggtcgctacttttggtggagtcttttaccaacactccgcttgttggatgtgtctccaggtggttatctcttgtcgttgtgtaattgtggtacgtgatacaatgttgtcatgactgtgggaacatgtttgtgtcgtatgcatacaaattggacgttggttttgtgtggggcgacaaagtagacgcttgttagtgatggccaaacgggccccaaatttggggtaatggaaaggaataaggagccttttttcgtgtgtggcacttcccccctcgtccacctgatgtgtatcctcgggcgcttgttcatcaaaacgttggttgtatagccacattggagtgtccccacacatgtgtgtttcgcctgcatgttcctctgtcaggtgggtgtgtagttgatagtggtctgtctgtgctcctgttttggctgtttccacccccgggtgtgccgcctccgtcgcagaccccccgtcgtgtttgttccccacgactgtcgtttggtcacaatgacctccctttgtgttgattagactcctctcggttggccgccggcgtgtagatgaggcctcggtctcgcgggggggcccccatcgcaggggtggtctccgtccctgtggtcaccccccagctcccggcgcccactgttcgtccccacaccgcttccggtgagaacccccccccgtgggttgtactcctcctgcggtccacgcttgtctttggtgatgcgcctctcatcgcgcaggggggtgaaaagacccacttgtttcggggagaagtgctcccccgccggaggatcctcccaccggggcccccctcatatttttcacccaatatcgcccccctctaatttgtccacgccaccgcgaaatagcaccgccccacagagattgagtttctcaaccgcagccgccccgctcttgttgtcactctgtgtgtaaaaacctctataagttatatagaaaaataaatgagaatggtgttatagccccccccactctgtccccctatatttgtgccacgaacccctcacccaccttttgaccacacacttggtgcacgaagttgggaaaaatttccacccacggggcctcgaggctctgtcgagagaaaacacttcccgttcacgcgcacggtgtcccacaggcctataacccctctggctggcaccttaaattccttcacttatcacgcacgcccaacaccacccgcccccacccccacttttcacccaccatcccacgagccttctcctgcccgcggagctgtaaactggtccacgccctgtatagcgcggaaagggggctctggcacctagctggtaccccctctccgccaggtctttttccccctaaaattctgtgttgccccttga

SEQ ID NO: 707156 - DNA, 1367 bp, Homo sapiens
ggagggccgttggccgggtgcctgcggtgacgtccgcttcagtgacgggcagcgccattgcggccacccggcttgtctgtccttcctgtggcgccacgtcccccagagcgatccgagcgcgtacgcgccagagtaacgctagtccacctgattcctgtctcgtggtctcttgtgcgtgcttgcttctggagcagcgctcactcctcttatcaagccagaaagctggctgggtcacttatgagtcgcaaaaaatcacacacaacaaagtacatgacacacgctgtgcagcgagggctgcctcaagacattacggcagcgcacacgcaggcataatcatggtgggtgcgcatacagagagttctctgtagccgttcacatggtgtgtaaaatgcggtgcaacatgtgagcaaggttagccctatccctgtacaagaggtcgcgcaaaccgggggatgtatcctaccaggaactcgaaagagcaacatagctagctacttgcggagacacgcccacgtacaccgcaccgatcactcgattgggacactttggcgcaccagaaaaccgttctagattagtcgttgaaccgccttttcggtgggcaacccatcatcgaggcaaaccccatcaattggcaaacaatttgcacccaacccacgaacttagacaccttcgaggcaatacgtgcaaggtgccacacgccagccaaacaagctgtgggaatctcccctggcagtttcccttcgagacgcaacttagagcggccgcacgaatcgggaggacagccacatttcgctagagaacgaacacccacacgtaaacaggcaaaaagcaaggttcaagccaaaacaacaagttctccaagcggcaagaggccctatttggccttgcggaaggggttatatcgggccaggcccccaagacaaggcccgcgtacttttaattatggggggacgccctgtaacccaggccaccctgtcccataggtcggagtacaccaagacattacaacttgggtttatcaccccctggccacttttgccacatcatgtggggtcgagacattagaacccttccgtgggaaatgcaagagggccagtaggaggccccataggagggtaccccccctagacaccaaggagtgggacacatgcgccaaactttggcttccgaaaagttggcccccaacacaagggcattcggttaattaatttcacttttaccttaatgcaagcggcaccacaggggtcgtagaacggtttcgcacatctgtgtcctttatcccccctttcgcggaacggcgcaatccaactttgccgcacataatatacacatctctcatcagagcaaaatatatacaccggagcccc

SEQ ID NO: 707157 - DNA, 139 bp, Homo sapiens
tagtaaatgtaacaccatataggcccacaccacaaaaatccatgagaaaggttcaaattgaacaccatatgtgcattattttcaaatctgtgttgtgagtatatactagtatctgcgttgtaccagatacatgcacaaa

SEQ ID NO: 707158 - DNA, 995 bp, Homo sapiens
gtaacctttctaagctccctaactcgaggccagaacccacagctgaccttacaagcttgctccctctatgacacaaatgaatagaccggtaggaggagggtgcacataacccttacacctacctctgccagaaaagtgggggctgtactgtggactgcatcggatgatcttccttagtgctacttctttcagtgtaccctgtagcgacagcgtctagatatctgacatgccttccgttgacatctgtaacctcttcacccctttccctcttctcttgagcctaggctatctgtggtttgtcggtacgaagtgtgattactatatagcttaattggtattgatgtacaaatattgtggggttaggggcttcaaagccggcaattttcggataacaccatagtcatttcagccgaggtaccgatgagaacagaagtgtactgtatctatgggtagtctagaggccaccattgaagcgattgacatttagggattcatctagcctgctgcgagaaagtcgaaaaagatggacgaccagaggtcttaatgatggaaagtacaagctacaacgagaagcgagaaccgtgaccattgcctgagcaatgctgtcgaaagcccgagctgtctaaattctgtctgaagcgggagcacatgtcatctactgcccccctaatttgcaggcccacgttggactgcagtcggtttttcgtaccccatggcggcacgaaaagaccgcttgaaaactgtgtactcatacttctatgagggaggtgaagggtaatgaccccatcgaaagcccccagggcttcacaatctctgaaatgctgttgccgtgccaaatctgtctaccccaaagaagtcacggttggggagcggaagctgacattcgcatgccggggcgaagagcatcaaagcgggcgcgctgcaacaaactgcgagttgaaggcctaaacccggagccgggagacaatccaccttcggtttatctaaacagtcgt

SEQ ID NO: 707159 - DNA, 474 bp, Homo sapiens
  misc_feature (22)..(22): n is a, c, g, or t
  misc_feature (110)..(112): n is a, c, g, or t
  misc_feature (119)..(119): n is a, c, g, or t
  misc_feature (122)..(122): n is a, c, g, or t
  misc_feature (230)..(230): n is a, c, g, or t
  misc_feature (233)..(233): n is a, c, g, or t
  misc_feature (243)..(243): n is a, c, g, or t
  misc_feature (249)..(249): n is a, c, g, or t
  misc_feature (253)..(253): n is a, c, g, or t
  misc_feature (302)..(302): n is a, c, g, or t
  misc_feature (333)..(333): n is a, c, g, or t
  misc_feature (377)..(378): n is a, c, g, or t
  misc_feature (384)..(384): n is a, c, g, or t
  misc_feature (427)..(427): n is a, c, g, or t
  misc_feature (454)..(454): n is a, c, g, or t
  misc_feature (469)..(469): n is a, c, g, or t
  misc_feature (473)..(473): n is a, c, g, or t
gcatcattctctgtaatctatnagccattataagcctgaataatttcagtctcttcagagcaaaacatagtattttattccactagcagatgtttctccaataacaatannnaaacctnttnatcctcatatactacccactctcatccctgaaacataagttgccatattccagtggtcctgaattttaacatgttttgctctacattatttcaagaaatataatgagntanagctttgatnatgagnttanctcctttgctgtaattatacttactctataattcaaactatttagctgnagtcagttaacgagtaaaaaccgcggatacngctcaaactgctcttaacttctttaaatgtttactgttctatcnnaactcngacccaagctgcacaggtgtaacttgaggcactaacaatcttnctaccagacgttattgttttatgtgtncttaagctgggcgcntatnc

SEQ ID NO: 707160 - DNA, 231 bp, Homo sapiens
caagccctgggcggaggggctcagaggaaccagccctgcccacacctggatctcagacctccagcctccagggctgtgggagaatcaatgtgttttgtttctaagccgcccagcctctggtattctgtgacagcagcctgagatggactaagacatctcataagaagaggagatgacgacacagacacccacggaaggaccactccttgatggcgcagcggagaagacagc

SEQ ID NO: 707161 - DNA, 1007 bp, Homo sapiens
agcggagtgcgcagaggacgcggcggaagcatgttccaggctcctgagctggagcctgggccgaggcttcctgcgtggcatcggggcggcggtgctcgagggcttgctccggctgcgccttgctcccggaggcctggcaggacgcgtccggaggccctgagagtgcatcgtgtgccgccactcccggaggtcgcgccgcaacggtccggggtccatggacctgctgccagccttcgtggcagacgcatcgccctgagttcttcgaggtcccgcgtgctggacagatggatggatgcgcagcatcagtggacgtcccgcacagtgtggccgctgctcgaggacgcgggctggacgattgccgaagggcgagaagaatcattcctagcctgtcgtgaagctgagccatggtttgagccattattgacctgactagagccaataaggaatgcttgaggttatactttccgcagttgatctgctcgttcgatctcgcctaatcacgtactgatttagcacacgaatggccattctaccttacatcttagttgactttgactcggccaacttatgcacttttattaccggggctcgaagcttgcaacaagtgcttgatacacatcgttttgtgtaagagcgaactacattgacggttcacctctccgttgcgcaaggggcgctatgcaaggcacgcgcagtgagcaagtgccaatacatctgacaatttcccctataagcttggcccaggtagtctaatggcatgtgcgcacgaaatcagcacaggacaactttgcctgtctgctaggcgtactgaagtttcttgccatttccaaacgttcttagaagcgcaaaaagaactttgagaacgaggaacacacgggcctttatcggggaagaaccattatgtcaggtgggaagaagaaaaggccaaattattcccaacttccttctttggggcattttgccttaagaacgccttgtgtctccgggtaacccttcttgtttctcca

SEQ ID NO: 707162 - DNA, 303 bp, Homo sapiens
tgcaatggctgtgactatctggacaatacagtggtagtataaagaaagagagaacacagccgggcacagtggctcaggctgtaattcccggacttgggaaggccgagcagatggatgatgaggtcagattgagaccatcctggctaacgtggtgaacacccgtctctactaaaaatacaaaaaattagccaggcgtggtgacacatctgtagtaccagctactggggaggctgaggcggaagaatcacttgaacctgggaggcggaggttgcagtgaggcgagattgagccattgcactccgg

SEQ ID NO: 707163 - DNA, 1065 bp, Homo sapiens
ggatgcttcctcgtgtgtgccccaccgcagccgccgctccctgagtgctgcgggagtgccctgctgccccgcggctcgctgtgcgtgggagtggcgcgatgcgaacctgcgtgggcgatgtgagcctgttgcctgatgcctgcttgaagatggatgcttgggtgctgcctgtgcctgccctggcctgcggctccgtgccctgctgtgatctgcctcctgctcctgtgtcttctgcctgtgcccctggctccccctggcgatgattgcctgtgtgggcgatggatttggctcaggccaccctgctgggaactcgtgcacggggcattcttcggcccaaagagtggacggttacaatccttgacttgggacgaacgaaacgtaccgttgacgctactttcacagggcaaaatgcttgacacgtgacaccactagacttgctcgctacgagttgggtagcaatcaggctgagagccgagaaggttttccgccgttttcgagttacgtctgtggacagacgccgttaacagctaaggtacgggcggttgacagcagtttctccgctttggccagctcgaacttccacgcggcattacagtgcgtgtggcacccgccgtgaaagtttattaacccgttggggcaagggtgcacgtcgacacggcgggtcttagggcccctagacgagacgcgaccagaacgagagagccagccgaggttggttccccgttgccacgcgtggtggggcgcaccaggaacgttcatttacgggacggaacctcggttacgagccagccgaaagctatgggtttggaggtggccccgactcagacgcggcgcgccggacagcgctctcggccgacctgtagacgacaggcagtcggagtcgctcagcaggaggaacggataaaacggccgcgacgaggtcgggtcagaacagcagagcaccagaggcacgagctcattcgacgagcgacagtggcggggtgccccgcaagggagcgaccaagtggggcggcggtagacgagtcagaacagcggagtgtcggaggatagcggagcgaagcacgg

SEQ ID NO: 707164 - DNA, 100 bp, Homo sapiens
ttttagcgggactttgcgctgatccatacagatatcgtggcttgctaagatatgctctatgtatttcatccaatttgtgtgggggtgtgcgtgtgtgtgc

SEQ ID NO: 707165 - DNA, 343 bp, Homo sapiens
  misc_feature (55)..(55): n is a, c, g, or t
tccccaaagttgggtttttaaccaaaaggccctgggcccgggcagggcccccaanttttttttcccatccaggagcccccaccccaatttggcctttttatttttatttaactaaaaaattcttttccccccccgtaggggcccccccttttttttgggggccccataaacaaaagtgggcggggggttttttttttgccccccccaaaaaaaatttccctccccccaaaaaggggggctggcccccccggcccaggttattgggttttctcccccgtgtttttcccttttttgtgggtggggttttcttttttttgaataaaaacccctttttccctggtta

SEQ ID NO: 707166 - DNA, 390 bp, Homo sapiens
  misc_feature (234)..(234): n is a, c, g, or t
  misc_feature (247)..(247): n is a, c, g, or t
caagtcttgagctcccccatggagtttggagtgccccccacacttgggccggtcaacctgagttgtactgtccaacctgtgggttacaattacatgttagacagtaacctcccaagccgacttccatgggcagaatttagtttttgtcttctaaccaattgtatttcatctgggtatttgattgccagataccctgtgctggttctgctctctagctgctaccattgctgtaanggccatgtgaaangggggatgggaaggaggcaattgtttgctgaatgttgcaatccttgagccatgcttagcagaaggaaacctttaaaccacctccccttccccaggttatatgaagccactaggctaatataaaccttatagttcaaataatga

SEQ ID NO: 707167 - DNA, 869 bp, Homo sapiens
agcgggaaggcgctgagctgatatcccagcaatgccagctctaaaggaagggtgtgaaagcagggcagatagaggctcccctgccctcatccaatgaactttctctttaacctctaagtttattttttaaacgctaattaaaggcttatgtgtatttatctgcatttatctatatacatatatatagctatctctcatgcttaagccaaacaattgggtattttccctttctgataaagttgaaaaaatgtttttgagagtcgtagaccttttattaacaccttatgttaaattcattctgttagacgtctggaggattataacagctttggaggaggctcttttattaactgtcttattccaccgaaaggggcatcctcgtttgaatttgaagaggtttaacagtaatatcattcatcctttcgtgtttccgttagatttcaagtcctctctccaggtgtgatggaaggggagaacttaggtggagatgaaagggagtcgctcttggttagaaaattggaagaattcaattctcagggagagtgacactgaatgggaacgagagccaagactgtgcagggaggaagaggcagaaggaaagagaaggaaggagaaatagcgccggtctcctaaggtgttgaaggcagagctggaatcttgtggaacacagcctggctgttgttacagatttaacacccacagattgtattgtcttacctcatctagtccgtcacacagcaaaacttggactacacggagatggggcttggggatctaatcaaaaatgagatgtaccttaccacctggtgctctgaaaaaagcctgctgtttggggcacattttgtaatatgtcactattatacttaaaa

SEQ ID NO: 707168 - DNA, 786 bp, Homo sapiens
gaaaaacttccatagaatctcttctcgtgaaagttttttctgctggaaaaaagggcatcgctgtagcaggcgtaagatgtctcagtcactgactataagtacaaagggcccagaagctggaatctgaagacaaacatggctccactacattttactctcatgcctgggaaacattacttaaaccagaagaatctatgccctctttacttcacagtgctacagagaggattacatgagccaagtatatgtgaagacccagagaggacagttgacctgacaagggacatatagctaggaaatgaagctgctaagtgattctaggcctgattccaaggtccttacgtctttctatttatccacagcatatcagtgcaggagattatgatttagagcgaaatggctgttaagagtggatacaaagcatcaaaagtggttaagacttgaaagatgttttaatatcgatcaggggcatgcatttcttgcaggtctcacctccgttgtaatgataaacgaattatttgcttaatttgtcttaaaaatcccgttggtaaaaataatcgacgtttaaatggatatgttgcaaagcacgaggcatttgcaaatttttgtcaggagttaattttcctgatgacacctcattgtgctaatgcacaatactgcccctatcagcacagagtattacaggctttccagtcaaatgggagcaagcagtggagggattgaggtagtatttataccttaattccctgggctgcaggttaacccaggaaatatctcaatatgaaa

SEQ ID NO: 707169 - DNA, 575 bp, Homo sapiens
caacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgttttggggaagccctgggctcgctctagagtctctttcctgagtatggctgctaagggatcttttccaaacagagtgagggtctttttaagagggaggcccatgaggccatccaggaaagggcctgcctcaacgtgggatgggagcctgaccaaggaggacttgaatgattcggtttcaacctgttccagaggtgcacacaagaaggtggcgaaagcccccgtcttgccccctaaaccttatcccgttcctttttgccttacaaataacaaagtgcaagcctgtaaaagatcttaaatccaattgggatacttttttaaacaactgttataaaccggaagaaac

SEQ ID NO: 707170 - DNA, 859 bp, Homo sapiens
  misc_feature (208)..(208): n is a, c, g, or t
  misc_feature (223)..(223): n is a, c, g, or t
  misc_feature (232)..(232): n is a, c, g, or t
  misc_feature (306)..(306): n is a, c, g, or t
  misc_feature (502)..(503): n is a, c, g, or t
  misc_feature (527)..(528): n is a, c, g, or t
  misc_feature (538)..(538): n is a, c, g, or t
  misc_feature (545)..(546): n is a, c, g, or t
  misc_feature (563)..(563): n is a, c, g, or t
  misc_feature (569)..(570): n is a, c, g, or t
  misc_feature (582)..(582): n is a, c, g, or t
  misc_feature (592)..(593): n is a, c, g, or t
  misc_feature (613)..(613): n is a, c, g, or t
  misc_feature (688)..(688): n is a, c, g, or t
aaatcgcataggtgcgaggccgggggtgcttgttctttttgtctgaatgaatttaaaaggaaatatataataaaaatgttaaccagaaggtaaacttgagtgtaatgtcagacagacacacttttccaccagtgtatttgaattttagaccagtgaccctcgtttgtggcattcatgcaaacacatgctgagggctttgttcatctgngtcatcgtgtccaanatttcagtncatgtttgtagcacagattttggaagctattcatactttctctttttaaaactgtatttcctttgtgtttcaancagttaactctaaaaccagagatgtctatgggcagctctctcgtgatgtttgtctaatgatgttaaatttcagtctcctgtgtgttttatattttcttgtctgtatgttctacagattctattgttgcacacaaagcgtgggcatatgaaagagaacatgttttcgagaagccattggggcctaagcacatgcggnnggacggtctttcaaatgcgtgatnncagagaatcncttcacnnctttgctgaaaagtgangctcanngatccagcaccnatgttcctcnnctgacccatcctgtctatcnttctcagttgagtttttaaatctcactttgggtttcctttgtgaagttggaggcgaagtttattaatagcctaancactaccccacccccaactaggaggaacctctgttttcaagagagatgcctgtcctgtgcttggatagtcagtcaattattcgtgtatgaaaccaatgtacaaatcaatgtttgaaaatactgatctcagactttctaagttaaaattttaacattttgattgtttgcata

SEQ ID NO: 707171 - DNA, 209 bp, Homo sapiens
  misc_feature (57)..(57): n is a, c, g, or t
  misc_feature (117)..(117): n is a, c, g, or t
  misc_feature (140)..(140): n is a, c, g, or t
  misc_feature (146)..(146): n is a, c, g, or t
  misc_feature (174)..(174): n is a, c, g, or t
  misc_feature (184)..(184): n is a, c, g, or t
ctggggcagggtggggggccatgttcccagaaccaagaacataaaccctccaagggntctgcttgatatcccaagttggaagggaccccagatacctgtaaggactggttgtttctnttcggtggccttgagtctcagantttttnggggtctcccatgatttggggtgatttntcaccctctntccttcccccagcacaaagcactgg

SEQ ID NO: 707172 - DNA, 411 bp, Homo sapiens
agagcacccccttgcggccctaatattgagggcttaaaatcacaagaagggtacttcaacactggctacgcattgtgcttgtcccagtgctagagcgtaggaatagaccctggcgtccactgtgagatgtacttcagctaccagagcatcaagtctctgcagcaggtcattcttgggtaaagaaatgacttccacaaactctccatcccctggctttggcttcggccttgagtaatcggcatcatctccgttaatggtgactgtcacgatgtgtatagtacagttatgacaagcctgggtccatacagaccgctggagaacattcggcaatgtcccctattgtaagccagtttcttcttcaagctcccggagagcagctgctactggggttacaccatcatctatgagacc

SEQ ID NO: 707173 - DNA, 191 bp, Homo sapiens
ttttcttcctccaaatgcgcagggtttccaaacatttgcaccattttaggaatgttaaaaaaaaaatttaactttgaatggttttaaattaaagaaataattaagtcaaaatatccacatgtatgtagttcttttggatgaccgaataccttaaaatgaactaaataactgaaataaagtgttaaaatgtt

SEQ ID NO: 707174 - DNA, 771 bp, Homo sapiens
aagggctaggagcaggctgggtgttaatcggacgagggtctatggtcgggtctctgcgtcagctgctccggactgagctcgggtgtatggggcctgtaggaaccggctccggggtcccgttaacgggccgcccccacagcaccccgggctggctgtgagggtctccacttgatctgagaatggctacctctcgatatgagccagttggcgtgaaattggtgtcggtgcctatgtggacagtgtacaaggcccgtgatcccacacagatggaccacttttgtggccctcaagagtgtgagagtccccaagtggaggatcgcggtggagtgaggccttcccatcatgcacagttcgtgaggttgtgctttacttgatggcgacttggaggctttttgagcactcccaattgtttgtcctggactgatggacgtactgtgccacaatcccagaactgacctgggaagatcaatggtaaccctggtgttaggagcattgtatgaccagtgacctaaggacatatctggacaaggacaccccaccaggcttgccatgacgaaacgatcaaggatctgatgcagccagtgtctaaagaggcctagatttccttcatgccaaattgcatcgtacaccagaagatctgaagccagagaccattcaggtgacagtggtggaacagtcatcttggtgactttcggcctggcagaatctacgtaccaatggcacttacaccgaggtgtcactctggtcgactccgagtctctgcccattgac

SEQ ID NO: 707175 - DNA, 288 bp, Homo sapiens
aatcagcggacggtcagattcagcaggacaaagtccgatacaaactgggctagacaagccaggcaacaaaaatgcccacgatgggacggtggactggaagatggtccatctcagggtgaggggttcggagcccctcatgcctgacatggcatgtgtatctctgctcttctccagaaggcaccaccacaggtgcccacttctggaacgttctgtctcctgctgctctggtctccacaaagccggtgtcctgagtttggtcctcggcatcccgcttgctggaaatggtga

SEQ ID NO: 707176 - DNA, 629 bp, Homo sapiens
  misc_feature (104)..(104): n is a, c, g, or t
  misc_feature (228)..(228): n is a, c, g, or t
  misc_feature (238)..(238): n is a, c, g, or t
  misc_feature (275)..(275): n is a, c, g, or t
gagtccagatcaaaaatggcggtagttggtgtgtcctcggtttctcggctgctgggtcggtcccgcccacagctggggcggctatgtcgagtggcgcccatggngaagagggctcagttcgcatgtggaagactctcaccttcttcgtcgcgctccccggggtggcagtcagcatgctgaaatgtgtacctgaagtcgcaccacggagagcacgagagacccgagttncatcgcctanccccaatctccgcatcaggaccaagccgtttccctgngggagatggtaaccatactctattccataaccctcatgtgaatccacttccaactggctacgaagatgaataaagagaatcttggtaccactacccgggcaccagggaccaccagacactggtttggaccgttactctgcacatggaggcagaaaaagtatatgggaccttgagctcacggtgtctgttgactttgtatcgagaagtgatgacgtggtatactggtcgtcacgcatcccttatgctgtgtggcaggagatggcttagatgaataacttagatttgagaatgacaatgttagaagaagtaaggaaagttgttgaggatgtggggggccaaaaaaatttataaagg

SEQ ID NO: 707177 - DNA, 316 bp, Homo sapiens
atcgcaggttgtacttcattaaattccttaaacagatatttatcgctcggtggctcacgcctgtaatcccagcactttgggaggccgaggtgggtggatcacgaggtcaggagattgagaccagcccgaccaacatggagaaaccctgtctctactaaaaacacaaagttagccaggcatggtggcgcatgcctgtaatcccagctactccacaggctgagacaggagaatcgcttgaacccgggaggcggaggccgcggtgagccgagatcgcgccactgcactttacctgggcaacaagagtgaaacttgtctc

SEQ ID NO: 707178 - DNA, 110 bp, Homo sapiens
tagtgatgacttaagattcaatagctatgcaaattgggctcaacagaaaatcaagctagatcataattagaactcgatctgttctttctttacaatcctcacaaactcct

SEQ ID NO: 707179 - DNA, 367 bp, Homo sapiens
aagggtttttttgccccccctgacttcaaaggtaaactttgtttgggacatcaaaaaggggggtttgggggccttttggttttttaaaaatttataaaaaaaaaaaaaggtgggggttgccttggggaattccccggggatttctgggcccatgggggggattgtttaacccggggccctgggaaaatgggggtttttatgttccttaaacagggaagggaacagttgggccacttttaaacaaaggaaataacccggtccggattggttctggtccatttggttttttttttttggcaaaaacaaacccggcttcccccttgggggaaaaaaagattttggggaaaaaggaaagtttttaatttca

SEQ ID NO: 707180 - DNA, 107 bp, Homo sapiens
cattccagggatgggaggggccagggatcatgttttactcatttttgtatcgccagcccctggcaaagtgtttggcttatgttatgtgaataaatgaatgcttgcca

SEQ ID NO: 707181 - DNA, 490 bp, Homo sapiens
ataatactaatgcatattaattgcctttttattatcaagtgcaatgaccttatgcaaaatgtgatttttaatttaagttacgacgaaggagcattttgccttctcgtggttgcatggggttttcgtgcacaggtaaaacatataacaccaacattcaaaatcgcctcatcttgttgctatagtactctaatggtgatgtgtaagaaattaaaatttctgggttttccagtttgtactgcggaggtgaagaaagagctggggattggacatcctctctgggacaatcgttatacttcttacctttctctgagctgtcaccgattcggtcttacaccaaagaacaagaataacaacaacctttggagcacacagggtgagggcagaacacgtttcaaacactggacttctgagtatgactccttgccaaaaacactgaagtactgaacgtggcaatgattaatgctgaagtattgcctttgacagtgatgac

SEQ ID NO: 707182 - DNA, 335 bp, Homo sapiens
  misc_feature (45)..(45): n is a, c, g, or t
  misc_feature (75)..(76): n is a, c, g, or t
  misc_feature (119)..(120): n is a, c, g, or t
gccggccgcccgagcagcagaccgcggcctggcgctgcatttcgnaacgcaccgccacctcgacgctcttgagcnngttgacgttcttggtttcggtgcgggttccgaactgcggtgcnnacggtttcagcgacacgttggcgtcgcagcgcatggagccctgatccatccggacgtcggatacacccaaggtgcgcaacaggtctcgtaaagccgtcacatacgcccgggcgatctggtgcccgtctcccgcgccgacgatgggtttggtgacgatctcgatcaacggcacaccggcacgttgtagtcgatcagcgacgtcgtcgctcgtgaat

SEQ ID NO: 707183 - DNA, 87 bp, Homo sapiens
ctagaagattcagcaaagtacttttgtgctcttggggaaggccttccccgggctgtcggtactcgtagggacaccgataaactcact

SEQ ID NO: 707184 - DNA, 1491 bp, Homo sapiens
  misc_feature (1491)..(1491): n is a, c, g, or t
ggtaacttttgcaaggagaggggttgggtgatcgccatcttagggaaccgatgttctcgtccggggcgcactctgggcgcgggggaagctccatgtgaatgaacgccacagtctggagagtgggtgcacgagtggtcctcggggacgctcgcgcgagcagtttcacgcgcagggcccagcggggccagcaccgcgtgcgagcgtcgcgattcatggtcaggccgtccggccgctggaaggaggtgcagatgtgtggaacttatggcctaccgagcagagctattgaatggcagctgctgttgagtcttctggctggaggtcttacagtgggtggtcgtgacggacacatgactgatggttgtgctacctgggtattgtgtacgtgagaaatggagccgtagtggcgatgtgtgggacactcgtcgaatatagtgacataaggggctattatttgtcataggggatgtcgtcaagtttcataagggtatgaggaggcagggacttgggttgttctcgttgggttttttcgcgattatatccagagacttggggcttcaccgaatcgttatctctcatttgggcgttacattcacaagtggtcacggtggacaatcgtagtgacatggtctaatgcggttaatatatattgagagacgcttctttgtaacagagtcgtctggtaagtagtggaaattatttgacttctgagacggaaggggacggaaaacgtaaactattaattcttacatagagtccgtctagcgaatacgaaacatgaaatagtaacggtggagatagctcctacttggacgcatggttggccttggaatttctcctgttagtggtctggggacaatatgggggcccgtggtgcctttcgcttaatggggaaataggcttggacttagaagcgggtttcaggacaatttgcaaaaaaactcctcaggggcacggttttatttggctctaatgtcaccttttttgggagggtgacttgggcaggagttgcctgaatacacttgtttttaacgggcatagacacagggtcgcttaaatagaggacaatttcctaaacaaaggggggaggtggggaaggccttccctttctggtggagtttgcatgccacccggggtttgcgcaatatcccagccccttattggaccctgacaacagcgttcccgcgacctggtggcgtttggcgaccgcgcgtcacgctggtgtggaaagcggaacactggtacaaccgcggttgtggggggagagcccgttaaaatgccccccggggggttggcaatgtgttccaaacggacggagaggagcggatggggatggtacgaccactctggttcgccaggcggacaatcaagcagggaagcgagcttagagcgagacaggtatgaccacacagcgcgggagcatcgtggcgaccactaggcgagatagaaaacaaagagcggcgggggagtctgacttcggagacagcggcaacn

SEQ ID NO: 707185 - DNA, 103 bp, Homo sapiens
gtcaagaggcagctaccagtgaaaaatagtgactatttccaagacattaggcagtggggaggtcagcgagaagtcaccacagaaagctcccactacctaaatg

SEQ ID NO: 707186 - DNA, 110 bp, Homo sapiens
gcattacactcatatcaaaatttcagtatgatcttcccggaaaatgtctgggacaaacactctaccactccatagcaaatgatgagcatggtcgtggcgctagtggctca

SEQ ID NO: 707187 - DNA, 459 bp, Homo sapiens
acgcaagcatggttactacatcatgactgcatcatgagatctatgaatcctgaatagatgcaattgtatatcatgctttttccctaattacaggctataactattatttttctgagacagagtctcactctgtcaccaggcggagtgcagtgtgcatcttggctcactgcacctccgcctccgggtcaaacgattctctgctcagctcctgagtgttgggatacaggtgctgcaccatgccagctaattttatatgttaatactgatggggttcaccatgttggtcagggtggtcttgaactcctgacctcaagtgatctgcctgcctctgcttcccaaagtgcaggaaaaatttttaaaggaaattaaagatgttgctctagtgaacacacaaattatgagaaaacagaatagccttattgctgttatagagaaagttttactagtctacttagatga

SEQ ID NO: 707188 - DNA, 795 bp, Homo sapiens
  misc_feature (357)..(357): n is a, c, g, or t
  misc_feature (374)..(374): n is a, c, g, or t
  misc_feature (426)..(426): n is a, c, g, or t
ctggctaaggaggtatggctggctgaccacgtttgaggaaggctacgtgctgagcctggccctggattcttctgtctctatatggagtgagagacaaaacaccagaccctgagggcagagccctgggctagacctggctggtcggaaccagctctgtgggctcaggaggttcctttaccacgtgggctctgggcttatggtctataaaatggtgagggtggctgtgggagaatatttagttcagccctgctaatgtttaagtgccttctgtgtatcaggaatcaggctttagggtatatcagatatgtcagttctaacatcctgttgttttcatctgcgcccatttcctcttccctntggttcatgtctctctnctgaatcttttctttgcttactcctcactcttttccccatcccacacccctnttttctgtaacaaattacttttaacaaataatatgtgttcaccattggaaaaacataataaaacaagaaggaaacaaaaatcacccaaaatcctaccatgcacgtttcatgcattttgtttcctgggatttgttgtcatcctgtatggtgaggtgacagatacagacaactgccttggaagaagagtttgttcccgagaggaggggacatccatgccatgcagggccacacggggaagcagccagggtccttcaggaggcagaagtgaaggagaaagcaaagcgcagcgccttagtgtggttttcgtggaacggagtaggtgaggcagggtaggcaagttaggatacagtagggagaggggatcctcta

SEQ ID NO: 707189 - DNA, 409 bp, Homo sapiens
  misc_feature (24)..(24): n is a, c, g, or t
  misc_feature (40)..(40): n is a, c, g, or t
  misc_feature (45)..(45): n is a, c, g, or t
  misc_feature (47)..(47): n is a, c, g, or t
  misc_feature (105)..(105): n is a, c, g, or t
  misc_feature (130)..(130): n is a, c, g, or t
  misc_feature (132)..(132): n is a, c, g, or t
  misc_feature (165)..(165): n is a, c, g, or t
  misc_feature (184)..(184): n is a, c, g, or t
  misc_feature (209)..(209): n is a, c, g, or t
  misc_feature (231)..(232): n is a, c, g, or t
  misc_feature (261)..(261): n is a, c, g, or t
  misc_feature (271)..(272): n is a, c, g, or t
  misc_feature (309)..(309): n is a, c, g, or t
  misc_feature (328)..(328): n is a, c, g, or t
  misc_feature (333)..(333): n is a, c, g, or t
  misc_feature (336)..(336): n is a, c, g, or t
  misc_feature (354)..(354): n is a, c, g, or t
  misc_feature (356)..(356): n is a, c, g, or t
  misc_feature (382)..(382): n is a, c, g, or t
taataactgattggtgtccggaancgctcaaaccgacagntcggncntgataaagagatccgggagaagaactggcattgtgagatgtttggatccccgtgccgngggacaaggcgaaacagtgcagccngnctgggaacaggatcctgtgaaagctgatgcccntgtgccctgagagctgccnctcaatccctgtcccaagccggcangctatggcattaatgtcaccanntgttctcaccctctaggccctgtgcctgnaggtgcctcnncagccgaccagcagccaccccgcctgcttcatccgcntcaggagggtccggtgagnctgcngcngtggttaaggaagtaacncnggcgtgtattaaggaattttaaacgnaataaaatgtatgttggagatacggtt

SEQ ID NO: 707190 - DNA, 112 bp, Homo sapiens
agtctctacacgatccccccctcaaacccagtaacgatttgagtggttacgctaggataaaggattccagcgaacgagcgagtgcatgctgctctaggatcctctacgcaca

SEQ ID NO: 707191 - DNA, 135 bp, Homo sapiens
tcactcgcttgtcgcgctcggctccctcgatcacggcgcccgatgtgctggccattcggttctctttacactgttcttcagtcagctcgtctggtttcgggggtcttagctttggctctcctcgctcgctcttac

SEQ ID NO: 707192 - DNA, 384 bp, Homo sapiens
gggtaaatagatgtgcttcatgctcactgaagagttttttttgatacacagggtcactctgtagcccacgctgtggtgcagtgtcatgatcacaggtcactggtgtctcaacctcctgggctcaagtgatacttcaactctagactccccaggagctgggaccacaagcttggaccaccacacccaggtgaattgtggtgagcatttttttttggggtgatgggggtttgccaagttgtccaagcttgtctcaaactcctgggctcaagcaatacacatgtctcgggtttccgagctgggattacaggcgtgagccaccattcttgggcctgaaggatttgggaatgcttaaggaattatgatttattttacaccttggctggt

SEQ ID NO: 707193 - DNA, 197 bp, Homo sapiens
aaaaactgatttcaaaaactcgggctgctttgggaggtttaattacttcaggggaaaagaagacaaaacgagtttttcattcggggggaacttttttctttaattttaactgatttaaccccttttgggaattaaagaaatgataaagacttttatgggagatttccttatcccagaaataaaatatttcccaatga

SEQ ID NO: 707194 - DNA, 971 bp, Homo sapiens
gccgtgcgcgcaagccggatcggcagtgctgcggggaggagagaggacgaggcggcggcggcagcaggaggtggggtgaccgatcgcgccgggggccgaagaggaacgccgccccgctgccatctcgctccccgcactgctcctggctgcctggccccacgcttgctcgcccacaggatcgcagctgggttcacgcttggagctggtgcggaggcaccgggccctgagctgggtcggaggtcctctccgcctgctgcgcgccccaagcagagggatccgccgcggatgaacctgctcccggactggagtgcgccctgcggcctcgggtgcagtccgatgctgccagatctcggccttgatggactgcctggtgtggaccgatgagggaaggaacgttgccccccagacccaagaggtgacccctgagccagccccggaatgacccttgagacctggaacaatgcggctggccttgcatgttctcattccatcctgctgttcggaggctgcagggcctccatcctcgttcatcagccttgcagggaccctacgggagctcgacacaccacaagcaggttgcaaggaattaaaggttcaaacatcaggccaatggcaggcccaccaacagaccttccacacaaggcgggtcccaggactggttgacttgaagggaagcccagctaggagagtggtcaactcggggatttattccagtgggggcccccgaatggtggccggcaatcttgggcaagctgctttgacccaggccttcaaagcccccgggttggcataacggggaaaaccccagttatttgacagggcttcccgcacaagacgcctggaacgccagacttggctcattcaacggaaaattgcccaggatcgtgagcggacaattcccgggggcaaggaggcttccggaaatgcgccctttacaatcctgggccgggagaaccctgggaaccagctag

SEQ ID NO: 707195 - DNA, 118 bp, Homo sapiens
gaagacttgctcccctgtcctatgaaagagaatagtttggaggggagaagtgggacaaaaaagatgcagttttccttgtatgggaaatgtgaaaataaaattgtcaactctttcagtt

SEQ ID NO: 707196 - DNA, 442 bp, Homo sapiens
taacctggcgacccttttccgacatacacctgaggtgactcttagtactgcttacattattggctaaaactagtcatgtggccacacccctgaaaagaggtaggggtagattaagggatacagacattggataaacaggtaccttttattttggaggaggaggaggttcttttttgttttttgggtttttttaaaatttgagacagagtcttgctctgtcacccaggctgaagggcagtgacatgatcttggctcactacaacctccacctcccagactcaagtgattctcctgccttagcctcctgagtagtcaggactacaggtgtgcaccaacaggcatgcaccaccatgcccagctaatttttttttttttttttttgggaaacagagttccgctcttgtcacccaagctggattccaagggtgcaatctcagctcac

SEQ ID NO: 707197 - DNA, 465 bp, Homo sapiens
ccattacagagattatagcgcggaaaatattctattagtgtgattattgggtatttgacaatgtcttattaattacatagcatcttttatatctataacctcagctttcagctcctcattcattccttaattcatttacttaattcataattaactttttaaggaatgaaactggatgacagaggagtgaatagtgtatcaattccaggttcagaccttgggttgggctttatttttcattccttacttctcacttcctacctgtctaccttgcctttttgactgactggtagagaaaagcattcaaaactgataatagaaaataggacgtactatgggagtcttggcattggcagccatctcacaatctttctgctgctgttcactttcatctatttgagcatgagttaatctgcacagacggcactgaatctatattggtaagaccatgttgcatggtctggg

SEQ ID NO: 707198 - DNA, 354 bp, Homo sapiens
cgtctacatagtgttctaaatctggtagcagtggtctttgggagggaataaactagggccatcaataaaattcccttagtagaaaaaattttctgaaattaaataaaattctggctaggtgtggtggctcatgcttgtaatgccagcactttcggaggccaaggcgggtggatcacttcaggtcaagagttcaagaccagtctggccagcatggtgaaaccccgtctctactaaaaatacaaaaattagccaggcatggtggtgggcacctgtaatcccagctacttggaaggctgaagcagaagaatcgcttgaacccaggaggcggaggttgcagtgagccaaggttgtgcc

SEQ ID NO: 707199 - DNA, 451 bp, Homo sapiens
  misc_feature (387)..(387): n is a, c, g, or t
ttttttttttttgatgattatcaacagaaactttatttctcatcggttcaggaacaatcggagggtagatggaaatttttttttttggaaatatggagggaggaaaaatcctccgaaaaggaagggccatactgattgagaagaaaaacattttcggtgcaaaaggttaattctcaagtggggaatgccaaatgaagggttgcttacatgggggcacaaaattccaaatcagccacattgggttgaggtgattatgagacgcagttggttttaatgaaggaaatttagtaccactttaggctacaggaccctggggttcttctgtcagaggattggggttcaggtttcaggctttagggtgtaacatgggggggcccaatatgctantgctggtttcatggggatgcccagccctccccaaggcccctctttttggggatctcctgacgag

SEQ ID NO: 707200 - DNA, 100 bp, Homo sapiens
  misc_feature (46)..(46): n is a, c, g, or t
  misc_feature (58)..(58): n is a, c, g, or t
ggatttattgtcctttcaagtttaaagaagtatataatctggacanagtgtttcacanaattcaataaaaattacaactggttgttctaaataaagttga

SEQ ID NO: 707201 - DNA, 172 bp, Homo sapiens
catgaggggtagcgctgggagtttagaagtggcctgcccttaactgttttcactaaacagctttttctagggggagagcaaggggagagatctagattgggtaaggggaccgggatgtcaggaggcaaagttttttgtgtaactgtgtacaataacgattaaagtcgaaaaa

SEQ ID NO: 707202 - DNA, 137 bp, Homo sapiens
ttcttgcccgaaactgccgtggtagggcgaagaacattggtaaaattgtagctgattttggcctgtagtcaggtttgatgacatggtgacacctactacagcccatgcttggagccaatgtttacccacattcaata

SEQ ID NO: 707203 - DNA, 163 bp, Homo sapiens
aggaaacagctgatgacaagctctagtaagagggactaccacagcaatgtgtccatccagctcactaccagcctcactatccagacagcatgatgattttggggtcattttcaagccgctcatccagctcatggtagctcatgcctgtcttgcagcacatctc

SEQ ID NO: 707204 - DNA, 1049 bp, Homo sapiens
  misc_feature (448)..(448): n is a, c, g, or t
acgagcggtcagggaggtgtgcgtgttggtggtgtgccggcacgtccatgttgatggacggtgttgttggggaggactgacatgggagtggatggttgcgtgcatgttgtagctccacgcgtgaggcgacatagagtgggttgcaggaggtgagcgtgccgtggcagggttcagggcgtcctcagaaggacggttttcgcggccatacgtgcaggcagagcctgcggcgcatgatggattgctgtgtcctgcctcgtcacgtggatagactgaccaccgaaagacgtgcatgacagtcgtcagacgcaacggggaaaagtatctacgattcatgtcctagtaggaccacaagttacccaccggtggggtcctcgctttccttgtggccttgctggtatggaaagtcgattttcgacgatgaatcatggtcgtgagtagtccaggggtntagcgtacaaagatgggcatcgaatgatacctgtcgtagtaagttcacccgggtcctatgaaagcccaggattaccacgcgaagtattcttgttctcaatagtcaccccttcagatctggacgtggtgaatgcattctcgccgcaaggatgatcttcagatgatgtctgtgatactttactgtgtgaggatgaaccagtgtgatgtccttagggcaagagagttgggggtgcctcccgaggtgagagaccttggacagttaggtaatcgagattcttgatgggacgtgtatctcatgaatgaattggacattatgggattcatccaagctttctcaaagaaggattgagtgaggccttccgagattgtcgggagttcggaatattcttgaggctgtgggaggcagggtctgaaaagcataaggtcgtcggggattgtgttgaccggttttccaattgggaaaagtggggttccacaaagagggaattgggttagttaaaccaggtggggggggggaatgtaaaagggggggcgcaagagaggcgaatgtggaggaaaagtttacaaaagcgggataatagaaacgagagaggaggtataaa

SEQ ID NO: 707205 - DNA, 239 bp, Homo sapiens
caacatagcatgttcattgtatacgtagaataatcattattattattatgataagatatacctgaatgcaagacttcgaaacctatccttccttccctttcttctacccttcacttacctttcttctttccttcccttcactttccttctctccttcccttcactttcctttcttccttctccccctctgcctcttcctacctcctctacctttctctctctcctctttcaatttcaca

SEQ ID NO: 707206 - DNA, 710 bp, Homo sapiens
  misc_feature (487)..(487): n is a, c, g, or t
gctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggcagtggatataactcctttagaacaaaggaaattaagtttgtgatacccatgcagtggttcaggactgtggaaactcatggatttgacaaaaacacaagcagaaacaatgtgtatcagcgttaaactgctttatcaaatgtcagcctggatactatctataaagagatggtcactcaagctcaacaggaaataaccagtacaacagctaatggctcatttggatgctatcaggaaagacatggtcatcctagagaaaagtgactttgcaaatctgagagcagagaatggagaacatggaaattggaattagaccaagttangcaagaattaatgcatgaaaccagtcgaatcagagcagataataaactggatatcagttagaaaggagcagagtaacagatatgtttacagatcaggaaaagcaacttatggaaacaagtacagaatttaccaaaaagggatactcaaaccaaaagtttatttcagagaccagtataaaatgtgcgctgaaatggcttctttaaaaacactgatggatctaaa

SEQ ID NO: 707207 - DNA, 1155 bp, Homo sapiens
  misc_feature (932)..(932): n is a, c, g, or t
gctcccaccggaaaactctgaggacatgaatagtcgccaggcttggcggctcttgctctcccaaggcagaggagatcgttgggtttcaaggccccgcgggcatttctcgccggccctgcggagaggtgaggcaaggtgtcgtgtcatcagattgcctgagtgctctctagcggaggacgatgcccgtgggggtcgggcggcattgttcggagcggatcgggaatgagaaggtggccacgcccttccttccctgtattcacgccttgttgcatggggcgactgcctggtggccttggtttgaccacgggatttggccccaagttcggccccctaaggggggcgggaagggggatctgagggaacagcaactgcgcctttcttgttatttgaagggtgaacctttgggaaggtgccatgggctctgcgcccggctatctttactacaagaccagtttgtttcccggtttttgcgggtgacaaaggaggggggctagttggctctgcggtccagggagcccaaggggtaaggattttctttcatgtaccataaaccaaggggggcatatgaagtaggcgggccgaggggattattaacgttcctttagaaaccagaggggaaattaaacttttgtgataactcgttgcgttgtgggttccagggactttggaaaacttcattgggattttggacaaagaagcataagggcaggaaaccaagttgtattcaaggggtaaactgctttatcaaatgtcagcctggatactatctataaagagatggtcactcaagctcaacaggaaataaccagtacaacagctaatggctcatttggatgctatcaggaaagacatggtcatcctagagaaaagtgactttgcaaatctgagagcagagaatggagaacatggaaattggaattagaccaagttangcaagaattaatgcatgaaaccagtcgaatcagagcagataataaactggatatcagttagaaaggagcagagtaacagatatgtttacagatcaggaaaagcaacttatggaaacaagtacagaatttaccaaaaagggatactcaaaccaaaagtttatttcagagaccagtataaaatgtgcgctgaaatggcttctttaaaaacactgatggatctaaa

SEQ ID NO: 707208 - DNA, 930 bp, Homo sapiens
  misc_feature (170)..(170): n is a, c, g, or t
  misc_feature (707)..(707): n is a, c, g, or t
gctcccaccggaaaactctgaggacatgaatagtcgccaggcttggcggctcttgctctcccaaggcagaggagatcgttgggtcgcgccttgctcgagcgaacgggaagagaaggtgccacgccctcctcccggattcacgcctgtgtgctgggcgacgccgatgcctngtgccccgactttgcccatgttcgccccaaggtggcgagggactgaggaaagcactgcctttctgttcttaaagcgaacctttgaaggcctgggcttcgcgcgcggttctttctcagccgtggttcccgttttcggtgacaagaggctagtaatctcgtcaggagccaacgtaagagttcttcactaccacaaccaaggagggatatgataggcggcagtggatataactcctttagaacaaaggaaattaagtttgtgatacccatgcagtggttcaggactgtggaaactcatggatttgacaaaaacacaagcagaaacaatgtgtatcagcgttaaactgctttatcaaatgtcagcctggatactatctataaagagatggtcactcaagctcaacaggaaataaccagtacaacagctaatggctcatttggatgctatcaggaaagacatggtcatcctagagaaaagtgactttgcaaatctgagagcagagaatggagaacatggaaattggaattagaccaagttangcaagaattaatgcatgaaaccagtcgaatcagagcagataataaactggatatcagttagaaaggagcagagtaacagatatgtttacagatcaggaaaagcaacttatggaaacaagtacagaatttaccaaaaagggatactcaaaccaaaagtttatttcagagaccagtataaaatgtgcgctgaaatggcttctttaaaaacactgatggatctaaa

SEQ ID NO: 707209 - DNA, 1025 bp, Homo sapiens
  misc_feature (65)..(65): n is a, c, g, or t
  misc_feature (67)..(67): n is a, c, g, or t
  misc_feature (71)..(71): n is a, c, g, or t
  misc_feature (100)..(100): n is a, c, g, or t
  misc_feature (193)..(193): n is a, c, g, or t
  misc_feature (269)..(271): n is a, c, g, or t
  misc_feature (273)..(273): n is a, c, g, or t
  misc_feature (281)..(281): n is a, c, g, or t
  misc_feature (290)..(290): n is a, c, g, or t
  misc_feature (299)..(299): n is a, c, g, or t
  misc_feature (305)..(306): n is a, c, g, or t
  misc_feature (317)..(317): n is a, c, g, or t
  misc_feature (324)..(324): n is a, c, g, or t
  misc_feature (333)..(333): n is a, c, g, or t
  misc_feature (338)..(338): n is a, c, g, or t
  misc_feature (340)..(340): n is a, c, g, or t
  misc_feature (352)..(352): n is a, c, g, or t
  misc_feature (357)..(357): n is a, c, g, or t
  misc_feature (364)..(364): n is a, c, g, or t
  misc_feature (369)..(369): n is a, c, g, or t
  misc_feature (389)..(389): n is a, c, g, or t
  misc_feature (406)..(407): n is a, c, g, or t
  misc_feature (409)..(409): n is a, c, g, or t
  misc_feature (412)..(412): n is a, c, g, or t
  misc_feature (420)..(420): n is a, c, g, or t
  misc_feature (426)..(427): n is a, c, g, or t
  misc_feature (433)..(433): n is a, c, g, or t
  misc_feature (436)..(436): n is a, c, g, or t
  misc_feature (448)..(448): n is a, c, g, or t
  misc_feature (469)..(469): n is a, c, g, or t
  misc_feature (494)..(494): n is a, c, g, or t
  misc_feature (502)..(503): n is a, c, g, or t
  misc_feature (506)..(506): n is a, c, g, or t
  misc_feature (512)..(512): n is a, c, g, or t
  misc_feature (517)..(517): n is a, c, g, or t
  misc_feature (540)..(540): n is a, c, g, or t
  misc_feature (546)..(546): n is a, c, g, or t
  misc_feature (558)..(558): n is a, c, g, or t
  misc_feature (569)..(569): n is a, c, g, or t
  misc_feature (572)..(572): n is a, c, g, or t
  misc_feature (574)..(575): n is a, c, g, or t
  misc_feature (577)..(577): n is a, c, g, or t
  misc_feature (597)..(597): n is a, c, g, or t
  misc_feature (621)..(621): n is a, c, g, or t
  misc_feature (646)..(646): n is a, c, g, or t
  misc_feature (689)..(690): n is a, c, g, or t
  misc_feature (700)..(700): n is a, c, g, or t
  misc_feature (748)..(748): n is a, c, g, or t
  misc_feature (765)..(766): n is a, c, g, or t
  misc_feature (949)..(949): n is a, c, g, or t
  misc_feature (970)..(970): n is a, c, g, or t
cgacgtaaaataacaggctcaactgtgtctagcctttaactattaatgggggtccccctaacttnanggtnaaccgacagcgagaccaagtcaaacgtangtacatcaatcttaaatggtttcattaagagctatgtgaattctgtcagtgcattatgaggaacaatgtctaagaggatattctatggttgtntcacaggttactactctgttgtatatccaggctggcccatatatccacgtaacaaaaacacttctctctttctcannntnaattcagnaattctaanactgtctgnaataannaccaaaaaggnacagcanaaaaacccnaattnanttctttaggacnaaaanaattcangaaanaaaaaacccaaaaaccaacnacaaacacataaggctnnanttntaaccaanaacaannaggtanacntctatattaaancatttcagaaaaaaaaataanaaatagcaaaacactaacacaaaanaaaaaatnnccnaactcnaacanaaaaacacaacttaagtaaaaanaagcantatttgcagganaccacaagagnacntnnantaagtaacctaacccatgtntcagcttctaaatctgcaaaatgngcaaggtacagtagcacatttttangtgattcttagtaactccagtagccttcattagttaaaaacannattatttttngcatgctgcttcgactctcaatatctggttttccctgtctttttggtntactagttccccaaatnnaaaacagaggagtaactaggggatctgattttagaggccttaattttctgttcatggactgttaaaagtaaaaccaaactttcaaaagggataaacctaaatatttacttgttatcattagagagggaacatcaaatgctgggacatcattactaaccaatagcatcagacactggaattaantggataatcacaatggtcgtnatgtatacaaagacatatataccactttctagtataaatttttcaaaaaatacaa

SEQ ID NO: 707210 - DNA, 644 bp, Homo sapiens
  misc_feature (24)..(24): n is a, c, g, or t
cggacgcgtgggcgaaccacgcgntccgcctcttttagatcctaagtctcttacaaaagaggagtactacaggaagaccctagaggaaggggacatccgaggctgtatactgggggaggccggtaagaaagacgtctcgattaggggaacggggttgctagaagcagagctggttacgtcgttaatggttggtacacattcggagggtatacgcatggtagcggacgggcaatgttagttaaattagagtatgaaatgaatggaggaggaaaatggcacgggaaatggggaccagggaagaaataccaccaccccagtgggtagcagaccaaaacaggacagtacagcgcactaacaccaaggaaccccacgctacgagagacacaacatggagcaccacccacacgaccacccgccaggcaacatcctgtcaaaagcacaccattcggcgcctacaccaagcccgcactatatcaaaaaccaaacccccaccaacccacgatcaaaccaagcgagcgtgcgcacgagaacacgactgatccccaccgcccaacacccgcccccgatcacgccgccacacgcccgacctcccaccgcggcccctctaaagaaaccgaccgcgcgccacaaccaccagacaacaa

SEQ ID NO: 707211 - DNA, 1061 bp, Homo sapiens
ctgacgcttgtctgccgaccagggattcctcgccgagacgtcatgcctacaattccagcatgtgactagctatttgtaatactttgacccctattatactactctgttctgctggttcaccatggcgccctcagattttacattagacctctgacactgtacctcccagctatcaaactgtctccgctacgctgttctacgagccacaatgagaacgaaattaaatcttgggtcgcatgacccgcaaaaatagtaaatcgaaagtgttttgatggatgcgctcgcgatcgggatcgatcacgctatcttcccgaatgtctcttagctggtcctgaggcttggtatccagctaataaatatgaaccttagatttgtccatctagtgcaatgtttcgtggattaaatgacaagcccagtttgtaccccgttttttggtggcaggtcagagatgctgctggtgccttgcaccgaaaggtagcttgattaatatccctctgtgggggatgaaaacgatttaatgtctatgcgtaatgttgaaaagagcagagtcgttctgtttgtgattgagtatcaggactgcacgcatttgagaaaggcatgagtctttcctcatagactagcattgcttgacatccatggctgtcacctgtgggttttgtaatcttttgccaatcaattcattaaccacttggtggttggggttgactctgatttatggtgcaaatgtagatggtggatccgtcgaccagtgtcggtgtaagagtttgaatggcggattgtgcgctgatggcgtataggctaacgggctttgagcaacaacttggttgtctgcatctcagataacgtgcgtcatcttttgagccagggagttgccattatcctcttaagtaaccgcttaattttcgtgaagaagctgaatactcccggcggttttgaggtttttccaccccttaaacgctggggccccattttacaccgcctggggccccctttgtgttctcacctgagcccagaaatataaacggcctcacaaaaacgataaccccgaaaaaccccacgaa

SEQ ID NO: 707212 - DNA, 1669 bp, Homo sapiens
  misc_feature (1199)..(1199): n is a, c, g, or t
  misc_feature (1214)..(1214): n is a, c, g, or t
tctgagcacgcgattgataacagagatgatctctgttgtttagcctaggggagagcgatagttggatgcttgttttctccgggagcaaattaatttttgttttagcctccccgtcaagaggggggataattctgtgcgctgtctttgaataacaacgatctgttgggggggggaattatcccgcggccccgccgttgaccacgagatatgcttggggccgccctcctaagtctcccgcgaatgttagctggggggaaccaagccccccccggaggggagaccctttctccctggggaccaacaaagggctcgggaccctcacccgtggtggagaacaacgcctacacctgcggcaagagacacaacaaacattactccggggggtttttgggaagagaagtgcttttcacacaccgaggccacagcacgcgccgcaaagttcttaattcccctatgaagggtgtgtgaaccctcgtgcgtgggtgatatgctccgtgcgccctataggtgagctccctctacggtccccccctgtggcgatggtgctacacacaccaagaaccccatcccccttgggggttcttaggcctttcttttgatgtgtaaaaatcggggttgttcttcttaaatgctccacacggggcgcacgaccacattttggaagagaagttccaacactcgtgtgtgttttttctcccgggaaaccctgtgcccaccgcgtaaatggaggtataaagaacttgtgggggttgggtgtgtttcccaccacacgcgcctctcgagtgttcccacgaacaattgtggagagactcttgtgacacccttttcccacagaaagcccctcgtgtagaattctctgggagaacacacgctgtttctctctcgcgagattgggaaagaagcgttttaaacaacacacacgggcccaacacaggtgggagagcacacctcacaggcgctctgagccgagagcgcccctctgtcacccacacagtgggacaattgggagagagccccccccgggtctctgagaaatactctgtcacacacagagggcacacagagatcgtctgctgagcagggtgggagagattctgagggggtctttttcgcttgctctgtgggcctctcgtgctttcttctcactctggggggccccgcgcgctcgttgtccacttctatactctctcacgcgaganatccacgcagaaagngagcacacactctctgggagactttacacgcgccccaccacgcgagttttctctcgaggcgctgagaaggtgaaagaatgagccaccacattcacaaggagaagaacccttttgcgcccacagcgttttgcacaggagatgaaaacacacgtgtctccccgcttggcgttcttcacattctttctcacaccacagaggaggagccctgttttcccggaacctggtgtgctaactggttcacgcacgcttctgcacgaaaaatgtgcctccccttgtggctgcctcacagctcgtaacctttggcctgaaagtcccacgcacttaaatggcacagcccctcaatcttccaagttttgtgctcccctttacctaatagcttcctgcctccccagcatctgtgactcctgctgtggcccaccaaacccccattaccattattaaaaggttttccaaac

SEQ ID NO: 707213 - DNA, 372 bp, Homo sapiens
gatgtgaaaacgagagtgtcattgatacacagcttttagatttacaagatgaaaatgttctgcagatctgttgtacaacaatgtgtgaatatactaaacactgctgaattgtatacttaaaaaacattaagatggtagattttatgttatgtacttctttatcataattttaaaaaaacttaaatgtagctgggcacaggggcttatgcctataatcccaacactttgggaggttgaggtgggaggatggcttgagcccaggagtttaagaccagcctgggcaacatggagaaaccccatctttactaaaaatacaaaattagctgggcatggtggtgcatgtctgtaatcccagttacttgggaggctgag

SEQ ID NO: 707214 - DNA, 381 bp, Homo sapiens
  misc_feature (3)..(3): n is a, c, g, or t
tanacggtcatcaaagcaagggaaagccatgcgtgctgggttggctcaaatctgttactgcaagaattcttgtatcaccaccaagagttctgtatgtgctatttataacaatcccttcaaagccatcacctaacttggcttggaagtccatagtccacatatgtatttcaaggtgagagcgctaagtatctctgagaaccagacagtgcaagtttgttcatgatgcagggtaactcaagaacttacaagttcttttcctaggtttcatgtaatcattgaatctatcctctagactgaaggagtggcattccgtgatttcaacgatcttttgctgtgcaagaatgataaacttgggtagcattgctgaccaagacttcgatg

SEQ ID NO: 707215 - DNA, 725 bp, Homo sapiens
gatgaccaagaagaggaagcctgtagtgaagtaagatcgtgacgccgtgcatcttcctaggcgtggccgagggatgtgtgaggacctcacgatctcaaggagaacacgttcgacgagtgcagatagaaaaaaagcgtttccatgaaacgtgacgtgacaatgggcaatgagcgcctggtaaggccgacaaagatcggccaacaccaagcgacaaaggcccgcctgatcaaggggggtagcttcagtagcgacactggttcgcaacgggaggcgggatggactgtctaccaaaaattcggcgagcgtggccggagggtagtcactacgtgaaataagcgtgttgtccaattcttgggattaccgccacatggtgaagctgccttaggagccttttcgggggcgattgacccaaacattcgccccgtttgtacgtcaatcgattggcgagaaaccatcaaggggccaagtgaattacaagtctgaaggtgacacgtacgtcggcgaactccaccaggggtgggttggcccagacacgctggttgatcaccagcgggttccacgtacgtctctttgttagtcgcaagtgtgttgagataaccctgtggtgggcgctggtgtacacgcggaaagcagtgcttctgagtcacacaaacacaggttacaggtggggcctgggcacagtgctgtccactagttgttcccactcctcctatttcgatgcaacc

SEQ ID NO: 707216 - DNA, 1282 bp, Homo sapiens
tggatgggtgggatcgcaaggcgcccctttttctaaagcctttcccgcgggccatcttacgaggcaggagtgcggcgtgggaaaaagacaagcgtggaattctctcaaaggttgagtggtccgcagcgttgaggattcatacggtggtctctctgggttccccgtgggtgtgtggtggtggtgatggtggtggaggagagggccggcggcccatataaattcacctttcttgagagcctcatggaaacagggacccaggaaaagaagggggcccccaaagtgccccgaagggacgttgggaccaacggccaccctgttgaaagaagaggcgtgtggccccccctatcatttctttgaagagaattttttctctccaaaaagagtccgaaggggcgcacgagggttacgagtgagtgatagagacctcctttgagccggcccgggaagtgtgcgtattcaaccagtggcgcccccgccggaaagccggggttcaaagagggggttgggaaccacccccgcgccggcccacaaggcgcgacacgaggggaccgtggcgacgaaaacaatcacaggctacacacaaaaagaggtggcgtgaacactgggggggaacgggggaagacatgtggccctgaggccccgatcatgcgaaacagcgcgcggaagctgaggcccggcacgcgggaagaagagaagtgagtgcccctgggaagaggaaaaaaaaagttaaacgccgcgggtaacaggggccccccgaaaatgcccagtgcgaacctgggaagaaaatcttcacacaggggagtacctccccaagggcctgagggaaaaactgcagcaccatgggaccggaaatataccacaagatcacataagccaagggagggatacgaggagaaatccacgcgggggcacaagaaaacaaagagaggagtgccagccggcggcaaccacatgaaaagaccaggcgtccgcagaagactccccaaaaacgcggttgtttgcccacgccccccggagagaaagctgtggaacatcaccgagaggaaaaaagagcgaccaaaaagaaaaaagaagaataaaaaatagaataccaccacaagaacaagacggacactagaaaagaaaaagcacagacacacagataacacgccgccacacacagcaagcagacacacacgacaacacaaccaagtaagaaaaccaacacaagacaacgacgacaagcagtagacaacagaagaaataccagcacacatcctcgtagcctgctgtacaagacaca

SEQ ID NO: 707217 - DNA, 465 bp, Homo sapiens
cgacagagcgagactctgtctcaaaaaaaattatatatatatatatccgccaggcacggtggctcacgtctgtaatcccagcactttgggaggccgaggcgggtggatcacgaggttaggagttcgagactagcctgacaacagtggtgagaccccgtctctactaaaaatacaaaaattagccgggcgtgatggcgggcgcctgtagtcccagctactcaggaggctgaggcaggagaatcgcttgaacctgggaggcggaggttgcagtgagctgagattgcgccactgcactctagcctgggcaacagagcgagactttgtctaaatatatatatatatatatatatatatatatatatatatatatataaaatatatatttttagacagtttatatatatataaaatatatatatatatttctaactatgggcttgaaattagtaggacataaaaatgagt

SEQ ID NO: 707218 - DNA, 497 bp, Homo sapiens
  misc_feature (57)..(57): n is a, c, g, or t
  misc_feature (204)..(204): n is a, c, g, or t
  misc_feature (351)..(351): n is a, c, g, or t
  misc_feature (369)..(369): n is a, c, g, or t
  misc_feature (378)..(378): n is a, c, g, or t
  misc_feature (406)..(406): n is a, c, g, or t
  misc_feature (426)..(427): n is a, c, g, or t
  misc_feature (434)..(434): n is a, c, g, or t
  misc_feature (438)..(438): n is a, c, g, or t
  misc_feature (453)..(453): n is a, c, g, or t
  misc_feature (465)..(465): n is a, c, g, or t
  misc_feature (473)..(473): n is a, c, g, or t
  misc_feature (475)..(475): n is a, c, g, or t
  misc_feature (488)..(488): n is a, c, g, or t
gcgccgacgccgccgccgaaaggcccacaaaccgggttgcaagtgtttaaagcgcancccgagcccccaaaagagtaaacccaaatccaccgggcgccagtccccggaaggagcccccaggcggaccgcctgccacaccccgggcccgcccccccggggccgcaccagccgggccaggcccatgacggaatcccccgtgcagcnccccagaatgcaagtcaaacacgaatcgcctgaggcccccaggaaccaacacaaccccgaagcccccaaacacaaacacacgcccaaagccgccaaaagcgaccacaggacaacccgccggagccccccgcatgcgcagaagaggangtccaaacccggcacaancggcacgcnaaaagcccaccgcaccccccccacccancaaccgccgagccaccccannccggaanaccnccaaacccaccgganccccccacaagngaaagagnangagaaaaggcagnacccccccc

SEQ ID NO: 707219 - DNA, 848 bp, Homo sapiens
  misc_feature (188)..(188): n is a, c, g, or t
ctcacacaaccattgacgcactgctcaagaactacgggctgctctactgcttcacgaagggcattggacaaggtcgagacattcccgccgatggtgcagtgccgctctgtagagggtagctgtcgcttctaggtgcccggatggcatcctgtgaccgaccccttcccagtgcctctcctggccctggnaggtgccactccagtgcccatcagccttgtcctaataaaattaagttgtatcacttactgcctcgcaaataataaaaatttctagccagtcaaaaaaaaaaaaaaaaacaaaaacacacaaaagaaaaaaaacaacaaaacaaaaaacaaaaaaacaaacacatttctagcccacacccacgcgccccccccaaaaacacacctctaccaacacacccacacatgacgagaaggggagcagcgaggcccccacaaagcagacagaaagaaaaccactgtgcacacagcacgacgtggtgtcctcccagagaagacagcaaccgcgaggcggaagacaacacagacggcggcgatgaggaggacccccaccaccaccagaaagagcaaacaacgccgcccgcgcgggaccaccacaccgagcgcgcgagtatgatgctgaaagcaaaaaacaacacccccgaaaagagcagagaacacaccatagaggaaggcacccaacacagacgaggcgcgcaggacacacaaatcacacagaacgaggaggatcacaccaccaaggcagaggaagatcccaacgaaaatcaagaaaaagataacacacccccccccgttgagggagctaaccagcgcgcggaggcctcagcgcggcctacatcacac

SEQ ID NO: 707220 - DNA, 386 bp, Homo sapiens
aactcctacctggagcctgacagtatcagaatagctaaggcagctaggggttgaatccagtgtcaagaggattacagagtactcatacatatgctggtagggaatctaaaatggtgccgctgtattggaaagcagtccagcagtttctcaaaatagctaaacatagaattacacagtaactctgagtaacatcccacttcaaggattgaaagagaattgaaagcatatgtctacacaaaaacgtgtacataaatgcccataggagcattattcataatagccaaaaagtggaaacaacctaaatgcccatcgatggacaaatggataaacaaaatgtggtatatgcatatgatggaatattattcagccaaacattcaagccgtca

SEQ ID NO: 707221 - DNA, 364 bp, Homo sapiens
tatagacttaatcagacatagacaaagcaggatcaatggacttccttgtgattcctattacaatctcactctctatatatctttattgcctgagtaagttcttgttctttccgttctctatgccgggccttctcctcaaggatttttccatagctttcgttttcttgaaattgggatctgaggggtccaaatagaacaagtgggaagtgtacattgcctgaaaccgtgcatcgttaacatttacctcaaagtcatcctctattaattccttctttttcacgagctgctttttcttctttttgctcagattctggtgctccacaatcttgtagtaattgaagtgtttcttactgtcctcgtcctc

SEQ ID NO: 707222 - DNA, 1012 bp, Homo sapiens
  misc_feature (222)..(222): n is a, c, g, or t
gggcgtctgaaggcctcggtggaaaccgtggtaccccgcctcgctctgggagtactaggtgccggtccctgtccttccccgaccctggctcacatgtggcggctcctgtcaaccctccctgactaaccccttactacggtcatggttgggcctaccaagtggctgggagaggcagaagcaacaccttgcctattcaaattaggaaagccactaagagaaaancaggtagccccgcagtcgtagtcgcgcccatataggaactccgacctaggtcatccgctctgacaggctccgaggagtataccctaactctcgctcggagttcatcgtgagttttgcagtggcctggtccatgcgagaacggacgtacgtcggaatgtcccgcttgtgcacctctatgtgtactgtccaacggtggtcgacgtttcgtgtgcaaccatttctgttacttactagcaccgtacagagcggcatcgttgtacgaccgtttagttgtctacatgtgaacgacgcggatacttcggagggggctagcgggaactgaggtagccctcatgtcgtgggtgatacgtcagtgatttggcaagacaagcgactcgcgtcgtaccccaccggtgtgcgcacctatcagtctacagggcctgtagatggtatcactctactcgctagagaatcggagccatggggcagcatcctcgcggcgcacacacattgtggcttgatgttccaggtcatggggttgtctgaacttagcttggagtaaatgcgttgagtgtgagtgggtgaagcgtgggaaaaggggaggaggtaaacgcaggaggaggaacagaaatattgggatggtgatacatggcgcaaggatgcagaggaatagcacatggatgtgtggctctagtctggacaggtagagttcaaagagttagaggtagatattacaagtcaggtggagaaaagattaattggcagcgtgagatgagtgtcccaagagagtagaatgacgggaggatgggga

SEQ ID NO: 707223 - DNA, 86 bp, Homo sapiens
atactaccaaaaatgtttggaatggttttggaaaaaattattattcctaaattcagaaggtatctggaaatgtagagaaaagatct

SEQ ID NO: 707224 - DNA, 239 bp, Homo sapiens
tggggaaaagggcccggggcccccccctggcctgggagtccctccctggtttttattttcagaaccccaggctcccctgtgtaattgaaggggaaggaagccctttcttgggttttggcctccaaaccagggtaagggcaggcccctccaaaaggggtttacaccccccaaggcagggggtgcaccccccccctgggagttttttttttatttaaaaaaaaattgttggggacccctca

SEQ ID NO: 707225 - DNA, 102 bp, Homo sapiens
cactagaggatccccagctactaccttatattgaccgatatgtcacacacgtaatttgtccatattttactataccataaatacttactatcactatcagat

SEQ ID NO: 707226 - DNA, 823 bp, Homo sapiens
  misc_feature (710)..(710): n is a, c, g, or t
aaaaaaaaaaaaaaaaaaacagggggaaaggggtgggttagggcaatctttctagggcagaaagaagtacgggataggaagagcataatacacggtttttctcaacagggagcagtatggtacacaggtcataaatggatggtggactggcttaagcccctaaaatatgggtaactaactctggggacaatatggggaggaaaattggaagatggtggatgggtggtaagagctaaatcctcatctggtcataatccagaaaatccactaatatatatatattacataaatggaatatggactaaagttatatggtggagggaaaaaacacagaagacttggcgtaaaagcagttaaaagtcatggcgtctgggagaaattaaggagggagtggggcagggggaccgggtagaggagtgcatttattaacagcgtgaaaaagcccttttataaaatttttatgtggtatttaaatattatgtggcatttcaccttgggaaaaacctaaaaaaaaaccaattaattgtgggaaaaaccctatggagggtgaatctaaacgggaaagggaaacaactcaagagaatatggaaaagagttatttggcctctggggaaagacccaacttggggcagggactggtgggttttccatggggcaagcacttttgggggagcctattctaaatgtgggtgactttaaacccaaatttncccatcctaaatttctcttaacataaaggaaaaccatattccctattcttacataaaaggaggtctacactgtgtgtacattcaacagcaaaacacacacaaaaggggggggg

SEQ ID NO: 707227 - DNA, 107 bp, Homo sapiens
atcttccctgtcttatgaattcgaacagcataccccgcgattcctgcttgcagataccagtaccgactggcgataccagataacaaaccagtaccgctgcataacca

SEQ ID NO: 707228 - DNA, 435 bp, Homo sapiens
tcttgtttcctgcacttccaagtagctgggattacaggcggctgccaccacgcccaggtaatttttgtatttttaaagtagagatggggttttgccgtgttggccagcctggtcttgtttcctgcacttcagcctgggcagcagagcgagactctgtctcaaaaaaaaggaaaagaaatacataaatacattttgtaatgccatagctaccataggcagtgatgcctccagtggatcagggcaaagtaaattgaaaaccttgtggagaggattcaccattccagatgtcatgaagaacactcatgaatcatgggagaaggtcagaatgttaacattaattaacagtggtttggaagaagttgatttcaaccctcatggatgactttgaaggttttaagacttcagtgaaggaaataactcagaagtgcaggaaac

SEQ ID NO: 707229 - DNA, 213 bp, Homo sapiens
gtttggtggctcatgcctgtaatccccgcaatatgttacatagattatagttttctctactcttattaccatcatagttttcatctgagccactataagggagggcacctcagagttaagggtccgctaagactagtgaattcctaaacatgatcctgcccttcacggagcttactgtcactgagataacctgaatatgttacgtctacctgt

SEQ ID NO: 707230 - DNA, 385 bp, Homo sapiens
gggagaaacacgagtcccagagaggtgagttggggttggaagggggaaggtcacagatagcacagggatctccttccttcctttctggaagctcacccgggtgccccagaatacagaggggcagatgtgcagagcagggggtgccagggcagtaagcacatgtgtggggacaggtggtggtagtgaggggagagaggagagatggagaggaaaacagaaggattaagagcagggcctaggagggaggtgagagagaagggggcgttgaggaaggaatgaggacagacaagctgggtgatggtcagaagatggtttgccatgagtcttagagggatctctgctgtcctcacagaggataaagaggtttactgcttccctggaaccc

SEQ ID NO: 707231 - DNA, 160 bp, Homo sapiens
agcccaacttcaccccgagcttgcgcgccgcgagctcagtggtgcctggcatgatcgaactcggcgcgatcaagtcaccgtccagcgccagcggcgcactcgtcaccctgctcaacgccgcctggaacgccgcattgcggctggcgtaccagcccgcgtt

SEQ ID NO: 707232 - DNA, 287 bp, Homo sapiens
cgtcgacgttatttagcaataaaaagaaatgatcagtgaagccatgaaaagacatagaggaaacttgaaagcatattgcaggctgaaagaagccaacctgaaaaatctacatatatgtatgatttcaactatacgacattctggaaaaagaaaaactatggtgacagtaaaaagatccgggttgtcaggggctctgggggacagagggagggacaggtaggtagagcacaggggatttggggggcagggactcctgggctggaggtcgacgcggccgcgaattagta

SEQ ID NO: 707233 - DNA, 367 bp, Homo sapiens
  misc_feature (69)..(69): n is a, c, g, or t
  misc_feature (99)..(99): n is a, c, g, or t
  misc_feature (118)..(118): n is a, c, g, or t
  misc_feature (169)..(169): n is a, c, g, or t
  misc_feature (299)..(299): n is a, c, g, or t
  misc_feature (350)..(350): n is a, c, g, or t
  misc_feature (357)..(357): n is a, c, g, or t
tattaattgaaaaggttcagggtacccacttccaatgagtgtagggaagcaagcagtagtggtgtttanaatatcaaggttagctgctggatgcgggtntcacgcctgtaatcccagnactctgggaggctgaggtggacggatcacgaggtcaggagatcgagacaancctggctaacacagtgaaaccctgtctctgctataaaatacaaaaaatcagctgggtgtgcacgcatgcgcctgtagtcccacctgctagggaggctgaggcatgagaatcacttgaacttgggaggcanaggttgcagtgagctgagatcacgtcactgcactctagcctgggagacagnagtcganctccgtctca

SEQ ID NO: 707234 - DNA, 815 bp, Homo sapiens
agcgcgcgagtagcaaggagaggagccggcgcggcgcgccctgttgtatgccgtctctcccgggcgaccgcgcagacacagaggaggagccacgcgcggtgatgtgttgccgggttgaggaaggccgcaaaagaatgccgatagccaaatgtccggagaagaatccgcagatccgtgcccaacgcggtcctgggtgggaacacatcctttcattggacgagatcaccttgtggttagagcgcccaatgtgtcgtggacttctataaggatccaaaccatataggaaagccttttaaacaagcgttggaccccccagacagttggcccaagacttttttcttttcacatttttgtagacacggcgcgggccaaggatgaattatcattattttcctcaggatattatccaatagattataagtggacaatatcatggtgatatggggtaacattcaatcaaaaaggtttggaggtgataaaggtactccgttggccaatttgtgggaatagtggtggggaaaagtgtaaaattccttatatgtggcgtggagacattaaaggaaaagagcgttgcattttgcaagaggggtggatccgagttttgcaaagaaaggggaacagtttgtggcaaaaatttctggaaatggcagattttggggaatcttgctggtaaaagaacaatcagcatgggggggaaggtttccgaaaggcacacttgtgggcggccggaacaaaattggagggaaacttccacaagagaaaggtttcagcaccggggatgtgaaatctgtcggaacctggggacctggggattt

SEQ ID NO: 707235 - DNA, 749 bp, Homo sapiens
ggctcacaaaaattttttgtaagaagagcgcctttttatcatctggctgcggcgccgcacacacatatatttgagataagaagaagaattataataatataaataaaaagacgtggcgactttacactgccagatggtgttccttcctggaaggcttgccaagatttgtgcccttatcttggaaattctcccagctaggatagccacttatagaagcgtctcccaccctttatctcacctttagccagattaaacttatgggggaaaacttaaatactggtgcaaacaaaattctgggaagcattttacttatctgttaaaaaaaaagggaatcctatggacctgatttggcccaccaaaaataaatcttgcctgtgaccaataaccaatactcttgggaaatttaagagaggatacctatggagtttgatgagctggtattagagggtgacacaatgtaaccgagttacacacacgacagcacataacttcgttttagagaacattcaagcacatagctttatagcttcaacaataatggtaacgttttaaaccttgaaagttttgcacatgaatgaaagcacgtaatttgtacacaatgaaaagcagagattctcttttatatggtttatactgttgatcagaaatgttgattgtgcattgagtattataaaaattagatgtatattattcattgttctttactcatgagtaccttataataataataaagtattctttgttaacca

SEQ ID NO: 707236 - DNA, 400 bp, Homo sapiens
agcctatagcacaagtggaaccctgtctttacaaaagaaaaaaaagccgggtacggtggctcatgcctgtaatcccagcactttggaggctgaggtgggcagatcacctgaggtcgggagttcaagaccagcctgaccgacatagagaaaccccgtctctactaaaaaatacaaaattagctgggcatggtggcacatgcctgtaatcccagctactctggaggttgaggcaggagaatcgcttgaacccaggaggtggagatagtggttgaaacgagatcgtgccattgcacgccagcctgggcaacaagagcgaaactccatctcaacaacaacaacaacaaaaaagccagatgtggtggtttgcgcctgtaatcccaggtactcagaggctgagatg

SEQ ID NO: 707237 - DNA, 708 bp, Homo sapiens
  misc_feature (14)..(14): n is a, c, g, or t
  misc_feature (84)..(84): n is a, c, g, or t
  misc_feature (87)..(87): n is a, c, g, or t
  misc_feature (137)..(137): n is a, c, g, or t
  misc_feature (141)..(141): n is a, c, g, or t
  misc_feature (167)..(167): n is a, c, g, or t
  misc_feature (178)..(178): n is a, c, g, or t
  misc_feature (193)..(193): n is a, c, g, or t
  misc_feature (200)..(200): n is a, c, g, or t
  misc_feature (208)..(208): n is a, c, g, or t
  misc_feature (215)..(215): n is a, c, g, or t
  misc_feature (227)..(227): n is a, c, g, or t
  misc_feature (259)..(259): n is a, c, g, or t
  misc_feature (360)..(360): n is a, c, g, or t
  misc_feature (367)..(367): n is a, c, g, or t
  misc_feature (402)..(402): n is a, c, g, or t
  misc_feature (466)..(466): n is a, c, g, or t
  misc_feature (537)..(537): n is a, c, g, or t
  misc_feature (545)..(545): n is a, c, g, or t
  misc_feature (572)..(572): n is a, c, g, or t
  misc_feature (577)..(577): n is a, c, g, or t
  misc_feature (632)..(632): n is a, c, g, or t
  misc_feature (701)..(701): n is a, c, g, or t
cccccctgattttnttttaaacaagacacccaaatcagcagcaaaggtacctggggtagtcactgagattttgaacactggganccngagggggaaagtccaaaaagtagaagtggggaagaaaagggaaggattgngggngaggctaggctctgggggacagagcngggccgcaggngggggaagccagttnggggggnaccctccngactgcngtggcccgtttncccccagaccccagagagccccagggtttgtnctgcagtccattccctatcccccaaaggcctcagaggcctaactccaagtcctctaactcctctcctagcgcccccctccttgctagcttttctagctgcnctttgcngggctggctgacttccccagcctggatccgctgcngcagccctcccacctgccggagtttcttctttaggttctttatcttcttggctttctcagtggnggcagccgagtgaggctggtcagaggcagcggtgggggctgcccgagagcgctgtggagcactggggagtngggctgtntcttccagggacaccttatcaagagtnctgcncaaggcctctccctctcctttctcttgctgctgccgcctcttctcctttcgcttnaggttacgtttggctgttttggagaggcctggttcaccaccttcaggcctggatggggtgacaggagcngtggcct

SEQ ID NO: 707238 - DNA, 113 bp, Homo sapiens
ctctagaggaccccgttttgtattggagttaccacaaatggcctcgctgaaaaaatgcagtataaaatgtattgggcctgtaagacaaatgggaaacacctgggtacctgagc

SEQ ID NO: 707239 - DNA, 133 bp, Homo sapiens
ccatcagtagcagcggcagccgcacatcagcagcttgctctgttccatccggcagcaatggcggccaccaccaccatggcgctctcctcccccgcgatcaagctcgccggagcctcctacgccctcggcggcg

SEQ ID NO: 707240 - DNA, 289 bp, Homo sapiens
ttgaacaaacttcatacgtttgctactgtccttgtatgaagtgtcccatcaatcaaggaatagattcagtacagtcagtgattgttcagtaacgatgatgtatttaaatttcgtcctctggaaggttgattagaactacgtggcacaacttgtaaaccttgcccatagtgtggccctgaggtttctaccacaattgtaggtcttaccttatgctcgagcttcgagtgctgttcttgtgtccatgtgttttcctgggtgatatactctatagttgggatttacttggtgt

SEQ ID NO: 707241 - DNA, 242 bp, Homo sapiens
atccctcaggtgaagacaccactgttactgatgttgggccaggaggaccgacgagcgcccttcacgcaggccatggagtattaccgtgccctcaagacccggaatgtgcctggtcggctcctgctctatcccaaaagcactcacgcattatcagaggtggcggcgctgacagacagctcaatgaatgctgcgctctggctacacacacacttgggcagctgaagccctgccattctgcatga

SEQ ID NO: 707242 - DNA, 106 bp, Homo sapiens
atggctgtacagtagcagagagtaaggtacatctagacactatgccatctgtttttgtaaaaagacactggcaccatgtttgaccaataccattccacactgctga

SEQ ID NO: 707243 - DNA, 117 bp, Homo sapiens
ataatagccgcttctaaacgctaatccaagcctcaccccactaggcctcctcctagcagcagcagggaaatcagccccattaggtctcccacctcgcgctcctggggggatcctcta

SEQ ID NO: 707244 - DNA, 372 bp, Homo sapiens
tgagcttctcgaggtgaggagttcacaaccagcctatactcaacatggcgaaaccctatctctactaatataatacaaaaatgtatgctgggcgtggtggcgcgtgcttgtagtgccagctgttcatgaggccgaggcaggagaattgcttgaacctggaatgtagaggttgcagtgagccgagatcacaccgctgcactcccaactgggcgacagagcgagactccgtctcaaaaaaaaaaaaaaaaatttgctgaggaataggagcaaaaacggagggaacctttccaggttccaggaaaaagagacagcatttgatggagctagggtcaacagaacaaaggaggaattgggatccaggccccttgggga

SEQ ID NO: 707245 - DNA, 220 bp, Homo sapiens
aaaaagaagctagcgtctatcattgtggacattcgggtggtacaagtctttgctattgtgaataatgccgctatggtgtttttttgttagttagttagtattagttaggttaatatctttataggaatctagcaagtcttctgttagattcattcctggcttttatacatttcagtggcctgattatataattcttatcaatctagctgaataatctcaa

SEQ ID NO: 707246 - DNA, 386 bp, Homo sapiens
tgatctagagccctccagtcattgcccagctgtagacctgctcgaagtccactgcctttgccccagcacagaagaggcccactgccaccctagtggacgcgagccaagggctggtcaggctgcagtgcccctcctagcagggccccttcccactcagaccgaggatgtgggcaccacagctcttgtggggcagcccaccttagaacctgactagcgagggacctccgctgcatctcagcaaagcccctcccagggttagatcgattgagcaggacagccctgctcctggacagggaccctggtacgagctctctcctcagggaggaagtaggggtggggctatgggggtgcttactctgtaccccccagaccatgtcccaagatgc

SEQ ID NO: 707247 - DNA, 928 bp, Homo sapiens
ctacttcccctatcatagaagagcttatcacctttcatgcatcacgccctcactaatcacttttccttatctgcttcctagctcctgtatgcccttttcctaacactcacaacaaaactaactaactactaacatctcagcacgctcaggaacatagaaaccgctctgaactactcctgcccgccatcactcctagctcctcatcgccctcccatccctacgcactcctttacactaacagacgacggtcaacgatccctcccttaccactcaacatcacactctggccaccaactggtactgaacctacgcagtacaccgactacgcgcggcactaactcttcaacctcctacactacttcccccattattccctagcaacccaggcgacctgcgacctcctctgacgcttgacaactcgcacgctagtactcccgacttgaagcccccactctcgtactaactacacttacatcacaagacgtctgccactcactgagctgtccccacattaggcttacaaaccacgatgcaattcccggacgctctaaaaccaaaccactttcaccgctacacgaccgggggtactacctacggctcaatgctctgaaatctgtggagcaaaccaccagctcttcatgcccatcgtcctacaattaattcccctaaaacatctttgacatagggcccgctatttaccctatagcaccccctctacccctctagagcacaccacccccccaccccccccccaccccccacaccccacgggggcgccccacaactcccccccacggcccccacacccccgcccccccctcctgtcacaacgcgcccaaaccaccccacaaccaccacgacagcgcacgttaaagcggagggacacgcccccgaacctgcgcaacccctgcgggcacctggccaccgc

SEQ ID NO: 707248 - DNA, 170 bp, Homo sapiens
tagttcattaaaacaacagatgaagtggtaacattcttggatattattattttgagacagggtctcgctctttcacccaggctgaagtgcagtgacatgatcatagctcactgcagccttgaacttctgggctcaagtgatcctcctgcctcagtctcctgaggagctgg

SEQ ID NO: 707249 - DNA, 88 bp, Homo sapiens
cttttttggattttggagttgggggtggtcaaaccccccaggaactttcccctccttcggatgggcaaataaatttgtggggggcgga

SEQ ID NO: 707250 - DNA, 283 bp, Homo sapiens
cttttttttaaaggaaaaatcccccgagaacttttttcccctttttaagggcctaaaataaatttttaatgactcctgttttaatattacccccccttgttcccccccccctttaatcaaaggtagcagattgttctttttggcccgaaataaaaagtttaaaagttgggggtcctttaaaaccccacccaggccttttttttccccccccttgggtaggttgtccccactgggcttttgccccaacttttgcttgggtttctcaatagtttttcccagccca

SEQ ID NO: 707251 - DNA, 836 bp, Homo sapiens
agcggggagtgactggttgccggctgctctctgcgtggttcttcttctcgtgtcgcgtgaaggcccccgtgtgctgcttcctggtcaatgtctgtgagtgcctgctgagctgtccccggtgccgccgacccgggtcgtgtgccaagtgggtccgagccgcttgcctgtgctctcatctccttccgtctcccgttccggcccgtcccgttgtccgcgtggaatgcaacgttgcagtccgtttctcttgtctcctgtcgatggcaattcgtgttccgttgcctttggccctcggcatggtccgaatatcaaatgcccgaggactaaataggtgcacctgatacgcaagcagtattagctagttaacctccccagggtcgagtgtcgagtgccgtagataacacaagtattataactttaatttaatactatagttaatttatttatagcagtttgtgattacctctatattcctgttgtacactagtctctgagaaggcgtgctcagtagttctcttattaagacaaacactaagcgccagatgaatggcaactcctcgattaccattcactatcccctgcatagccgtccgctacgtggatccttgtgtgtggactacctatggatgctcatcctgggactccaataactttgcattagtcgttgagcaattctccgtgttgtagccaactgatgtacgcacacttcttatggtacaggctgtgggctcatggtgtagttgaaccatgaaagcaagctctgcaagtcctagcttaggattgctttgacaaacagggggcatctgtcgatacctgggggtcataagttgatggaaagc

SEQ ID NO: 707252 - DNA, 1292 bp, Homo sapiens
ggagtttttctttagaaacagtgccaagaatgacaagatattaaaaaaaaaaaacaggaaaaatgaaaaaacaaaaaaaccccttactttttaaagagaaaagctgccttaacaggatttttataatataggttattctcataccactttttcttttccataggttccctaggatttccagcgcctcagggctggcattccttagcctcatactgggtggaaagaacacagggggtgtttttgggattccagaaacattattttgtgaacactcgtggaaatatagttcttaaattgtgtggtaaacacacatctaaggagaacaatttctccttatagacgctttttagacaacagacaagaacaaagaagatacaagaaagaagacaagagaaaaagagacaaatagaaaaaaaaaacagccatgtgtgtggggcggcgcgacgcaacgagcgagccacgcaaaaaagagaaaggtcttctagcaaccaacacaactctccgaggcaggggcacgcgcaggggcaggggccaccaaaaagaagagagaacaagcgagagcccaccgagaggggacaaacaaaaagggtagttgacccacaggagagaagaaacaccgcgggagatagacgaatgacaacacagacgcgggccggagtgagacagattctctcgcagaccagcactatgtaaaaagaaacaaaagagcccggcggggggagggagaaacacaaaaaaccagaagaacggtgtgtttcgtcgaggtgagaaaaacacaaccatcccctacaggaagagcagagaagaaataaaccaaaaggaaggagaacaccaccacaatggaggggggacacacacaaaactacacaccagaggggagggtgcaacaacacaaacgagcgagaggagcggcatacgcaaaaaaaaaataaaaagaaaaaaagaataagtatatgaagcagcgcgagccaaggcaagctaggagtcgaggggtggcgtagcaacgagaacagccaaggtagaccgacagagcaacagcgcgacatagagacgaggcagagaagagacgacgagaaggcaagcagcagagaagagagtcagaacgcagagccaagacgaagcaggcaagaaggacaaagcacatacagacaacaagaaggacgaagacaagaatagagacggtatagaactgacaaggaagaagaacgaaagcaagacagagagagagcagcgaagaaaaagacaaaactagcaagagaagacaagtaagagcacaaacaggagcagcacac

SEQ ID NO: 707253 - DNA, 141 bp, Homo sapiens
tatgtgtctaaaaaacagaaaagtaagaaacagaaacaaatacgataataactccaactttttttaaaagtcggaacacagtaatgaaactatacagaacatagctgagaatccaaaaaacacatttttattatctccaag

SEQ ID NO: 707254 - DNA, 102 bp, Homo sapiens
ccctgcaccgatgtgaacccaccagggaggcctttccatcagagtcctgctccctcactcctcgcggcgccccctgtcccagagtcccacctgggggctctc

SEQ ID NO: 707255 - DNA, 309 bp, Homo sapiens
ggggaccctttgtgatgtgtgcatccatctcagagagtcaaacttttcttttgattcagcagtttggaaacactgtttttgtccattctgtgaatggacatttgggagctcattgaggccaatggtgagaaattgaatatcccaggagaaacactagaaggaagctacctgagaaaatgctttgtgatgtgtgcattcctctcacagagttaatcctttcttctcattcagaagtttggaaacactgtttttttaagaatctgataagggatatttcagagtgcattgacgcctatggtgaaaaagaaa

SEQ ID NO: 707256 - DNA, 1074 bp, Homo sapiens
  misc_feature (958)..(958): n is a, c, g, or t
taaactgatcagcctttgtataatgttttttaaattcatttctaaattaaaacaaaaatacagagtgtgtcattctcccttgggaatgagggaaacaaagaactcaggtttccaagaagttaacctttaggaacgctctgtgggaaagaaaaaccgggtctccttgtggggtgtgtctcgtgggaagcgtgccaccaccaatcttcctctctgtgcacaagaccggggggctcaagatatatgcctctccctctcttaacaaacagggctgtggccctgtgtgggcgcccaggggttatattgctggggtctccaggagaaccaacaggcctgtgatgtagattcgcctctctcttatcacagactctcacagagagagtgtgtgagagagacgcaagccgcccccccacaggagagagttaattggggggaagagggctcaccctgtgttgtgcgacacccgagggcctattctctctcacaatgtgacaccttgtgggagacacattgttgttaactcgtgtgtgacacacacctatatatgtctctagaagaaagcacacgcgggtgtatatctctacgcacaaatataccacagatatatatttttatatttataaaagagcgcgcgagaaagccgaaagatgtctcacgggagagggttttctaagaccaaacacttttttgcggcgagggcggcctatatacccacagagaagaagaggcgccccctgttgtcgtccccatgttgcgctcttcctgttgagaaaaacgccaccaaaggcgaggacaccaagagaagaagaagacggggggaccttgttgccgccccccaccaggaagaccccacaaacgccacaagcgccgcctggagaagagcacacaagcggcggcgactcgttgcggggggggcgttggggctcccaacacaaaaaaagggggcgtctctttgtaacgncccgtgggggcgcctccatgataggggggtgtaggtatatacgacgctcgtggtggagaacaacggcccaaagcggctgttggtgcagggttttgtccttacaccaacactcgttc

SEQ ID NO: 707257 - DNA, 1373 bp, Homo sapiens
  misc_feature (151)..(152): n is a, c, g, or t
  misc_feature (155)..(156): n is a, c, g, or t
  misc_feature (177)..(177): n is a, c, g, or t
  misc_feature (180)..(183): n is a, c, g, or t
  misc_feature (185)..(185): n is a, c, g, or t
cggcagtctagtcatccaccgccatcctgggccccacgtgttgcctgaccattcctgagcccaggtgggagccgtggctgaggtgacggtctcaaagtggaagagcttactgtcacagcaactcctttgcaagatgccccggccaggaatnnttnntgaacaccccaggcctgctgnggnnnntncttgagtctcatgttcaagcagtcttgtgagtaaagcactggctaccccttttcacttactatcttttcaagcatgttctaccaccttggaaggtaagaggttagtaccttcttccagagcagagggcaggcattcttgctgtgcgttgtgaaagggtagagtcctgcgctcctttcttgtagtagtccaatggctcatgcaggtgcctctgactcccctatgggaactggggcttgggagggtggtggaaaatgctgatgctctggctattgctattgttttgaataatcagtggtcccttgtccctaatcgaggaatttcgtattttctaccagtgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcaggggtaagtgtgcaggaaggtctgacctggcaagtcacttcactcctgttttatttagagtcacctggctaaggaaaagttcaaaaaccgtcaccttattttgaccttcccgtatggtaagtcaggtgattgaatcccggaaaggttcattgtcttcaagctcacaatactattttgggacaaacagttgtctagtgtttggactcatgaaccctgattcttgagggtggtattttactgcttttgtgatttggtttcaacatatatagtcttttctccggagttaccttaggtcagtggccagtgtttcagcccctggaaagggcatgggctgccactgaggttggtcacaggcctctcagctcatggtgggagtgggttcaggagttggtaagtagggttcagttctgttgttgccaccgatggcaacaggggtttgtaataatccctagttgtgtcaattatgtcacttaattttcacaacaggtctctgaagtgtttctcatctcatttttacagatgaggcctgcctgtgttaatacacctagtgaggagtggagctgaatttgaatgcaagccttggcaccttaattgagcaagtttgaaacctcgcttgttgcccttctggga

SEQ ID NO: 707258 - DNA, 311 bp, Homo sapiens
ttccccccccccccggggcccccaaaactgggggggggtttctgggtgctttttttaaaaggggggggtcctttttttggttttttcccacccaaaatttttttttgggtttgggggtgaaggggttttggcccctttgttggtccccccccccccccccccccaaggtaaagccgaagattgattaaaaattttgtttttcccccgggggggatgtttggggcccatcccggaagggggagcccttttttttgggccgggttttatggctttttactgggggggtaataaataaaaccggggggccttta

SEQ ID NO: 707259 - DNA, 326 bp, Homo sapiens
ggacctttctgtgctgggtgctgggctgcttgcgctgtatcccagaaatgataacatcaaagtgttacacggacaggttcgtattaaaaaaaaaaaaaaggcgccatgtgacggctggatgggagggtacagttaagagaagctttaaggagtctaagttgtaacctatatggtcctcagcaacttttccccagaagagaccatggtttggctcacagagaacatttaatttgccattctcaccaagtgcaattggttatgtactaaatgagaccagagtaggacacattgcccttgacactggccagcacaagacccacaggggt

SEQ ID NO: 707260 - DNA, 156 bp, Homo sapiens
tagaagtgagtggaagctgtgcattggatctttcagtgaacagtcaaagatcaggctgctctctctgttggtgatcacacgaattcttcctaggttagcactccagtcaccatacacaggttaccagctgtcgaaccttgatgaaatcacgtaatc

SEQ ID NO: 707261 - DNA, 354 bp, Homo sapiens
  misc_feature (15)..(15): n is a, c, g, or t
  misc_feature (79)..(79): n is a, c, g, or t
  misc_feature (130)..(132): n is a, c, g, or t
  misc_feature (134)..(134): n is a, c, g, or t
  misc_feature (342)..(342): n is a, c, g, or t
cttgcggccgcactntgggcacggtaagggcttctcccccgtgtggctgcgccttgtggctgcgcagctcgggtgccgncgggtaggccttggggcatagcggacacgcatagggcctaggcttggccgnnnancctgacaccttctccccactggcttcctctgccttagcttctgactctggctttggcttcacctcggccacctattcagagcagtctgccggcccatgtgtggcagcgtggcgcgctgccctgggcgcgtgtggaaatgtcttggaacaggacaggcacttggagcgggggtccgagcgcttgtagaagagggaggggaccgggcctnggcagggctgac

SEQ ID NO: 707262 - DNA, 484 bp, Homo sapiens
taattccccctggaaaccaaaaagggggggttccggggaaggggcccgtgtgggcccccccccctctcccgcgtgggtgggcccctgtgtgggctttttccctttctcccctgtgaagcagaccccccaaacaagatgtggtgagacaccgccccctccctatcgcctggacggtggtgctgctctcctccacaaacacccctcttttttagatgggggagagagggagaaacagacacgaagaaaaagaggtagagaggaggacaccccgcgccccccctcacccaaggcagataattctggagaaaggggcctcactgcaccccataaggagcatataaccccactcaccaggaggagggactacctcctccccgagaaccaattttgtgtaaaacaaccacaacctatgaaaaaaaactactaacaacggttcaaattaataaaacaacaaaaaaacaaaaacaaaaacaaaataaacaat

SEQ ID NO: 707263 - DNA, 485 bp, Homo sapiens
  misc_feature (377)..(377): n is a, c, g, or t
  misc_feature (407)..(407): n is a, c, g, or t
  misc_feature (413)..(413): n is a, c, g, or t
gttcgtcccggagagcaagaacggcggcagccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctntgggctgtgccatcagccagtctttcacanacattngccaaagtgttcatagggcgcctgcgtcctcacttcttgagtgtctgcacccctaatttcacccaaatcaac

SEQ ID NO: 707264 - DNA, 784 bp, Homo sapiens
  misc_feature (231)..(231): n is a, c, g, or t
  misc_feature (488)..(488): n is a, c, g, or t
ccgctctccacccaccccgggccgaaagtgctgcctgcacaggttggtgtatggtcctttgagcaggaagaagacatgaagcacattcctgttagctacgacagagaggggcagggcacacactggacatttcaagcccctccagaaaagcaagtcttactgtgctgggagtacttgtggagtgcgggctgtgttgccctgggctttaattatttcaggaacatttaaccncagggttggcaggccggatcttgatacgtgtttcttagttggaaagactttggaccatagggaaatgtcttctcaattcttttaatttcagtaaggttgtcatttttcttcttgtggcctctggaatgtgacacagaactcaagggacaggaaggagatgagttggaggctgggacaggggtccctgccagggatgctggtgactcacatgacggtgttgatgtgtggagtccggtgcctggtttggggaatgttcntgggatatgttccaaaggactgacggacctatcaggtactggaggtgaatggtcaagtctgatctcagggctgacagtgtcaggcaaggacaggaagttgacgttggactcattggctgaggttgcttgggacccagggagcaacgtgtgccaggacagatgggtctggggctaggaaggcaggtttgggctggagacttgggcttgggacgcatcccaggtagacagtggttgaggctgtggaaatgaccatgattgcctgggatgagagtggagacggacaagattccatctca

SEQ ID NO: 707265 - DNA, 422 bp, Homo sapiens
gttcgtcccggagagcaagaacggcggcagccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctggtagatgagctgataatggggagggttgatggcactctgatgaatgcaaaatacattctcattagtaacatctggtttattgggtgtctgaacaacgtgctgagaagtaaaagtccgtccgtcgggatactacggatgtggaggtaagtctggaatcagggtaggtgcaaaatacatgcatgatgagggt

SEQ ID NO: 707266 - DNA, 623 bp, Homo sapiens
  misc_feature (231)..(231): n is a, c, g, or t
  misc_feature (488)..(488): n is a, c, g, or t
ccgctctccacccaccccgggccgaaagtgctgcctgcacaggttggtgtatggtcctttgagcaggaagaagacatgaagcacattcctgttagctacgacagagaggggcagggcacacactggacatttcaagcccctccagaaaagcaagtcttactgtgctgggagtacttgtggagtgcgggctgtgttgccctgggctttaattatttcaggaacatttaaccncagggttggcaggccggatcttgatacgtgtttcttagttggaaagactttggaccatagggaaatgtcttctcaattcttttaatttcagtaaggttgtcatttttcttcttgtggcctctggaatgtgacacagaactcaagggacaggaaggagatgagttggaggctgggacaggggtccctgccagggatgctggtgactcacatgacggtgttgatgtgtggagtccggtgcctggtttggggaatgttcntgggatatgttccaaaggactgacggacctatcaggtactggaggtgaatggtcaagtctgatctcagggctgacagtgtcaggcaaggacaggaagttgacgttgggcgtacggggaggggatactctagagcg

SEQ ID NO: 707267 - DNA, 519 bp, Homo sapiens
  misc_feature (25)..(25): n is a, c, g, or t
  misc_feature (48)..(48): n is a, c, g, or t
  misc_feature (78)..(78): n is a, c, g, or t
  misc_feature (134)..(134): n is a, c, g, or t
  misc_feature (149)..(149): n is a, c, g, or t
  misc_feature (185)..(185): n is a, c, g, or t
gtgccaaagggtccctggcctttgnacccctacctccacttttaacangcccctccccctcaactagacctaaaaccnttccctagttttttatttaaccagccgagagaatatgtgacctccttttttccacntgaaacactttttanaaggcctattgttgggttaataaattggtcctaacntccgatattgttgtgtcctaacatcccatatggtccttagggaaccagggaggccctgaagagagccaacagagatgggggaatgccccacttgcctcaagcagtcagaatacacacaacattgataatttaagttagcccatcttatatgagcatagttcatagcatcccaaaacaattacaatagtaacatcaaagatcactgaccacagaacaccgtaatagactgaaaagtttaaaatattgagagaattaacaaaatgtgacacaaagtgagcaccacagacttgctcacccagggttgccacaaaccatcaatttgttaaaaaaaaaa

SEQ ID NO: 707268 - DNA, 420 bp, Homo sapiens
cccccggccctgggtaaaagattgtttccttgtggcagcatagcacaccctcgccttttttatgccatccgctgccccctccttttggttctgggccctttagcccttttgcccttccactttttggaccccgcccccgccctccccccccaggtccgtttttttttatttgggggaggaaaaaaactcctgatcattggccaaaggggctttcccctggaaaggccaaatgccttttaggaagttaggaggtttaggcccaccctttacaaaaagggtgggtcccccccccaaatccaaggggaaaattcaggtcaaggggttataacggccattcaggaagctttattttgggtccccccgtgttttccgcccccccccccgccattttgttaaaaaaagccccctgggtttttccca

SEQ ID NO: 707269 - DNA, 131 bp, Homo sapiens
atctagaggatcccgttgattagtcattgttgggtggtgattagcgttgttgatgagatatttggaggctggtcgatcaactagagggggcacaatagaatgactcagtactgcggcgggctatgcctagg

SEQ ID NO: 707270 - DNA, 656 bp, Homo sapiens
  misc_feature (532)..(532): n is a, c, g, or t
  misc_feature (553)..(553): n is a, c, g, or t
  misc_feature (581)..(581): n is a, c, g, or t
  misc_feature (601)..(601): n is a, c, g, or t
  misc_feature (641)..(641): n is a, c, g, or t
  misc_feature (656)..(656): n is a, c, g, or t
caacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattggccaccagaaagggcccaattcttttcacgacaacactgggccgcacgttgcacaaccaacgcttcgaaaattgaactaattgggctatgaagttttgcctcatctgccatattcacctgacctcttgccaacaaactaccacttctttaggcatctcagcaacgttttgcagggaaattgcttccacaactagcaggacacagaaaatgctttccaagagttcgtcaaatttggaagcatggattnttatgctacaggagtaaacanacttatttctcattggcaaaaatgtgtngattgtaatgggttctattntaataataaagatttgtgtgaaccctagtataatgacttntcatggtccccgctn

SEQ ID NO: 707271 - DNA, 398 bp, Homo sapiens
aatccagaatcgatgccatagctgtttgctcgagtgtaaaaagtagtctggcggaattcattcagtcttgggactgagtgatatggtgagtaaaggtacaaattaatgtcgagtaaagaggaagttgttgtgtcgataggggaagatacaggagcacagatggctgggtggccttgatctggtccctaaagctgcttggttggagctgctgcaggttaaaacccctagggcaaggatgtggaatcagaggctgcaccagtaagaaatctctttccaagagattttgtaggggctttgttgtattatttgacaacagtcaattctgctacagatgaacaagaaaaagaagatggatgaaactcataaacgtgtgttaagtatagataatgactatgtag

SEQ ID NO: 707272 - DNA, 157 bp, Homo sapiens
tctatccgtggttctggcttgcaaagaagaaggtcgtcactagtattgaacatgactgggagacaggtttaaggaagtgaggtttcggtgctagagcttgtccaaagaaatgagggctatccctgaagccctgagggaggacagtccatgtgagttg

SEQ ID NO: 707273 - DNA, 473 bp, Homo sapiens
gtaccagttcccccatgtgccagagtctccgtcactgctggaatatagagcaggagcccgtcgtggaaggatgctgggatggtgttcacctgtaggggcaaacagaggtcggctggggtgggcatatgaagggcatggaggtgggagctgtggggaagggaacaagaggcactgggattttggaagaggatgggagaaaataacacccctatatcacagggagattttactatttaaacgatgcccattccaaagcaggggatccaatgggatgccttctccaagtcctgtccaggctgtgggactttatcctcctcccgcctcaagcccattttcttatctttttagcctgctggtggcgaagcgcccctgggcagtcccctgcccttcattgcctaattcccagtgagcatcaccaacctcttttctgttctgtgagttaccaggagtgcataaagaaacaaacagaaaaa

SEQ ID NO: 707274 - DNA, 547 bp, Homo sapiens
  misc_feature (83)..(83): n is a, c, g, or t
ggcggtgatgaattgggacgcaggcgcggagcccagggaccatctccccctgcacagacttgagaccataggggacctgtctnggtggcctcagggataggcgctccccaagggtgtcgatatgaggcaggatgaactggacaggttggtacaccttgctcagtggcgtgaaccgggcattctactgccattgggcccgagtatggctctccggtcatcttcatcttcagaatcatgcgtgctggtggtgggctgccagagagtgtgtgggggtgatgagaaatcttccttcatctgcaacacactccaagcctgtgtgcaaaacaaggcgtgggcttatgaccaattcttccccatctcccatgtgcggctgtgggtccctgcagctcatcctagtttccacccacagtctctcctcgtggcattgcaccggtggctcaccagcaaacacattcgacgacgaaaatgctaccggtttgagggccatgggggacccccatacacctggaggatggtgaagaggcacaaggtccacaatctcagggac

SEQ ID NO: 707275 - DNA, 252 bp, Homo sapiens
tatgtaaattggctaattgatggtcgcctcaccatctgtacaatctcctgtttctttgccatagtggcattctgactcttggggattcattacttgcaacccccctttttccagagttccaaaacccgttttggcttttgtgttgtcatatcctattttgtgatgatggggattctgaccatttatacctcatataggagaagagcatctttctcgtggccacaggaaaagatcctacaggaatggatcctg

SEQ ID NO: 707276 - DNA, 105 bp, Homo sapiens
ttgagattatcgctagatgatcccctctcttcctccccactctgatataaatgagttcctattttttctgggacgagggggggattgattatgaaacataatgta

SEQ ID NO: 707277 - DNA, 392 bp, Homo sapiens
tccctttttggggtttccccccccccaagatccctttggggaggttttgcacaggcccgattcccgggtttaaaaaggttggaaatttcccggttttcccccccttttcacccccccggggattttttaaataaaggggtttaattcccttttctggtcagcgggggaaggggggaccccaaattaggtttaaaaggttccccccgggtttttttttttttgggtttttttttttgggccaagaaattttttgtttgtccaggaaaaggaagagggggaaattaaaacctttccggttagttttggaaaggccgggatttttccaaaaaatttaaaaagaggggcgtgggggttttttctttgggaaaaagaaacgtgggggcccccgggga

SEQ ID NO: 707278 - DNA, 150 bp, Homo sapiens
ggacagtagacataatatatgtatcggtgtcatctgatggtcgttaatgttttaagtttgggggttaacaaaagactgagtctcgctcggtgacccaggctggagtccagtggcacaatcatagttcactgttacgttacttcaaactcc

SEQ ID NO: 707279 - DNA, 1094 bp, Homo sapiens
  misc_feature (224)..(224): n is a, c, g, or t
  misc_feature (776)..(776): n is a, c, g, or t
  misc_feature (831)..(831): n is a, c, g, or t
  misc_feature (840)..(840): n is a, c, g, or t
  misc_feature (856)..(856): n is a, c, g, or t
  misc_feature (859)..(859): n is a, c, g, or t
  misc_feature (862)..(862): n is a, c, g, or t
  misc_feature (866)..(866): n is a, c, g, or t
  misc_feature (874)..(877): n is a, c, g, or t
  misc_feature (890)..(891): n is a, c, g, or t
  misc_feature (899)..(899): n is a, c, g, or t
agtcaagtaacgctgagagcctatcgcatgagggcgacagccggaaagcaggatggagcatagaagcattctcgcgagaagtagagttgcggttcctcgggagaggggcggaggctcagaggtgcaccacgtggggtttgctgccggagcggagtctccggccggcgtcagtttgagtctaggttggagttggaaccgtggagatgcggaaggaaaccccaccngccctagtgtgccgcgcgggccgggagtggaatcttcccccaaatgcgcccgcctgcatggaacggcggtggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggaacacaagctgtcagtggtagcaaagacatctgcatcaagggtttgggaccttgctcagcaggtggtactgagttcataccgagctcatgctgctcaggtcacttgtgttgctgcctctcctcaacaaggactctgtgttactttcatgcagcgaggacaatanaatttactctgggataccgctgtaccaagccagcatcacagattggctgcagtgngctggaacntctactcgctggttgnatnctnaggnaagtgagnnnnggcttggtgatgnnatgggcangtcctgtgacccagattacgctgggttggggtcatgaatcccagttgatgggggtgttcccacgggcttactggccccagaacaggcagtgggcgaactatgatttacgaacccagttggagagtggactcatcctcaatgggaaggtcaggacacaccggtcgtgtacacggcgctatcaggtgttttagcagc

SEQ ID NO: 707280 - DNA, 262 bp, Homo sapiens
  misc_feature (4)..(4): n is a, c, g, or t
  misc_feature (19)..(19): n is a, c, g, or t
  misc_feature (37)..(37): n is a, c, g, or t
  misc_feature (53)..(53): n is a, c, g, or t
  misc_feature (68)..(68): n is a, c, g, or t
  misc_feature (79)..(79): n is a, c, g, or t
  misc_feature (84)..(84): n is a, c, g, or t
  misc_feature (118)..(118): n is a, c, g, or t
  misc_feature (129)..(129): n is a, c, g, or t
  misc_feature (150)..(150): n is a, c, g, or t
  misc_feature (156)..(156): n is a, c, g, or t
  misc_feature (166)..(166): n is a, c, g, or t
  misc_feature (182)..(182): n is a, c, g, or t
  misc_feature (184)..(184): n is a, c, g, or t
  misc_feature (186)..(186): n is a, c, g, or t
  misc_feature (207)..(207): n is a, c, g, or t
  misc_feature (210)..(210): n is a, c, g, or t
  misc_feature (219)..(219): n is a, c, g, or t
tttntgcaggttagggggnctgattaatgttcccttnccttacaaacagctanagaaaaaatctcatnaaaaattgganacctntacttcctttaactttcctactcaatggtagganataggaatatnttccccaaaaaatttctactnctcttntccttggctntgatccctatacatantntnaatttatatccaggtttcccnggntcaatattnacaagacgactttggcatctgaattgttttaatatctttactc

SEQ ID NO: 707281 - DNA, 1067 bp, Homo sapiens
  misc_feature (749)..(749): n is a, c, g, or t
  misc_feature (804)..(804): n is a, c, g, or t
  misc_feature (813)..(813): n is a, c, g, or t
  misc_feature (829)..(829): n is a, c, g, or t
  misc_feature (832)..(832): n is a, c, g, or t
  misc_feature (835)..(835): n is a, c, g, or t
  misc_feature (839)..(839): n is a, c, g, or t
  misc_feature (847)..(850): n is a, c, g, or t
  misc_feature (863)..(864): n is a, c, g, or t
  misc_feature (872)..(872): n is a, c, g, or t
ggaggctgcgcggtaccggtccggtgagccgagatccgggcctgggagctccttaccccggccaggcgcccctccccggagactgaccctctcagtagcatccccgtcctgcatgtaatcatgatgctgaggtcagcggtcaactgagctgtctccagaccttgacctccgcgattcctgagctctagagtacagacccggccgggatacgctgttctgtgcggtctccagtgggaggtcgaaccccgttctagcccgttcatcgcgctgacagcttgtaccccccgtagatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggaacacaagctgtcagtggtagcaaagacatctgcatcaagggtttgggaccttgctcagcaggtggtactgagttcataccgagctcatgctgctcaggtcacttgtgttgctgcctctcctcaacaaggactctgtgttactttcatgcagcgaggacaatanaatttactctgggataccgctgtaccaagccagcatcacagattggctgcagtgngctggaacntctactcgctggttgnatnctnaggnaagtgagnnnnggcttggtgatgnnatgggcangtcctgtgacccagattacgctgggttggggtcatgaatcccagttgatgggggtgttcccacgggcttactggccccagaacaggcagtgggcgaactatgatttacgaacccagttggagagtggactcatcctcaatgggaaggtcaggacacaccggtcgtgtacacggcgctatcaggtgttttagcagc

SEQ ID NO: 707282 - DNA, 776 bp, Homo sapiens
  misc_feature (224)..(224): n is a, c, g, or t
  misc_feature (694)..(694): n is a, c, g, or t
  misc_feature (773)..(773): n is a, c, g, or t
agtcaagtaacgctgagagcctatcgcatgagggcgacagccggaaagcaggatggagcatagaagcattctcgcgagaagtagagttgcggttcctcgggagaggggcggaggctcagaggtgcaccacgtggggtttgctgccggagcggagtctccggccggcgtcagtttgagtctaggttggagttggaaccgtggagatgcggaaggaaaccccaccngccctagtgtgccgcgcgggccgggagtggaatcttcccccaaatgcgcccgcctgcatggaacggcggtggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggaacacaagctgtcagtggtagcaaagacatctgcatcaagggtttgggaccttgctcagcaggtggtactgagttcataaanacattattttttttttttttttttttttttttcaagagaagagagtccgagagcgcgggagggaggcagcacgcccacnggc

SEQ ID NO: 707283 - DNA, 374 bp, Homo sapiens
tctcacggaacgtgacacagtgttcagagttctcttagtaaatgcttcatttcaaagcatacatctcttccaacatattacaatgaaaggacaacagtcttttgtttttcctttattattattatgactcatttttttggagagctgagaatctctggtaacatagttacagatgttggcccagattaaaatgatgtcttttcacaaacagtcaaatatctgaagtatttgacagaggatacacaacactttcagattcttcacacggtgtgataacatttatcatagtacctctgtgataaaaccagcattatgcaaatgaacagactctgtattccacgatcattcatacttacctctaagttcaaaacgta

SEQ ID NO: 707284 - DNA, 1105 bp, Homo sapiens
  misc_feature (787)..(787): n is a, c, g, or t
  misc_feature (842)..(842): n is a, c, g, or t
  misc_feature (851)..(851): n is a, c, g, or t
  misc_feature (867)..(867): n is a, c, g, or t
  misc_feature (870)..(870): n is a, c, g, or t
  misc_feature (873)..(873): n is a, c, g, or t
  misc_feature (877)..(877): n is a, c, g, or t
  misc_feature (885)..(888): n is a, c, g, or t
  misc_feature (901)..(902): n is a, c, g, or t
  misc_feature (910)..(910): n is a, c, g, or t
agtcaagtaacgctgagagcctatcgcatgagggcgacagccggaaagcaggatggagcatagaagcattctcgcgagaagtagagttgcggttcctcgggagaggggcggaggctcagaggtgcaccacgtggggtttgctgccggagcggagtctccggccggcgtcagtttgagtctaggttggagttggaaccgtggagatgcggaaggaaaccccactgatctagggaattcggcagcgctgaaagtcgtggtcttcccgctaatgaccgtgcctatctgtgtcacgtagagttaggcggcatagcgctcgatacgcgtgtcgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggaacacaagctgtcagtggtagcaaagacatctgcatcaagggtttgggaccttgctcagcaggtggtactgagttcataccgagctcatgctgctcaggtcacttgtgttgctgcctctcctcaacaaggactctgtgttactttcatgcagcgaggacaatanaatttactctgggataccgctgtaccaagccagcatcacagattggctgcagtgngctggaacntctactcgctggttgnatnctnaggnaagtgagnnnnggcttggtgatgnnatgggcangtcctgtgacccagattacgctgggttggggtcatgaatcccagttgatgggggtgttcccacgggcttactggccccagaacaggcagtgggcgaactatgatttacgaacccagttggagagtggactcatcctcaatgggaaggtcaggacacaccggtcgtgtacacggcgctatcaggtgttttagcagc

SEQ ID NO: 707285 - DNA, 389 bp, Homo sapiens
gcatgccgacactagaggatacccttcatttacgcaataaagtataggcgatagaaattgataacctggcgcgatagatatgtagccgcatggcgaatgatgaaaacattatatccaggcatattatagcaaggtactaacccctataccttctgcataatgaatcagctagaaataactttgcaaggagagccaaagctcagacccccgaaaccagactagctacctcagaacagctaagagagcacaccccgtctatgtagtcacaatagtgtgaagattcatcggtcgaggcgacgaacctaccgagccgggcgatggctggttgtccatgatagaatcttagttcaactttaaatttgcctatatcaagggtaccgagcgcgaat

SEQ ID NO: 707286 - DNA, 1074 bp, Homo sapiens
  misc_feature (756)..(756): n is a, c, g, or t
  misc_feature (811)..(811): n is a, c, g, or t
  misc_feature (820)..(820): n is a, c, g, or t
  misc_feature (836)..(836): n is a, c, g, or t
  misc_feature (839)..(839): n is a, c, g, or t
  misc_feature (842)..(842): n is a, c, g, or t
  misc_feature (846)..(846): n is a, c, g, or t
  misc_feature (854)..(857): n is a, c, g, or t
  misc_feature (870)..(871): n is a, c, g, or t
  misc_feature (879)..(879): n is a, c, g, or t
agtcaagtaacgctgagagcctatcgcatgagggcgacagccggaaagcaggatggagcatagaagcattctcgcgagaagtagagttgcggttcctcgggagaggggcggaggctcagaggtgcaccacgtggggtttgctgccggagcggagtctccggccggcgtcagtttgagtctaggttggagttggaaccgtggagatgcggaaggaaaccccacgtgcgtatgcgaggggccgatggaggaacgcaatgacggtggtgcgtagttggaggctgcgcgtttccggtgcagatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggaacacaagctgtcagtggtagcaaagacatctgcatcaagggtttgggaccttgctcagcaggtggtactgagttcataccgagctcatgctgctcaggtcacttgtgttgctgcctctcctcaacaaggactctgtgttactttcatgcagcgaggacaatanaatttactctgggataccgctgtaccaagccagcatcacagattggctgcagtgngctggaacntctactcgctggttgnatnctnaggnaagtgagnnnnggcttggtgatgnnatgggcangtcctgtgacccagattacgctgggttggggtcatgaatcccagttgatgggggtgttcccacgggcttactggccccagaacaggcagtgggcgaactatgatttacgaacccagttggagagtggactcatcctcaatgggaaggtcaggacacaccggtcgtgtacacggcgctatcaggtgttttagcagc

SEQ ID NO: 707287 - DNA, 424 bp, Homo sapiens
ttcttcctgtcacttccttcctctggtattcctggtacgcgcaccaggcccaggtggccgaggaactggccgagcgcggccgcatcctggcgcgcgcgctggccgagaccagcgaatacaacgtgatctccggcaacctcaccgacctgcgcctgaccatcaacggcctggtgcagtccgacaaaagcatctaccgcatcgacgtggtcgacgccacgggcaagcgcgccgtgcgcgtgacctccgagagcgcggcggacgccgagccgcattactacgaagcgccgatccgcaagcaggtggtgtggatcaacctgttcaccgacaacggcatcccgcacgtctcggcctccagcgacacgcgcccgccgacgctgaccaccgaagtggtgggcgcggtgcgcgtgaccatgtcgccggcgaa

SEQ ID NO: 707288 - DNA, 667 bp, Homo sapiens
  misc_feature (545)..(545): n is a, c, g, or t
  misc_feature (667)..(667): n is a, c, g, or t
gtccatagaccgtagacgctgatagcaatctctagcctaattctatatgcacactataaatgttccactgatcgcgatatctggtagacgtactagagaacacagacagggaacgtctttcataactgattagaataacgtcattgtacagaagtgcggcatgattacgaggcaatatctaaagctaaagatcataagccgcatgtggactaaatgagatgatgtactagtgcaatggattgctgatataagaggatcacactcagacactagcatgaaagcaagaatagataccagttcaccttcagacaactgtactatggcatgactagagcgaatcccacgcaatcagatcgagaatcatattgatgaaagtagcaagagtccaaaggaggtctgaatatggagaggtactggtcttctggacaacctgaagacccttgaccagaattctgactgagctgatgactacatgctgaatatgcatgatagatcatctacagatatacgccatcctccaaactaatcgacactgaactaccgtngactggctcacatactcagtcactgtgtagtgctatgttgcatacttgaaatatattgatgatgtgatgatagtgcacttgactgcccactgttcaggacatgatactactgctacagtgtn

SEQ ID NO: 707289 - DNA, 857 bp, Homo sapiens
gtcccgtccggcgcttgggccagagtggtgcggacggcgcgtgggggatccccacgtgatgtgtttctcacgctagccctctttggtcctccttgacgtcccgggcctgtgggcccgctttctgccgagatgccgaaggtcaagtcgggggccatcggcctgcctgcgcgggcgagaaggagcagctgccgggagctgaaagagcgctgagaggactcatgttcaacacggggattggggcagcacattttgaaaaatcctctcattataaacagcattatcgataaggctgtcttaagaaccaactgatgtagttgcctggacagttgtggacctggaactgggcaacatgacgtgtaaacctggtacagacaaggcaccaaaggttgtttgcttgttgaaactggaccccaaggctaaggtagctgaacttcacaaaagagttcaggggcacgccctgtggccagcaaacttcaagtactggtgggttgatgtgctgaaaaacagatttggccattgcttttgataactgtgtggtgggcaaaatgtggccttatcaggatctcgttcgcccttttgggtccttcaaagcctgttgctaacatcgaaccttatctcgcagggtgtgcaataacttattgttttcccaacgagaagtttgcccctccgacttggtttgcaaaccctgaagataagttaaaacggcagacttctcatttaatacccagctgttggccgtgtggccccatctatgaacgtgggcacgaatatttggaccccgcccagggtgacccagtgttggacggtaaacctaaatcgcggccacaataattcaagaaggaggcagaaggaaaccg

SEQ ID NO: 707290 - DNA, 236 bp, Homo sapiens
gaagcgcctggtggccgcgtccaccaagaagaagaaaggcagcaagaaggtgacacccaaaccggcatccacgggccccgaccccctggtccagcaacgcaaccgcgagaaccttctccgcaagggccgggatccccccgacggcggcggcaccgccaagcccctggcggtgccagtgcccaccgtgcccgcggctgccgccacctgcgagccaccgtcggggggcagcgcggccg

SEQ ID NO: 707291 - DNA, 437 bp, Homo sapiens
agaacgacctccatctcccaggttcaaactattattcgtgcctatatcctcccgaagtagctagggattacaggtgtagagccaagtaaggctaggctgttctcgaattcctggcctcaaatgatctaccactgcctagtcctcccaaagtgccaggattacaggtgtgagccactgcgatcggcctttgattttctttctaattctatccattgttgagagttgggtgtcataatctccaactttagttctggatatagtctaactcttctttcattgtgtcagtctttagcgttacattactattgcagctctagattgctaattctggctggagagactcttttatcattacataatgtccttctctgtctctggtaattttcttggctcaggtctagtatatccactttatagctctgcctggtttcttttga

SEQ ID NO: 707292 - DNA, 563 bp, Homo sapiens
aaaacctctttccctatgggtgtaaatcacatcgtggcccccttaacggtagaaaccttgggttttaattcccatgaaaacatggaattttttaaacttaatcccttctttaacaggaaaaatgcaaatcccttcatatccccccaccaaaaatggaaaaactaaagtccaaaaaaggttccgaaaacgctttaaacctgtccccaagcccaatagggaaacctgtaatgactacaaactttgggaacgataccccatggtttatggaaacaatgctgccaataatcggtatttcaggaaaccccaaggggccaaattagactgagggaaaaaaaaaaatctctttttttttgaaagcgggcccctaattttgtatccccctgtaaaaacatttctgaaatacatagggttatatacaaaggttttttccgggaaattctcttgtctgggtgcacccttttttccgcccccaaattttaagtaatgaaaatgccctccagttagggtcaaaaaaaagtccacatatgtgattgttccataataaacttcggggggaaaacttt

SEQ ID NO: 707293 - DNA, 358 bp, Homo sapiens
  misc_feature (314)..(315): n is a, c, g, or t
gacgcctcgaagtcctcgaaggtgcagaagtggatgttcggcgtgttgtaccaggtgtacgggaggaattccgaaaccggcatccgacccttgctcgccaggtaccagcggcacgccagtgaccgaagttggggaaggtgatgatgcactggcgcccgacccggagcatttcgtcgaggatcttgtccgggtagtgcacggcatgcagggcctgggtcatgaccacgatatcgaagctgttgctggcaaagttgccgaggcccttgtccaggtcctgctcgatgacgttgatgcccttggccacgcaggtcganntgttctccgggtcgttttccaggccgtagcggtagagtcgacg

SEQ ID NO: 707294 - DNA, 628 bp, Homo sapiens
  misc_feature (22)..(22): n is a, c, g, or t
  misc_feature (60)..(60): n is a, c, g, or t
  misc_feature (67)..(67): n is a, c, g, or t
  misc_feature (148)..(148): n is a, c, g, or t
  misc_feature (153)..(153): n is a, c, g, or t
  misc_feature (179)..(179): n is a, c, g, or t
cttctcttatgcttggacaggnccaccagagggtttgtttagcagtaaacacccagtgtnttgggangatgcttgttgcaaagtggaccatgtctagcagtagcatcagtgtcaagggaaaacacccataattagcagattgggaaanggacntccctttccccggggggtttagagangatactcctccacctcttgtggagggcctgacatcagtcaggccccggcccgcagttatcccagaggcctgtctccctgtgatgctgtgcttcagtggtcacgctcctagtccgctttcatgttccatcctgtatacctggctctgccttttagatagcaggagcaaattagtgaaagtactaaatgtctgatatgcagaaataatggcataagctgtctctctctcttctctctctctctgcctctgcagccaggcagggaagggccccctgtccagtggacacatgacccatgtgaccttacctattattggagatggttcacattccttaccctgcccctttgtcttatatccaataaatatcagtgcagcccggcatttggggccactactggtctccgcgtcttggtggtagtggtcccccaggcccgggtgtcttttctttta

SEQ ID NO: 707295 - DNA, 818 bp, Homo sapiens
gactggcttcctgtgctccctcagtttgcagttggcctatcgtgggacttcaccttgtgatcatgacatctccaagaacttcgttcactgaagtcttaaacccctcacagtgacccatgaggattggaatcagcttctttcaaactcttactattgttgatattttgatcgcttcctatgaatcgtgaatattttaatgacatctaaaatgtgactcctggccgggcacagtggttcacgcctataatcccagcaccttggtaggtcaaggcgagaggatcatttgaggttagaagtttgagaccaacctgaccaacatggtgaaaccctgtctctactaaaaatagtaaaaattagctgggcgtggtggagaatgcctgtaatttgagctatatgggatactcagccaggagaatcgcttgaacctgggaggtggagattgcagtgagccgagatcgcgccactgcactccagcctgggtaacaaagtgagactccacctcaaaataaatacataaataaacataaaataacaatggtgtctcctttccagttttcaactttactttgcccaagatctatcataggaattgttgcctatggcatctacagccttatgaaatgtatttcttaagttataagacttaacaagttgaaattacccctttaattcataggctgcaggatggatgctgtgttatcaggcatagaaacaatagtatctacttgttacttctccattagggatcttggggtgaccagatgcattggcaatggaccaatatattttcaaatgaatctttaactattagatctcaa

SEQ ID NO: 707296 - DNA, 251 bp, Homo sapiens
ccccccctgccggggccgggacccaattttcaacaaatttggttcccccagggccgggacatcccgggccattggggggggttgtttttaggggggtttcccccttccccccgggccttggggttcaacccccccaggaggggggccgttcggcccgggttctttaaagggattcccgggtttgggggggagggggccccccctttttcccttagggcccgggcaataaagcggggggtttttccccccca

SEQ ID NO: 707297 - DNA, 749 bp, Homo sapiens
agcgggactacaggcatgcgccaccacacctagctaatttttgtatttttaacagagacagggtttcaccatcttggccaggctggtcccaaattcctcacctcaagtgatcctcccgcctcagcctcccaacatttgtatacttttggaagtcacacatcttcctgaaaagtggatagaagttttcaaccttcttcgcaggatggagggcagacacagaacttcaacacagtgacaggggcttcaaacgactaagttccgtccaggtacccttggagatgtgtgctgctgcgtggaagatgactgagcatgagacacgcagtgcccgaccgcgtggagcctacgtcctagagaggaggcacaggaacaccagacacgagaacgggaactgagtcaccagcggggaacgacagaccttatccaaggagcttcactaagaaacagaactgattacaagggaagaacatgtggtcgtctttacggcaagtcacacaaacgaatatgatgtgcctctggggtaaccaaaggcaggcttcccctgaggaagtgacccctgcaactgagcacttacagagtgattcagagttaatgcgatcatacagcccgagactggaagaatcagcatgtgccacacgtccagaagaaacgtacagcgagaccagcacagaccaaccagcccagagaggagccccacgtcctttagggtgagccacaggctgacctaaggagatccacaacatggctgccag

SEQ ID NO: 707298 - DNA, 176 bp, Homo sapiens
gaggtgagaggagatatcgtgggctatcgctatccatacatgggacagacctagttcaatgaatctgagtacgctactcagtagacagtcccaccctcacacgattctttacctttcacttcatcttgcccttcactattgcagcccttagcagggtaccagagctcgacattcgt

SEQ ID NO: 707299 - DNA, 163 bp, Homo sapiens
atctagaggtccctggtgcatgatgtggggcttctacgaggcagctgcgagtgcgggcaggtcacagattcacacgggctatgctatgcaggcttctacgacggcaaccgtgagtgcgtgcatgttcacagattcacacgggctatgcttatccatgcttcta

SEQ ID NO: 707300 - DNA, 491 bp, Homo sapiens
gatttcaaaaataactgaaaattgagataagaattctgagtacgaattgactaggcaggaaaggctttctttccaagagaaggcagcagcagcacctggtctcagagagcttccacagtgtcggcgacaaaaaggcagcagcttgtgcttggaaatggaaagaggcttgtatgagctcatctctcttctttttaaacatttttcatttattattgggtaactttttgtatatatattatctgggatttacacgtggaattgaccttgcagtatgaggagggagctcaaacttgttgaccacaggccttgtgccaagaaccagctgagtggttgatgtataatgtttccctggatccccagccatcagagagctgctgcccactgtccctagcttcgggccttctaaagggcctgggctggaagtactgtgaagaatagacacggagtcaggattgtgtatagaagtgaactagcaaaataaataaataaat

SEQ ID NO: 707301 - DNA, 607 bp, Homo sapiens
  misc_feature (330)..(330): n is a, c, g, or t
gtctggaatcagaggatgtatggaagtgcctggatgtctgggcagaagtctgctgcagtggtggagcccttatggaaaacatctgctagggcactgtggaagggaaatgtggggttggacccatcccatgcagagtccccactgtgcatggcctaacagagctgtaagaagagggctgctgtcgtccagtccacagaatggtagatccaacagcttgcaccatgtgcctagaaaagccacagacactcagtgcaagcccatgtgccagccaggaggggagctgtaccctgcaaaggcacagggatggagctgtccaaggccatgggagcncacgtcttgcatcaagtgacctggatgtgagacaaggtagagccgagctgggtctaccttgtttaaggtgatctgcccaccttcggctcccaaagtgctgggattataggcatgagcaagcaatacccaagccagtttcatttattttcataataggttatgaagtagtgatgtaatggttaaaagtcatcatcacatagtgtgtaaagatattggaattatgcgagaaatctggcaatcatctcttagatcagatggtaaaaaaggggacaaaaca

SEQ ID NO: 707302 - DNA, 577 bp, Homo sapiens
ccccggtctcacttctgaatccatatacaatttggattgtacagggacttataattttactggagctgggactgtggacacaactgtatataacctttaagtgctgagatactttagatatttgagctatgttgcaagaaacatgtcgtgatgtgtacataggagaattgtctcaagttatttattcagtagaggtagccagttaaagtcaaagtcttaacatcttgctgccagtttttatttgttgaatttattcaccaaatattaaatactacatgggcagcacaggactgggtaacccaacagtgaaccaagcaggcagtttacccaccaccaagaaacttctagtggagaagagagagtgaaatggaattaatcaagcagtgataagtgctgtaagggcataaaactagttgcagagtttttgggtacgttggtaagttggtcaggaaatgaaatgcagaagtgagccttgcagttgttacaggcaggatgaaccagaagcctggcagattaaagtaatagtaacaaagccagtgtgtctggggtatagtgttctgggaggaatgcatgagat

SEQ ID NO: 707303 - DNA, 954 bp, Homo sapiens
ctcaggcattgttgtaaagtgccatcagacaagatcagttgatcagaacagaaagctagctcggaaaatcctacaagagaaagtagactgttttctacaatggtgaaaacagtcctgttcacaaacgaaacaacgacgaacgcgagcgtaacaacacaaacacaacgaacaggcaacaacacaacgagcaagaggcaaaccctgcgaaaaaaaagaagctacttaacagaactgtgggcagtcaagtaaaaaggtccactgcagaacaacgaattagagattccaactgacagaatctgccagaagctcccagggaactaactggtggcgagcttccatcaccagcattattatagctgcttcaacaacgaaactatttctcgcatgaaacttaacacagcacacaaacaattctatttaacatggtgcactaaactgtagtgaacagagcacatgcacgattcaagaataaaactcggccgggcacggtggacggtgcctcacatctgtaatcccagcacttcgggaggccgaggcgggcggatcacttgaggtcaggagtttgagaccagcctggccaacatggtgaaaccccgtctctactaaaaatacaaaaaattagccaggcatggtggcgggcacctgtaatcccagctactcgggaggccgaggcaggagaatcgcgtgaacctgggaggcggaggttgcagtgagctgagatcgcgcactgcactccagctgggcaaactgggtgacacgagcgagacccagtctcaaacaacacaattacactaggtcacgtgaatgaccacgcctaatatccagaccttggaacgcataacaggaacactcccttgagcccagagtcaaattcgacaccataaacccagtgtccgcgtccacggccggattaaaaaaaaccgttcaaaaacaaatacataaccgtgtacaact

SEQ ID NO: 707304 - DNA, 903 bp, Homo sapiens
cttataaatggcagcatatcttgttaaacctccctccccaaatactctctgaaagtcatgcagatacctatgggattttacacacacacgcagctttaaaatgctatgtctctatgccatcagaatatacgtcatatattctattgtattaacggcaagcgaactaatgaaatagaacataaacacttcttcctagtagggatttcctagataccatgtatctaattcctcccattatgggcagatataggtgtttcgctttatatctgtattatactcttatctattagagcaaaataccattgaaagcctattgaactacttgacagatagtgatttggcaatggattacaggtctgactgtattcacttaatttcacatgtcgtatcgtgagaacgtatctcttgtataatgtgcattaccaagaatgccagcacagtttacatgatggcctactaacaaggtaaaacagagcatttcattctataacaaagatagctctggaatattgccttccttctgataaatattagaacatatcttgcagagacttcgggtggtcctgccacatgacctacattaactaggagtagagctaccaggatcgacatgcagtccgttattgacagtctagtcaaggagaccagaccactgcttgctaatatcccacttagagcgcaaagaacaattaaacctcagcaatcacggtaactctgtggcatcgttcgatgacccatatggtatctagtcagaacacggggtctaatccaacaagccgacattaacagatttgggttccctcaggttgaccgaaactgcacacccactatttcccatgctgtcatgctatcaggccttacagtcctccgtacagccccaatatttgacttacagacacaaaa

SEQ ID NO: 707305 - DNA, 163 bp, Homo sapiens
ccagcgacatttgtgatacttttctcaatacctgccaatactagataatagttctgtattggcaggtattggagaaaagtaaatcccaattcggtggccaatttttctctagttggaagactcccttttgcaatcctagaagtaggtatggacaggagggcac

SEQ ID NO: 707306 - DNA, 179 bp, Homo sapiens
atttgcccggccctgtttttcccccccggaaagtttttaaagagggggaaactccgggtcctctttgggggggggggggtttccaccccccccgttgtttcctttttgaccggtccaccccccgggtttttggggttgggggaaaaagggccccgggaccccccctccccgttttttta

SEQ ID NO: 707307 - DNA, 262 bp, Homo sapiens
ctcccctgacaagcaaaagctgaggaaattcatcaccattagaccaccctacacgaaatgctcaagggaattctaaacctggaagcaaaaggatgacatttgccaccatgaaaacatacaaaagtacaaaactcactggagtaaagcaaatacacaaagtaagaagaaagagaaaggactcaaaccacccctacagaaaaccacaaaaccacaacgacaaaaagaaaggaaaagaaagaatatacacaaacaactcagaaaa

SEQ ID NO: 707308 - DNA, 155 bp, Homo sapiens
  misc_feature (155)..(155): n is a, c, g, or t
ggcgaggcgggcgctgcggcccagcaagtcccttttggtggcgaccgacgatggacagagcaattggcagttttggaacgaggagaaggccttcgcaggcctcgggaggcttcggcccccccgggcaattcgggggaattttcagggcagaaatn

SEQ ID NO: 707309 - DNA, 373 bp, Homo sapiens
attgtgtaaaaacatggatttgaaggcagattaaggtatcaatctcagctcagcacaatcaatatgtgactttaggtgagctgcttaaattagcctcagtttatctcatctgtcaaatggggctataacaccacccaattcccaagcttatggggaggttaaatgagactgtgcttggctccatggctctcctctgctgctcattgtccatctgacccatcttgtcaagagatcaagaccatcctggccaacacggtgaaaacccgtctccaccataaatacaaaaaagttagccaggcgtggtggcgggcgcctatagtcccagctgatcgcacgaggctggcagattcccagtggatacggtgggtgatct

SEQ ID NO: 707310 - DNA, 482 bp, Homo sapiens
tatgtatgtgctccgattgtccaggcttttgatccacgctatgctccaagtcctcatcgcgcgcaccagcgtggccattgagcacctaccaggagtttgatagatacctatatcccatagaggacgcagacgtattcattcctggcatgactccacagaagactccttctgcttgtcagtactctattccgacaccctccaagcatggaggaaacgctacagaaatccaatctatagctgtctccgcatctccctgctgctcatcgagtcgtggctggagcccgtgcgtgttcctctaggagtatgttcggccgacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacattcttccaa

SEQ ID NO: 707311 - DNA, 129 bp, Homo sapiens
gaagagtcgactgctataggatcccccatcgcaaggatgagaaacggaatagagtcaagttctgaagattatacctgaagaagttactgggagctgctattttatattatgactgcatatatgttaaga

SEQ ID NO: 707312 - DNA, 103 bp, Homo sapiens
cagagtcaacagtgccagtgattctaaaactggggttcctgcttcctagggagtgcatgatgcccaggcagacatggcactctttttctagcttgtgcatttt

SEQ ID NO: 707313 - DNA, 312 bp, Homo sapiens
tatcaggtgctgccatccaggttcagcttgtaaatagctcaggtgtcaccctgcaagggatccctgcacttgcagactctgacagagccatgggcctcctgtgtgtgtggctacaggattgagcactgaggtgtgctctgatcatccactgtgccatgtgccaggtttttggtctgacccactgcttttggtctgtgtgatgatgaaatgaggtcagagcctgcagttattaacactaacgatttgttaatgatagctactgtttattattttatttaatttttttgagacagagttttcactccagcctgg

SEQ ID NO: 707314 - DNA, 857 bp, Homo sapiens
taatttccggatgtgtagtagtatatcctgggttttaccatcttgtccatggttgtttctttgaattcccgtggacattcatattgattctgctcgtcctcagccttcccctagctgctgtggattcactcggtattgtaggcctaccgatgcctctgtcccaatatcgtccttgacatattaacttgcgattctacctttatgttcttcatccagcgagaggtttccttctttttgtgctattatagtatggcctataacccaggatgctaaccgtttcctgtgttcatgtctgattgtcatactgcatctgtcttgtttaacacgacgatttatagctaacgttgtgacaacgtataggtacctatgtaggatactatgtctagggaaatgaaagcttggaatattgtctttgtccatttaatatgatgtaatatatttcatgtattcatttcctgtctcatagttgtattttcatggttattttggtttcctatgttgcctactgctaatggtttggatttggtttgtttgtcctctatcaaaactcatagttgaaatcttgatctaccaatgtggcggtacttgggagctggggcctagtgggagtcgtctggatcatgggggcagatccctcataaatggcttgatgcccttcacgtggtagtgagtgagttctcattctggcaaaactggatcagttcctgtggaaatgagttcccatgaaagggggttgttataaagccaggatgctcctcgggattttctatcttagcagttacccacttcccctgggaccttctcggccatgttgtggcacagctttataaagccctccaatagcaccagggctgcag

SEQ ID NO: 707315 - DNA, 599 bp, Homo sapiens
tcatgttcatttcacaaatgcaaaaactgaggttcagggagactgaccaggccaagcagaacagctaggaagaggcaaggctgaagcgcgaaccaaagcccgttttcctctgcctctgcccttcccttccagtgcctggtgggattgcagctgagtccctaaccttcactccactggaggacatgatctttctcaagtgggaggagccccaggagcccaatggcctcatcactcagtatgagatcagctaccaaagcattgagtcctcagacccagcagtgaacgtgcccggcccgagacgcaccatctccaaactccggaatgagacttaccacgtcttctccaacctgcatcccggcaccacgtatctgttctccgtgcgtgctcggacgagcaagggcttcggccaggcggctctcactgagataaccaccaacatctcagctcccagctttgattatgccgacatgccgtcacccctgggcgagtccgagaacaccatcactgtgctgttgaggccggcccagggccgaggagcccccatcagcgtctaccaggtggttgtggaggaagagcggccacggcgcttgcggcgggag

SEQ ID NO: 707316 - DNA, 878 bp, Homo sapiens
  misc_feature (40)..(40): n is a, c, g, or t
  misc_feature (69)..(69): n is a, c, g, or t
  misc_feature (87)..(87): n is a, c, g, or t
  misc_feature (93)..(94): n is a, c, g, or t
  misc_feature (150)..(150): n is a, c, g, or t
  misc_feature (169)..(169): n is a, c, g, or t
  misc_feature (191)..(191): n is a, c, g, or t
  misc_feature (195)..(195): n is a, c, g, or t
  misc_feature (237)..(237): n is a, c, g, or t
  misc_feature (251)..(251): n is a, c, g, or t
  misc_feature (254)..(254): n is a, c, g, or t
  misc_feature (277)..(277): n is a, c, g, or t
  misc_feature (285)..(285): n is a, c, g, or t
  misc_feature (309)..(309): n is a, c, g, or t
  misc_feature (314)..(314): n is a, c, g, or t
  misc_feature (323)..(323): n is a, c, g, or t
  misc_feature (349)..(349): n is a, c, g, or t
  misc_feature (392)..(392): n is a, c, g, or t
  misc_feature (399)..(399): n is a, c, g, or t
  misc_feature (407)..(407): n is a, c, g, or t
  misc_feature (475)..(475): n is a, c, g, or t
  misc_feature (518)..(518): n is a, c, g, or t
  misc_feature (552)..(552): n is a, c, g, or t
  misc_feature (557)..(557): n is a, c, g, or t
  misc_feature (592)..(592): n is a, c, g, or t
  misc_feature (599)..(599): n is a, c, g, or t
  misc_feature (603)..(603): n is a, c, g, or t
  misc_feature (625)..(625): n is a, c, g, or t
  misc_feature (679)..(679): n is a, c, g, or t
  misc_feature (711)..(711): n is a, c, g, or t
  misc_feature (738)..(738): n is a, c, g, or t
  misc_feature (749)..(750): n is a, c, g, or t
  misc_feature (754)..(755): n is a, c, g, or t
  misc_feature (758)..(758): n is a, c, g, or t
  misc_feature (771)..(771): n is a, c, g, or t
  misc_feature (875)..(875): n is a, c, g, or t
cactactgggcagggaagacagagtagccactgtatgcanaggggataagcagcagccggtacaccagnggcaggtgccgctccacnaacacnngcagtaagacttggtcagtgaccaggccctgccgccgcatcagcagcaccaggtcntctagcttcacagtcttgnggccagcatgaacagcaaatanctcnagatcatcacaaagatgcaggaaatatatatcaaggcacttntccaccatctcaanagncttcctctccatgggcatcttancatagaancaaaagagtttcacaaaatagatnaaaanaaactatanggggatcttgccggggactggggccngtggtccggggacctagggggatgcctgaccaacagaggctcngcaagcnctgaaganaaaaatgcaacaccaggcgctggggctggctcaagaaactgatgatgtcgcctggcctggagagactnaggggtgctggaggccgactctggacttgctgccctgccagangcatcctcatcccctgaagatgctcctggcccgncagcntcagcagtaccctgggatccctctgcttctgtcanctctgtntgtncctcagcctcttctaccctgcngggtccttgtgctcctgtagcctccatttcactcacactcacaccttcttcttncatctttttctctgcctcttcaactccatcgngtaagggctctacttcatcttctccanagaaaccactnntggnnctnaggaagcccagancaaaggcattgacctcctctgcctctcctgccagacactgggcatggtttcccagggctattcttctgcagcccaggcccactgctctgtgtcttgcgaccggnagc

SEQ ID NO: 707317 - DNA, 125 bp, Homo sapiens
ccgagctgaggacggtggctcatgtggcattgggcatttatataccacttggagggcaggctgtggcttctggagcaggtggcttgtaaggaatgtagcaggcatgcacgtgagctccggaatag

SEQ ID NO: 707318 - DNA, 308 bp, Homo sapiens
tgtaccggagctacagttgcaggcacacgcacagtcacagcaatgccagatccaagccatatctgtgacctacgccacagcttggtgcaacacaggaccctttacccactgacgaggccaggcatcgaacccacatcctcatagataccagtcaaccacaatgggaactccagcagtcattgtttaataaatacaaagtttcaattttgcaagaggaaataaattctggagatggacagctgcacaaaatatgaatgtacttagtatcactgaactgtgcccttaaaaatgttcaagaagttaagttt

SEQ ID NO: 707319 - DNA, 262 bp, Homo sapiens
ccttggggggggggggggggcctttttccccaaccctttttgggggggaagggccgggggggaccccaaaaatttaccccccccgggggtttgttttttttccccggtggggggggccccccaaaccctttgggggggggggtttttttttggggggccctgggttttttatttttgggggttttcccccgttttggggggttttttccccctttttctttcccccggcccaagggcggggccttccccccgggccctttta

SEQ ID NO: 707320 - DNA, 591 bp, Homo sapiens
gactacgacttacagatccctgatgaacacagatgctacaatccattaacaaaatactagctaactgaatctaacgaacatatcaaacagatactccaccatgattaagtgggttacatatcagggatgcaggaatggtttaacatatgcaagtcaatggatgtgatacaccacaaaaacagaattaaaaaccaaaatcacatgatcatctcaataaatggagaaaaagcatttgatacaatccagcatccctttatgatgaaaactctcagcaaaataggcatacaagggacatacctcaatgtaataaaagccatctatgacaagcccacagccaacataatactgaattgggaaaagtggaaagcattccctctgagaactggaacaagacaaggatgcccactcttactactcttcttcaacatagtactggaagtcctagtcagagcaatcaaacaagagaaagaaataaagggcacccaaatcaatgaagaggaagtcggccgggtgtgctgactcacgcctatactcccctcactcatcaagtaatcccagcacttaggcaggccgaggtgagcggatcatgaa

SEQ ID NO: 707321 - DNA, 203 bp, Homo sapiens
  misc_feature (169)..(169): n is a, c, g, or t
  misc_feature (184)..(184): n is a, c, g, or t
  misc_feature (186)..(186): n is a, c, g, or t
  misc_feature (203)..(203): n is a, c, g, or t
ccgaagtagcccttttagatacccaagacattcgagaatattgagttatgatgattggttggaattttttgaccctttggagagcagccaaagctttttggtattaaaacttcagggacttcaaggaaaaatcaacttctttgccagagtgttggttttctaagtcttngaggagttaaaggangncttttttgggatatcan

SEQ ID NO: 707322 - DNA, 290 bp, Homo sapiens
aatatatagttttaccgcgatttgggtttcagaaatactggtcttactgtgtagccctcgctaaatacaaactcctgtgctctacatatcctcctgtctcacactcccaagtgctgtggctcaggtcatgcaactgtaccagctagttttcacttctttaaggtgcagtcatgtgaacatgaagataatagagaaagcctgtgttagacatttgcatttcatgggatagagccacatctgggctgtgtgctttctctcatgccacgcagggaaaccaggggaggagatgt

SEQ ID NO: 707323 - DNA, 1234 bp, Homo sapiens
gattgtgggtgaccagactgtgatttgccacggggggggggtttgtgtgagcgtcgttgctgcccgccgctcgtcccaacgggtttttaatttcgtcgaacgttgctcccagatagtttacggagttacgagaaattgaagagtgtcgagcgcgggataggcgggcactttgtttctcccaagaggcgtgaaccaagatggttgctgccgacacaaggtccagattgagggcgtctgggttagctcgggggatgggaggggggctgcgtttataaggggggcgctgccctttgtcccggttaaagtttgtgggggtattggcacggccacggcgaacacaatggggccccggcgatgtagaccaaatcggggtatacaccccacggtggtgtgcgtagtggggaaatgtttcccctccggcgagttaatataaagtggtgtgtagtatacagttttgtttggagccaagagagctttagactggacccgcactgggctccgcgcttttcgcttgtgccgcacgggtgctggtgtttgtgtttgtgaaagttttcttgggtgtggggaaaattggtatgggtgtaggcgtagataaatgtgtgtatgtttactagaaggggacgaagtgtatagccgctttatatgtctgtcttatgttaaatacatgttgttaatgtgtacagagggagaagagtgtatatagattagtgtcgcctgtgtataaaatttctgtgtagagtaaaaagagagatgtgtataattaaatgtagtgtaatgtattgttagaggggtgagattttatgccctttaatttcttttatttaatatttgtttgttagtggagccctgtctataaaggtagttgtttcttttgccttataaaacgtgtgataaccctcgggccggggcgtggttggctctaacaacctgttaaattccacgaacaccttctgggaagggccgaaggcgcggtgtgagttcaccgagggttcacgcgagagatcgaagaccactcctggctaagcaccggtgaaagccccgttctgtacttacacaataccaaaaattagcacgggcactaagtggcgggcgcctcgtagtgtccagctatacttcacggagggctcacggcacaggaggaattggcgtgaacccgggagacggagctttcggtgagctgagatctgcaccgcctgcaatccagcctgggcgacacaccaggaccccgtatcca

SEQ ID NO: 707324 - DNA, 1222 bp, Homo sapiens
  misc_feature (7)..(8): n is a, c, g, or t
  misc_feature (25)..(25): n is a, c, g, or t
  misc_feature (35)..(35): n is a, c, g, or t
  misc_feature (37)..(37): n is a, c, g, or t
  misc_feature (80)..(80): n is a, c, g, or t
  misc_feature (129)..(129): n is a, c, g, or t
  misc_feature (149)..(149): n is a, c, g, or t
  misc_feature (152)..(152): n is a, c, g, or t
  misc_feature (278)..(278): n is a, c, g, or t
  misc_feature (463)..(463): n is a, c, g, or t
  misc_feature (574)..(574): n is a, c, g, or t
  misc_feature (851)..(851): n is a, c, g, or t
  misc_feature (900)..(900): n is a, c, g, or t
  misc_feature (953)..(953): n is a, c, g, or t
  misc_feature (1011)..(1011): n is a, c, g, or t
  misc_feature (1090)..(1090): n is a, c, g, or t
  misc_feature (1093)..(1093): n is a, c, g, or t
  misc_feature (1141)..(1141): n is a, c, g, or t
  misc_feature (1194)..(1194): n is a, c, g, or t
  misc_feature (1222)..(1222): n is a, c, g, or t
tagaagnnaatatatatttttttgngtttttgtanantaaaagccaccaaagtgtgttggtccgccttatcattcccccntccgccttctcctccgctcgccgttgccccacctggtccgactcccctntgacattattttttttccancangaaaccccgcagccctcacctcgctgtctctcgcacgacaaggccacaccggtcaagtgaggcgagtccccccgcctcccccgacgagacacacgcctcccacagcccagcctcccctttagttcnccttcgtagcagaacagagccatccacacaccgatgaagcgacctcgcacccccgctcctcccttgcccaccggcgtcagtcaacacacacttcatggcactcttactgcgcacactcatagttttacattacgactgtctcagatcgcgtcagagaatgttatatctcctaattttttggagcnaggctatcttctcttacgcgcgttccttcgaattgagaaatcgacgcaccgcaggggagtcccagacatattcactcacccctatacattctctgcgacatggtgtgtttntcacacatgtggttatgagcaatatatatataagtgtgacgacgtaataccaccacgtaatcgccgttttccttcacaagctgtatcacacctccaccttctgcgtgcgtatcactctctcaatgcgtaccgcttgagattatgtaacaactggccacgattctgtttttctctatcactcctctactcgatttaattgttcctccaccgtccctcaaactcgcccgctactccacatatgctcatgacgagcctactgccaccttctcacagtctntccctcatagtgtatttccacattagacagtgccgttctgctgtcgagngagcagacgtttcacacattctgcgatgtgtcactggttatgtcatctgtatnagcgcgaattatcgcgataccgtcagagctcgctgcgacgctcatgtttcagtgtgcncactgtgacccgcatcgcggagcgtgatccttccactcgttcgaatatcagcaccgtccagtgtcgcaccagatcctanacnaatgagaacacagcggatacatgcaatagtgttgtgtgagtgatattntcgatctcttgtgtagttatgactctcgcgctgccgacagttggcgctgtacncaccatgtctcgcgttatgatgtcggtn

SEQ ID NO: 707325 - DNA, 215 bp, Homo sapiens
cacatccctgagtcaagctgttctcttctttacagcttcccaagtggctagagattataggcatgcaccaccatgcctggctagatttagagtataatatagtaaagacagagtttcaccgtgtagcccacggctggtatttgaacatcctaggactcacagcagtctagccctaccttggaccttgacaaagatgctacggacttacaggtgtg

SEQ ID NO: 707326 - DNA, 440 bp, Homo sapiens
acgcgcaccgcggtcaaatgcaggcgattcctgagaacgcctatccttaggagagtggcgatgaggacgaagacgagcctggacaaggcgcatctcgatctgctcctctgacaaacgaattgcctgtgaggaagagttctccgattctgaagaggagggagagggggtgagcaagaactcttccaacttcaaaaaagccaagagagtcaaaacagaggatgcaacagagaaagacccagaggcgcagacagaagtcaccgaagaggagaaaaccaaggagggaggaaagccagaagccaaagggggtcacggaggaggtcaaagttggcctgaatgggacctctccagctctggcttcctgctgagtccctcacgttatttccccaagccgtcagatttatatttactatttctctgtgtaatttatataaaaatttatt

SEQ ID NO: 707327 - DNA, 619 bp, Homo sapiens
  misc_feature (90)..(90): n is a, c, g, or t
cgaaaagcaaaactggatgcccaggtcaagaagctggtgttaagtccgccggtgaaggctaggcgcctggtggctgccagctcaaaaaanacacgccaatttagaatgagaagctcttctcaggaaagcgccagaagttggtcaccaagattgcccacatctgagatgccctgtagcccctgcccgcatcctccagggggcccagggtgcctgcacttttttgtggcagccaaattgggtggtagtgggaggttgggcatggaggccagtgaaagctgacatttgtaaaaggccttcaaggaaaaaaaacccggccctgggtcaggcagtgtgagtttcccgtttgcccctaactttcttttttttttttttaaaaaaagaaaactttaaaaaacccccccttaaaaacaaaacatctttgtgttttgaacaaaggaattttcaaaatttgattgggattctgttttgaagtttaggaaatttttcaccctataaacccccctgttttatccccttttaattttgatgtttgggtattgggtgagggcatgggtttttttttttttttttttaaagggggtgtgaccaaatggaaataaaccagggcctgtgaccctta

SEQ ID NO: 707328 - DNA, 91 bp, Homo sapiens
gatgccaaaaggataaaaattaaaggtatgccctactaacctttccatatattttttccccgattttcaataaaaaccctccggcagtgga

SEQ ID NO: 707329 - DNA, 786 bp, Homo sapiens
gagatggcggaggtgctgtgtcctggtgcttgatggtcgatgccctctcctgggccgactggcggtcatcgtggctacataggtactgctgtgccgctaacgtggtggctctgtacgctgctgaagggatcgaatatattctaggactacatttactaacacgacagacagagttcgagaggtaactctagtgcctttcctcctgccgtcatacgcgggatagaaacacactaaactccattgctcgcgaagggctcgactacgcagcttgcacgaggcacacctcatgccgactattctatcatgggctggatcctggtgcgagtgtattgctcgactctcagtaaagatgcaagtcgatggactcatggctccgatactggaccacgtcttgcacggtcgttaggactgcgtgatcgccagcgcagacccctgacgaccatacgtagaaaatgcctggaatagagtggggttacctatgctagcgcactcagaagtgtcgttggcgtcattgacacgaccgtactagatgacatagtttgctctactctcgtgcgcgtcgtcttggactcgaacgaggattggctcgtgaaagatcaccgagagcatagatgaccagatcaccgctgagtgaggcatcacacgcaggcaaactgatgagcgccctagatctcgattcaagcgggtaaagaagcaaactacgatcaatggagggtcatgggttgtccaggtctgtacgaagcaacgtggcagcaagcacccttttgcatcagatcatcctagtag

SEQ ID NO: 707330 - DNA, 388 bp, Homo sapiens
catttagactatctgtctatttcttttctttctttttttgagatggagtttcctcttgctgcccaggctggagtgcaatggcacgatctcggctcaccgcgacctctgcctcccgggttcaagcgattctcctgcctcagcctcctgagtagctgggattacaggcatgcgccaccacaactggctaattttgtatttttagccgagacggggtttctccatgttggtcaggctggtctcaaactcctgacctcaggcaatctgtccaccttggcctcccaaagtgctgggattacaggcgtgaaccactgcgtccggccaactctctgtctttctatgcactcaaaggctgcaaagtcagcttcctcctagatagttgtaaatggcg

SEQ ID NO: 707331 - DNA, 667 bp, Homo sapiens
acgccacaacatcttaaaaggaccaatcaaggccgggcgtggtggctcacgcctgtaatcccagcactttgaggggtcaaggcaggcccatctcctgaggtcaggacctcaagaccagcttggccaacatggtgaaatcccatctccacaaaataataaaaataggccgggcgtggtggcagacgcctgtaatcccaggtactagggaggctgagacaggagaatcgcttgaatccgggagggggaggctacagtgagctgagatcacgccactgcactccagcctgggaaacagagggagacccaatttcaaaacaaaacaccaaattacatcattatagaccagtactatccaatacaaaataatcgatcagaaagctggtgatctttatctcgaagagccaatactaaattcgttttcaccttaaaaaaaacaaccccaaactactatttaacagattctcagacgccaaaagtttcacacagtcaaaagtttcatataacgactagcttgactaagatgatcaagagatagaagccctatatggcagaccattgttagctgaatctaacaatgtctttcgggcccaaactaaggtcaatcagtgatgacgcttcacacattgggttgccggcgcggcgtaagctgtatccagccttggaggca

SEQ ID NO: 707332 - DNA, 430 bp, Homo sapiens
gcttgttcgcaaggggttggccgccaggaacacaggtaagtgccgtgtgtggttcccgcgggccgggcctctttacgggttatggcccttgcgtgccttgaattacttccaggcccctggctgcagtacgtgattcttgatcccgagcttcgggtgggaagtgggtgggagagttcgaggccttgcggccttacggagccccttcgcctcgtggcttgagtggaggcctggcctgggggctgcttggggccgccgcgtggcgaatctggtgggcaaccttcggcgcctggtctcgctggctttcgataagtctctagcccatttaaacatttctggatggacctggctgcgacgcttttcattctgggcaagaatagtctggtaaaatggcgggccaaagatctggcacactgggtactaccgggtttag

SEQ ID NO: 707333 - DNA, 298 bp, Homo sapiens
actgcagcctcctcgcctcctgggttcaaccgattctcatgcctcagcctcccgagtagctgggattacaggctcgggccacacacccggctaatttttgtatttttggtagagacagggtttcaccatactggccagcctagtctcaaacttctgacctcaagtgatccacccgtcttagcctcccaaagtgctgggattacaggcgtgagccaccacgtccagctgagtttgggaatttctagccactgcctctttgggctccttctctctaggcatcagtttcccaaattgcctc

SEQ ID NO: 707334 - DNA, 418 bp, Homo sapiens
gaccaggcatgccaggcataccagccatcaggccacatgcatctgtctccagaagctgcccaagtagccatgctggatctggcacacactttctctccaagacttaggaagcacttatgacagtggtcttgtctagagagcatcacggacggggattcagagtagctacaagatgctgccacatggacttgaatcacgcattcaattcctaattgcaagtgaaagaaaccgcctgagggggaagggctgttgctatactgcagtgctcacagcactacagaacccccattgtggggcttacccagagccagcaacaccagagtttgcatgttttgtttttttttaatttatttttagagatgaggtctcactgttgtccaggtgggagtgcgaacgtattcacaggtgcaatcattgc

SEQ ID NO: 707335 - DNA, 377 bp, Homo sapiens
tttttttgagacagagtcttgcactgtcgcccgggctggagtgcaatctcagctcactgcaacctctgcctcccggattcaaccgactctcctacctcagcctcccgattggctgggattacaggcgcctgccaccacgcccagctaatttttgtatttttagtaaagatggggtttcactatgttggccaggctggtctggaacgcctgacctcgtgatccacccacctaggcttcacaaagtgccgggattacaggcgtgacagctgcgcccagcctaaattaaacacttttaatgggtaaagtccatggtatgtgaattatatctcaataaagttgttttataaaaattactgaccttaaattatctactatta

SEQ ID NO: 707336 - DNA, 204 bp, Homo sapiens
ggacttcctgacaccacagtcaattaattcctacaggggccttggcctggagaaaaggtgcgcagcccacaccactcgtcagctgccccccaacatccgtctatggctagagaaggcagggcgtggcctgtaccatagactgctgcgattggtttgatctgttgtgttgttcttaattccatggtagaataacttcctgttttt

SEQ ID NO: 707337 - DNA, 294 bp, Homo sapiens
  misc_feature (178)..(178): n is a, c, g, or t
  misc_feature (188)..(188): n is a, c, g, or t
  misc_feature (254)..(254): n is a, c, g, or t
cctgagtcatcgggcatgcagctgcaacttccacctattttttttttctctgctattacttaggaagaccaaatggcaccagagataagactcccttagatccccacttagatcaccaccctttctcagggggtaataaagtcatcttccttggaaattttgggggttttaaaagggnccaattcctnaataaccaatcaaagcactgtaacatacgcactggtcttgtatggaaaatgttgtaatcctgctanaattcctctctctttgcctgtggaagtgaaaccttaactt

SEQ ID NO: 707338 - DNA, 108 bp, Homo sapiens
acgctgtcttattattctcatcgactgaggattattgatctgtcttcactcagcatcttccatttgcatgttttaggagaagctgtggcggccggagaagctgtggcg

SEQ ID NO: 707339 - DNA, 124 bp, Homo sapiens
aggagccatgaacggagtgaagtttcttctcttttcttctttagtcactcacgcggctgtcctgggctgccatgtctcaccagtgcctgggttccagccccacgccgcgagtctggtgtatttg

SEQ ID NO: 707340 - DNA, 205 bp, Homo sapiens
  misc_feature (43)..(43): n is a, c, g, or t
atccccccccggggggcccccctcgggtggggggggttttccnttttcccccttttttaaaaaaaaggggcccccgggaaacccccccccggttttttttccaagggtttcccccccccggggggggggggggtttttttaatttccccccgggggggggccccaaatggttttttccccccaaaggttttttttttttttttta

SEQ ID NO: 707341 - DNA, 1507 bp, Homo sapiens
gagcggccagtgcggccagaggcgagctgacggcctggaaagacgaaatcaaattgcagcctccccaaagacgctgagttactgcgggcgagcctggttcccgtgggatctgttctgcgagcgctgcagagagccgctgcctgcgccgcagagccctcccggggccgcctggccagaagctggggcgccgtccgacaggcagcagcccctgtggcgcggggttcggccgacgatgtgagcccctgttgcagatgatggggtgctgtgcaatggctccctgcctgtgcccgaacataggaagaacaacgagccacttgatgtctgagataggaccaacattataaaaaaaaataccgtgagggagcacgaaagaacaagcaagagagaagaaagaagacgaagaacagaggaaaaacaaacagaacacacacgcgagcaacagggagcagcgaagaacaagaaaacggagggaaaacacaaccacacagaggcagaaaaagagagagacagacaaaggaacaacagggcaacataacaaggaacagaacaaccaggagcgcagcgacgtcaccaggaaccccgcacacgaccgaacgagcacaagccaaaaaagaaacacggaggaacgaacacgagagacgcagcacgaaggaaacaaggaaggagaacaacgaacagagcaggagcaagcaacagccaacaggacgccccggaaaggcacaaggagaagccacaaacaacacagaacacaaaaacgcacagagacaacacacgagaaaagagacagcaaaaagaaaaccagatcggcacgaaaagagacacaaaagacaaaccccacgaaacaaaaagagagaacacgcgaaacaaagagagacagcaacacacgaaagcagaagaacaaaagaaccaaaagaagaatagaacaacacaaacaagcaccgacgacgacggggaagcgaacagacacaaagaacgagagcgagaaagaagaggaagaacaaaataagcaaagcaagaagacgagacagaaaatgaacagcatcgaagaagaacaagagagacaagagagcgacgagagaagaacgcgagcaaaacgacaagaagaacaacacaagggaggagaaacaacaagcgaaagagagggaaggagagacacgagcaaaggagcgagggagcagcaggacaccagtccgcgcgggcaagccagacacccgaaacgctgagacacgtcgtagatgaaaaagtagagaaaagcaggggagaacacgggcaagcagggcacgggacgcagcgaatagaagagaacgacagcgggaaggaaaaggagagcggacaagacggagacgacgcagaggacaacatggcgacaggacgacaaagagagggagagagggaggacaagcaggcgaacagaaaaaaccaccaagagacaaggagcgaacgaagggacagaccagaccacgaaggatgatgagcgaactggcgagacttctgaacagcgacgcac

SEQ ID NO: 707342 - DNA, 166 bp, Homo sapiens
aaggagctggggctcagcatgggtctgatgttgggtgctactcctgtatgttggacccctgcttctcttcttaaaacacctcttctcactatgtacttctcttctaggaatggatgtatattgctacctactgtcacgagaagggcggctagaggatgttgagaac

SEQ ID NO: 707343 - DNA, 209 bp, Homo sapiens
ctgggactccttattaaaaatttgtatatctattgtgtatttatgtgtgtgtgtctcatattggggtttcagctatatcagcaaatactaacaaagactgacattaacacaaagagagcaatacaattattgtaggatatttcaatactccactttctgtaatacaacacgacgagaatattacgtatggaaatcgaagacctagaagg

SEQ ID NO: 707344 - DNA, 333 bp, Homo sapiens
  misc_feature (12)..(12): n is a, c, g, or t
ggaaaacaaccngagaagaggaagaaaacaaggagaatgaccccccttagagcacccttattggttttatggcaccccctatttgcccgagtaaaatggaagtaatacagtctttgtgcaaatttacattgaggaaaaagagccctaaggtcaacctgcaaattctagagttcctagtccgtttttctctattttcctttctgccatgctttaagtctgctgttatttttccactgagataaaaccactgtttgggtctaatagttttttgggtttttcttgcaagctggcaaatttgtatttatctcatggctaaagtactggagtaaaagt

SEQ ID NO: 707345 - DNA, 335 bp, Homo sapiens
accgcggctcagttaattaacgtgaaacgagtatgataatttcgaagattacttttaaacccggcttattgtaagtctgtgatgagcttagttttccttctgcaccaagaattaaataagagaagcggctgggagcggtggctcaggcctgtaatcccagcgagtttgggaggccgaggcgggcggatcacctgaggtcaggagttcgagatcagccctggtcaacatggagaaactccgtctcctggattcaggcgattctcctgtctcaacctcccgagtggctggaattagacatccgtcaccacgcccggctaatttggtatttttggtag

SEQ ID NO: 707346 - DNA, 341 bp, Homo sapiens
  misc_feature (266)..(266): n is a, c, g, or t
atagcaaatgttaagttactaggactgatgtgaatttggcaagattgtaggatacaaggccaggtgtggtgcctcacacctgtaatcccagcactttgggaacctaaggaaggcggatcactggaggtcaggagttcaagaccagcctggccaatgtggcaaaacccagtctctactaaaaataaaaaaattagccaggcgtggtggcatgtgcctgtaattccagctactcaggagaccaaggcacaagaattgcttgaacctgngaggcggaggttgcagtctgccgacaaagcgcccctgtgctccagcctccgtgacacagtgagactctgtctcct

SEQ ID NO: 707347 - DNA, 179 bp, Homo sapiens
acgcccggacaccttcaagatggagtttgtcaattcggccacctccagccaccacaccaaccacagctctgtttggctgaggagataccttcttggagccggagggcatcttcacactgggtcttcttggtctcagggtcttcgtgaggagggtcttggtgaggggcataagcaggaag

SEQ ID NO: 707348 - DNA, 433 bp, Homo sapiens
  misc_feature (5)..(5): n is a, c, g, or t
  misc_feature (19)..(19): n is a, c, g, or t
  misc_feature (196)..(196): n is a, c, g, or t
aaacntttccaaaatatangattaccatgccgcctgattaaatgtccgttaataaataactgtgtgaaaaactcctccaaatagccctgtccaagaaagccgacctgtgaaggcctgggccatggtggcctcacaccctataatccccagcactttgggaggccagcgcaagtagatcacctgaggtcaggagttncaagagcagccctaggtaacatggtgaaaccctgtctctactaaaaatacaaaaattagctgggcaaggtggtatgtgcttgtaatccaagctacttgggaggctgaagcacaagtattgcttgaacctgggaggcagagattgcagtgagccgagatccaagtttgtgccattgcactgcagccttgtgacagagcgagactctgtcaaaaacaaaaaacaaacaaacaaaaaaaa

SEQ ID NO: 707349 - DNA, 130 bp, Homo sapiens
tgctatggaagaaagaacaagattaaaacttatttcccatacgctctttttgggggaggggggttagcatttccgctttcaggtgagtcgcattttatagaataaaatgaatttgggttgagaaaaagca

SEQ ID NO: 707350 - DNA, 354 bp, Homo sapiens
tgggggaaccccccgggcctttccccccgggttttttaaagattccagggccccttttttttgcccccccttggttttgggggcccccaaaaaaccaagccccttttgccccgtgggttccgggggtttttggtcccccccctccagggggtgggggggttttttttttgcccccattttttttgggccggggttcccccccattttttccccccgaccccccaaccccttttgggaaaagttgcccccctggccctccgggtccccccccccccttcccgggtggcccgttaaaaaaattggttggccgctcctgggcccgtttttttttttttttttttttaaaccccccca

SEQ ID NO: 707351 - DNA, 826 bp, Homo sapiens
  misc_feature (221)..(221): n is a, c, g, or t
  misc_feature (800)..(800): n is a, c, g, or t
cctttactatatgtaaatatgtgtttagtttcattcaatagatgaatgctgttcacatctagagagccatttgcatgtcagcaccatctgggtgtgttctggcttatgttgaaactgaacttgaaatgttggtgttaaacaatggttttaattattataatgttagaaatgattcaaaattcagtaagtagcagcatttcagagcctaccttcatgctgantaggccaattccgtaaactactgcctcccccctctggtgatcatctttgagaaatagtgtcttgtggaagaaaaaagtgtatttctctagtaattggttttgaattttatgtaatacctagattttactgtttataaacaatcaagacctctgatagagctactgttgggctttgcgtttatcctaataaaagttaaatgtgatgaactggttcttcatatctttgagactataaataattggcaaattttctgcagcccagcagagattatgtaaactggcctgtaattaatatgaaatatgtattttgtgtattttgccaaatttagtgattgtcaagaatcatttgcccatttgaaggatcacatttatattagaagttattggagccaaggtgggaggattgcttgaggccaggagtttgagaccagcctgagaaatataatgagaccctgtctcctacaaaaaatttaaaaacaagttagctgggcatggtggcacgtctctggtagtcccagccacttgagagactgagttgggaggatcacttgagcccagaggtccaggctgtagtgagcnatgatgggtgtcactgcactccagcc

SEQ ID NO: 707352 - DNA, 234 bp, Homo sapiens
aagatgccaagatcatgccactgcactccagcctggtgacacagcgagactctgtctttaaaaaaaaaaaggagggttaatagaattctgccctctgggaacccattccatccagtaagaaagacagaaaagaacataatatcaccataacttggtggtgggttcggatggtgatggtggatgggatacattggggtcaagcacctcctttctaagcatggatatggccagggt

SEQ ID NO: 707353 - DNA, 393 bp, Homo sapiens
  misc_feature (59)..(59): n is a, c, g, or t
  misc_feature (82)..(82): n is a, c, g, or t
gctccatagatgtttgctgaatgaagggattcaatggtgaactaaattgggaacacaantgggtgaccctgagttcacttanagtctttgtgcctctggaaaatgggaagcacacttgataatctccaaggtccttccaacttggaagcctgtgactctccccatctcgggcagtttctgcttccacccatcctgttggatgactgagatgcactctgtgagcatccaagaaagccctggccctttgctggagctgatggtgagaagactgtcagtgcctgccccatcagagcccttggaaagatctcatcacatctccaggagcccaaaaggcagaaaggaggaagaaattaagaaagctgtgtttgtgcctttctaatttatggtcataaa

SEQ ID NO: 707354 - DNA, 504 bp, Homo sapiens
  misc_feature (177)..(177): n is a, c, g, or t
  misc_feature (220)..(220): n is a, c, g, or t
  misc_feature (267)..(267): n is a, c, g, or t
  misc_feature (348)..(348): n is a, c, g, or t
gcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctntattcgagaacaggtgaatcagttgaatttgtgtgtaaacggngatatcgtctttcatcacgttctcacacattgcgaacaacatgttgngatgggaaactggagtatccaacttgttgcaaaagatagaatcaaatcataagtgcacacccttattcagaaacttagtantataatcagtctcaattcaatttttatggattgtttaactccttttaatcataccgaaaaatttggaataaattggggaaatggaaatattaggtgagaaccgtggctctcttttttaaagcaccatatttattctcggaaacttaaaaaaaaaaa

SEQ ID NO: 707355 - DNA, 532 bp, Homo sapiens
  misc_feature (530)..(530): n is a, c, g, or t
  misc_feature (532)..(532): n is a, c, g, or t
cagtgtgagtcaatctccaggcccccagatggtacattcaggcaccagcatattcctatgcatttctagataaaagtatttttcagaaaacctgagcatatgtcctattaatacaacttactctcatcagctctgcatgagaagaagggggatttccctcagtagaacagtcagaatggaatcacagacttgttttgagccagtcactggtaagtgggggtaggctaaaatgataagctcagaatctaaaccttagactagggaatggcaaactttttccataaagaagcaaacggtaatattttaggcttttggtctagataacctctgttgcagtgacacagtggtgccatcgtagcctaaaagcatatgtagacaaggcataaatgaatggacctggttttattccagtaaaacttaatttatacaaacagtcagagggccagatttggcccttggtctatagtttgccaaccctgtttagaccagtcacaatttattccctggggctgggccaactttttctatanan

SEQ ID NO: 707356 - DNA, 473 bp, Homo sapiens
cttcgcgcatcataatgaagtgtcacatcactgatcatcagagaaatcaatcaaaaatacaatgagatatcatctcaccctagttaaaatggcttttatccaaaagacaagcaataacaaatgctgtgagaagatgtgaagaaaaggaacccttgtacactgttggtggcaatgtaaattagtacaaccactatggagaacagtttagaggtttctcaaagaactaaaaatagaactacaatatgaaacagcaatctcactgctaggtgtactcccaaaagaaagcaaatcagtatatcaaagagatatcaagcactctcacatttattgcagcattattcacaacagccaagatttgcaagcaatataagttcccatcaacacatgaatggataaacaaaatatagtacacactcacgatggaatgctattcagctattttcttttttttttttttttaatgataccgcgaa

SEQ ID NO: 707357 - DNA, 240 bp, Homo sapiens
ggtggggttttttttttccggggggttttttgggggggggtggcccttttttaaaattttccccgggccccttttttttttgggttttttggggaggggccggttgccttttacccccccgggtttccccccccggggtttttggggttcttttggggggggggggccatttttttagttgggggcgggggctttttccccgggggaattttttttttttaccctttttcccccccccca

SEQ ID NO: 707358 - DNA, 881 bp, Homo sapiens
  misc_feature (651)..(651): n is a, c, g, or t
ggaggtgcggttggtttagtagggtgagcttggtttgtgtccctgtgggtggatgtggattggtgatcggcaggatcctggtatgcgcctaagcaggtcaaagtgcatatcattcggttgcataaccacttacacggcacaagacctgtcaaccctgtgagtgtggcagccctagttgactaccaagtcagtaaagatgtggaaaggcctaagatcctgggataaaggaaggcattctcactccactgatccagctgaggctccatcatttgctaggctgagcaagcgtggaagtatgagccggtacatcttttcatgacgtacaaatatcctagaaggtagtctgacacctgctcctagcgtgcttgcgtctagataggtgtgtatggcatatcttcgtgaaaagcgatgagcgcatggatcagtccaccctgggtattggagagtcccaaggatgactatccggactgagaaatagtcgatatggcgacaggactctcacagatgcttggtggacttggggatacccgactcagcaggagtgcgtcctcttttcgacatggtccatcgacagcatgcgtgaagtatttgggcgagacagcggacttgttctttgatcattatcaaatcatagttaaggagggggatgtncagaaaacccatggtttatctgggtaggttagaaggtctctgatggaaggttggttaatctgggtgagactcctgtacgatagaattgaaagccttggtttcagggatcgttggaatcctttgctaatggcatagggatgggtaaggtgaatccccaaagggtataataacaaaatatgggagttaaatttgttgagagtgggggaaattggatatttacgcataataag

SEQ ID NO: 707359 - DNA, 1022 bp, Homo sapiens
  misc_feature (1019)..(1019): n is a, c, g, or t
agagtcggcgcattcacgagaccgggaaaggatagtgcaatgcattacttccacatgtcaaacgatttctccagcttagctataagctgatacagctttattacttggataacatcatctccattagaatgtgagaagtgcatagcggtcattagttgcatatcagtcaatgctcttggaactttgttaaagtattatgactgtcgtgtacatagtaggagaagagagttgaatagcgagagagaatagtctggacagtagtagtcgttgtggttctgtaaagaaatagcagttcctagttgtttttagaaggtcatttatatgggtgtcattgagccagcgctggaaaattaggaataatggtagaatgcaaggcagtaattaccttcttggagaaggacgtctgaaggcggcaaacagaagggagagaacctcatgggcagaatattatagaatgagtgtcatattccagcatttgaattgggaaagaggaagaggtgaagatcctagagtatgattatgaatcgtgccctgtgtttttgaccgtgtggaacaatcagtttgagctgatgtgtatgagtgtcgtcatcgagatgaaagccctagtatgtaaagtcgaagtccgatttacatttggggtgtttggatagagaagagatcctccatagacgtggggtgtaatcatctgtggaactgggtaatagtaggtccaagggggagcactcttgtacccggtaccggggtacaggccgggatcctccacaatctggataccggggcaggggggctataagcgcggagcgaacggcagcgacacgggctactcctagcgagggcaatgaatccacgcagtggggcagtccgaaaacatatgatgagcgtgctagaaaaagagctgagcacatcgtgtgtctacagcagtgcacgccgacgcgactacacaaaacaacaaccgaggctctctccgctgctttctcctccccttatactagttagctctcaggagagaagaaaagcanaga

SEQ ID NO: 707360 - DNA, 391 bp, Homo sapiens
attcctttttcctttttttgccttttccctcaatagttgccttttagtgctgtaatagttaaatcctccagcataatcaataacttgcatatgaagtaaaaaggaatactgtgaaaggggagtatttttgtacagccagtttttttatgcaaaaatttatgcatttttccaattttatattaaacgggtattttcaaacaataggaaacttttttttttttttttttacagtttagtgtatttggtttttacatggaagactaaactcatgcttattgctaaatgtggtttttgccaactaaatttaaaatgcagcattttaaaaatttacatatcaatgtttttccagtattgtttgttaatttttaaataaagttatgatcagtgtgca

SEQ ID NO: 707361 - DNA, 1071 bp, Homo sapiens
ggttgttatgttcagattcagtttggtgccgtgatgctttgcggttgtgatcagtctgttcgaactgtggtgatctgtctgtcgcgccgagtcgttaagcggtagcgtatgagtcctggagaaatggccgtaaatccttcgagtgacatcgtgcaaaagcaatagatgtgactcgtagtcagagtgctggaagtgttgtcagtaaggtcacgccacgggttgaggtaaaacgtgccccgcgtgagaagcatgcgtagaaccagcgcaaaaggacccgatgacgtgagatgcgtcgactccttctcgtaccagagcggggatgtaaacaattcatccactcggattcacgggtctcggcgtaaaccgctttgagggtgtatccatacactattttccgttggatcacgtcacgacagaggtaagaccctcgacgtgcgtagcatcactctgggacaccgctaggacctttccaccgaagcgtgtttgtggcaacgggtgacgagatcggcgtcacggtgactcatgatggaatccgacgctctgttgagttgtttctggcagcactggcatgccgagttcggggtgccgccactgctgatttgaagcgagtacccgtgaagaaggagttcacctcttgagcttgtgggcgtctaggttcaacgcacaggaagttcaacacacaaccgatggtgaatggccttaggttcccaagcgcacgtaccctaaggaggttggatcgtaggatgcactgaaccctacagtgcgaaagacacgtgctgcgacgattgcgttggctttcgtagcccgggaattgttatcgcgtgcgaacgaacggaaggatagtccctcgaaagcgttggatacgtggctaagcaagtacgcttttcctcgcgcaagtttccttgtgcgtacgccgtgacatttctacttgctgttcaggccatagggcaaattccaaggaaattcaagtgggaaggccatggttgcacattggttggccaattagaacaccaggttgggaattgccaatcgtttgtggaacagtttcttgtaaacccatgggttccccga

SEQ ID NO: 707362 - DNA, 486 bp, Homo sapiens
  misc_feature (45)..(45): n is a, c, g, or t
  misc_feature (249)..(249): n is a, c, g, or t
tgaagtgacttgggacaacttccaattcagtccctgggactgccntggaggtggcttccccatggccagcgggagccttggccttggcccgtcctgtggacttcctgctctttgaccttaattgccatttttcaaagcacacctgtgtggcctgtgtcccctaggaccccctttcttgcagcgctgtgctggtttcttacagaatggttctgggccttggaacagcatcccaccccaccatggccctgntgccacacacatgtcctgtgaccacatggacagagacatcccaaggctctgccatcaccagggccacagcatggagaggcccagagctcggccagctgtgtgcagagggggctgggccagagtggggaccatgagggcctgtctctccaattgagacactggggtgggcttggaggggagtagatgccacaggctggagagctcagaccctggcaggggccaggatataaaaaaaat

SEQ ID NO: 707363 - DNA, 112 bp, Homo sapiens
tgactttcacctttgacaacgtgctcctggaaaatacacaattagcatcatgcatgaaggattgtgcttggaggacaaggagccttgaagttggagttcttgaaggatgacg

SEQ ID NO: 707364 - DNA, 625 bp, Homo sapiens
ggctattttttgtcttgtggacaggcctctgttgacagatgggttctccgctctatcaccctaggctgaatcatgggtctactgctatctctcagcctcgctgggcctgaagggatcctcctgcctcgccctcagcctctctgtagtatgtctgggaccacatggacctatccacaccctatgctattgttatgtttattttttttgtacgagatgggatctcctctgtgtatgctcaagctcatctgtgaattcctgggctcaacgcgagcctcccacctcagcctcccataagtgctttgatcataggcactggtgaggtggaattgatgatgaatctgtctggcacaccttggagcaatctccagtaaccatcagtacgtgaggataattgggtaactttactgaaagccctgtggaaggaagtcctttaaggatatggaaagacgatggatatatcaaatgcctgacctgttctccaaaaataaggaccttcaaataggagtgattgaaatcaatgatctacttgcatgttacgctgttcatttgggtggaatacttcatcagaataaactatgggatcttgtgctgtgtcaaagtaacagataacgacctggtctcagag

SEQ ID NO: 707365 - DNA, 856 bp, Homo sapiens
  misc_feature (35)..(35): n is a, c, g, or t
gggtgtgtctaaccccgcggccccgtgtggtgtgngccccccgggtgcaacgaactgtgggcggccagcctgctcgtgtgtgcatacccctttggggggccatgattattaccagcacggccttcatgcgtgcgcttgggggccccagccgaagctcggttgggttctgctgcggtgtgggtgtaacagtcttttcccttgtggccgccaatagagccctcgcggttggtggcacacgcgcgcctttggttctgtcacgaccacacccccccgtgggaggtttcttccacgcgggcggccttctattttttctattttgttcgcccgcgggcgatacgaactgtcgctcctgttaggttagttttgtgcccgtacgcgccagaccctcgctatcggtctgcggacgcgccctcgctcgccgcgcgtgtcggtgcgtgaattagattactcttcttctacggggggtccgcaaaccagtcttctacgccccccccagtagcgttttgttaggagtgttatgtggcagcacgctccgcagtatactgcgtcgctggttatccccccctcttgtatactctcctgggggaaatactctctgtggatggatgacacaccgtttttctggtctacaaaatagacttttgctctttattgcgggccccacaatactgtgttgccaccccgcaatacttgctcttttaataatatattccaccccaccaagctgggggcccccccccccccccctaaacaaaaccccccttttcccggacaacccccctttttttaccacacctttccccccctttttttttttttcccccccccccccatcatttcccgggtttttttttta

SEQ ID NO: 707366 - DNA, 965 bp, Homo sapiens
  misc_feature (390)..(390): n is a, c, g, or t
agtgcccattacggccgggggggggacaaaaaaaaaaaaaaaaaaaaaaaaaaaaatttttggccggcctggcccccgaaaagagctttcccgaaaccattcgcgttgggggcggcgggggcccataagaggatatcgagggaaaagtggggctcatagacgtgggttccctagaggaaaaaccgggggccaggaacatagtgggcgtgggaattccccaccccaataaaaaaaaaggcgcgcggggggaaagacacggaacgggttccgtgaaccaaactcccaagaagggggcagtatctaggagaggcacaaatcaaggggagaattcatcaccagcggcgacgtcccacacgcgaacccggaaattaatcaaaattatagcccccncggcgcagggggacacataacgaaataccaggaccaaagacaacacagccacaagacaaactaacaaaaggaaaccacaacaaacaaacgaccacacgacaaccaacgcaaccaacgagacgaccacgaccggcagacagacaccagacaaacacgacagacccacgaaccaccaaacaacaagacactcacacacaacccaccaccaaccaacgcagcacacacaacagacaaaaccccgacgaacccacacaacaaaagatcgagtctgatcgtccacagtcggtcgggcgaagaggtaacggcaaaacaagcgaagagaccgcgtggagcgggggggacggatgtgggggagagtcagagaggcaaatacgtacgagaactgaaagagggcagcaacagccggcaacaagctcaggaagcgaccagacggagatgctagaaccggggcccaccctcaaatcagcggcgtacccatgacaagaagacacacgaccgtgaccccgaccctgtcacgccgcgacacggctgtttcggtgccactgggccgggggcacgcacacctagcacaacga

SEQ ID NO: 707367 - DNA, 516 bp, Homo sapiens
tcggccctgagtcccgtcccaggctctggctcgggcagccgcgccaccgctgcccaggacgtcgggcctcctgccttcctcccaggcccccacgttgctggccgcctgcgagggtggcgcgcatgctcctgccttggccacctctgcccccgccgtggcctgcgctcgtggtgctgggcctcttcgggctcctggcagcatcgagccccagggtgtgctccagtagtgcgtcggagaaccagacctgcagggaccaggaaaaggaatactatgagccccagcgccgatctgtgcgcccgctgcccgcagacctatgtctcagctaaatgtagccgcatccgggacacagtttgtgccacatgtgccgagaattcctacaacgagcactggaactacctgaccatctgccagctgtgccgcccctgtgacccagtgatgggcctcgatgagattgccccctgcacaagcaaacggaagacccagtgccgctggcagccgggaatgttctgtgctgcc

SEQ ID NO: 707368 - DNA, 119 bp, Homo sapiens
tcccctctcttctcttcgtctccaacgcctcttcatattgaccggtcgatccctaggcgccccccctatgatagcagagttaccgagactcgacattcgttaatcatcgtcactagcta

SEQ ID NO: 707369 - DNA, 498 bp, Homo sapiens
tcccggaatgggcgtccccccacaagaagggtggcgagaaaggaaaaagggcccttctctgcccatccacaccgaaagtgtgtgaacacccggaggaataccacccatcccgaccattccaccagccgccatacccatgggaatggggcttccaagaaagcgtgccacctctgggccacatccaaagagaattctggaaatttgcccatgtaagagagaatgggaacatcccagatagtgccgccattgaccacccaggcgtccaaccaagactgtctgggcccaaggaataaggaatgtgcccatacccgaatcccttgtgccggctgtcccagaaaacgttaatgaggatgaagattccacccaaattaagctataataactttggttacctatgtgacctgttacccactttccaaaaatctaccagaccagtccatgtggatgagaactaatcgctgatcgtccagatccaaataaagttattaaattgccaca

SEQ ID NO: 707370 - DNA, 739 bp, Homo sapiens
gcgcggagatgtggaattcttctcgggaggcagtgctgggtcctttccaccataatcatcgtatccccaccggagtcaaagtattatagactgagctcgccacaactccacggaaagcacgtatgccctgactctgcgtgcaagatggtcctgacgccctaggatctcactcatttctttgtcaccacgtaggggtgggacttgactgggacacatacgtattagcacaacctcatcacataagacaatcgtcactacaacgaacaccgtcacatacggatgtggatagcatccagcgttatcacagataggtgattcctaatcgaacatagggaaggctggataaatttacggactcaaatcaataaggggaagggacatcaacacatatccaacgtggacatttatgcaccgagctacataactgcaagggccactaacaacacacatatgaacacacaaaaaccaataacagccacaaaaagaatcgccaatttatacacacgttactccgaatatttgccagttcaggggcagtttcaagacgttcttaaaacagtgttcaccttttcccccgacgaaaacgacacgtatatcctacgggaaccttaattcccgggaacattggccacccccgacaacgggatacaccgtcggggaacagtaagcccacggaagttggcagacacaacacacagaatggacacaacacttccataagtcaatccatggaagggac

SEQ ID NO: 707371 - DNA, 898 bp, Homo sapiens
  misc_feature (1)..(2): n is a, c, g, or t
  misc_feature (4)..(4): n is a, c, g, or t
  misc_feature (6)..(6): n is a, c, g, or t
  misc_feature (28)..(28): n is a, c, g, or t
  misc_feature (34)..(34): n is a, c, g, or t
  misc_feature (58)..(58): n is a, c, g, or t
  misc_feature (63)..(63): n is a, c, g, or t
  misc_feature (65)..(65): n is a, c, g, or t
  misc_feature (150)..(150): n is a, c, g, or t
  misc_feature (640)..(640): n is a, c, g, or t
nntntnacatacgtctcaccgcaggcgntagccnctgtttatgtattgggaggagagnaaggnancttcaacgccgagaacgacaccagggcggccggtgtttttcttgagagagcaactagccaccacgccccaaccacccccgtccancacaagggaggggcgcaacacaatactcggggaagcccggccctccggaacccacacggacaagcgcccccacagcagcgcccgacgaacaagcaagaggacaaggcgacaaacagcgacacgccacagcaccggaaagacccccaccaccaaagaacgcgccacacggaggccacagagcacacagcgaccaccgcgccagcccgggagcgaacaacacagcaacaacaccaatcgcgcgagccacacacacgcgggcaacacagaacccgcacacccgccaaggcccgcccacacgagaaccaccgcagaccacgacccgcccacccggccccctccaaacacaccaccggcagccccgaacaccccaccgcggcgaacgcccaccagaccacccggaccacgcgcaaacaaccaccacccacaacccacactccaacaaaccgcaccgccccacaccgccaaccccacaccgccaccaaccgcgcancggcgcactgaccacaacagacaccgggaaccagccgaaccccaacaaaccacacacacggagcaaccccaccccccgctcaccgcgcacaacccaccgcgcgccgaccacccacaaagcgcccgccaccgcacgccccagcaaccaccccggcacgccccgcgccccacaacacggcacccccgccaacacactcaccgcccccacccacgaccaaccggaccaccccaacacctcgacccaccgcaccgcgcccct

SEQ ID NO: 707372 - DNA, 151 bp, Homo sapiens
tgtggcgatctgtgcacctacgacaaggccaaggccaaggagctctacgccaaggctggtggctacaagggcaccctcacatcgccgtcaacggcgacggtgaccacaagtcgtggtcccaggccgtgtgcaacagctggaagaacgatct

SEQ ID NO: 707373 - DNA, 176 bp, Homo sapiens
gccttcagttacaattcatgatcatggcctagtcctactaaatttagtacatgcttcccaaatgctagtacataagtcccctatatagtccagcagcacaagctactactaccatactagtgtgatacctcatctaccagaacatgtggtccactagaaagacagcaataaattct

SEQ ID NO: 707374 - DNA, 432 bp, Homo sapiens
ttctagagtatccccaggactgcctgcagacacgactctcctgcctcagcctcccaagcagccgggatcacaggcatgcgccacatgcccggccaattttcataattttttttttttattatagatggggtttctccatgttggtcaggctggtctcgaactcccgacctcacgtgatctgcccaccttggcctcccagagtgctgggattacaggtgtgagccactgtctataatttttttaataaaatagagaggaggtcttaccatgttgcccaggctgatcttgaactcctgagctcaagcgatcttcccaccttggcctcccaaagtactaggattttctttttattttccttttcttgtttttgagactgagtcttgctctgtcgcccaggctcaattacgtgatcatggctcactgcagccttga

SEQ ID NO: 707375 - DNA, 310 bp, Homo sapiens
  misc_feature (13)..(13): n is a, c, g, or t
  misc_feature (150)..(150): n is a, c, g, or t
  misc_feature (282)..(282): n is a, c, g, or t
gtaaccccccaancccctcattccaccagccatagctaactactaacctgcttctgtctctgtagatttgcttgttctggacatttcatatcaatggtatcatatagcatgtggttttttgtgtctggcttctattacttaggatgtgtnttcaagatttatgttacagcctcagtatttcttttctttctgttgccaaatatcccattcatcacctgatggacatttgggttgttttcactttttggctattctgaacattttaccccctcctcttcaaanctgtgcttgtattcaagactcttctggt

SEQ ID NO: 707376 - DNA, 252 bp, Homo sapiens
ccgcctccgagcccggccggcagcccccggccttaaagcgcgggctgtccggaggggtcggctttcccaccgaggatttggcactctggtgagggaaaagggcgaaagagaaaagcgagcagccgtcctttcacagcctcagaaagtgctcgcttcccttcgggggctttcgcgaatcccgaggcaatctcggaggcggtatttgacctgtccaaagacgacttgatacctctataatgtaacagaaaaggt

SEQ ID NO: 707377 - DNA, 166 bp, Homo sapiens
gctgcagtgcagtctggaacactttgatagctcgtcgcattctgtacatctgcattccccagcgtcacctttccacccctttggtccgcgggctccacgggacgcgggaagcccagtgaagcctgctcttccttttgctcctttcagcccaaacaggaagccatca

SEQ ID NO: 707378 - DNA, 339 bp, Homo sapiens
aacactacaaacatgacacgttaataccaaggggagcagatttttttaatacaaggtcaaaatcagcaacaagtaatgcaatcttttgaagatatcagatacaagctccaaggacaatttctttacgaaggcttattccagtatcgagaggctagcatgaggtgtgtgcatttgccaggggcaaatatctatttacaattaacccatgcagtaaatgctacacatctgctgagtccgaatagaagcatttgcagtggacgatggaagagcccaactcgtcttactcctgcttgctaatccacatttgctggaaagtgaacagtgaggccaggatgtaac

SEQ ID NO: 707379 - DNA, 327 bp, Homo sapiens
cccctattacaacagttgggaccagaagtgtctcaaattttgaaatatctgcctatatatatgagatagcttggggatgggacccaagtctaaacaaaattcatttatatttcatgtacacttaatactaatagcctggagttaattttatacagtattttgaaataattgtgtgcatgaaacaaagttttgacccatctcataaaatcagatagggaattttctacttgtggcatcatgttggcactcaagtttcggattttggagcattttggattttagattttcagattatggatgctcaacctgtagtgagctgttgtaact

SEQ ID NO: 707380 - DNA, 146 bp, Homo sapiens
gatggcacgtatctccaccagttctctaaatcagcaagaatcttcagtaccagaggtgcctgatgtatgcacattatgccacttgagaatgctgggaccctgtctccctctatgacttacagtctgtggttcagcaagttacatgc

SEQ ID NO: 707381 - DNA, 191 bp, Homo sapiens
  misc_feature (107)..(107): n is a, c, g, or t
  misc_feature (163)..(163): n is a, c, g, or t
caagacccttcccctccctgggctgtgggggtttgagtttaaagcccccacaccctaggcccgtgccaaaggggaaaaggctgactcccaggggaaaaggggaagcnctgtcattttccacgtcattttcacaccagcccatcctgccctttagatttgggcnccaataaaggggttttttgtgcttggca

SEQ ID NO: 707382 - DNA, 327 bp, Homo sapiens
ctgatgatctacgatcgctatgctccctcttcacatctccaggaccgtagagggggctctggcactggactgtgtcaatgaatgtatgtcaacatgaatgaataaatgaacaagaggaggaacagagggagatgcagaaagaaagcaggaggctgggtgtggtaactcctgtctgtaatctcagcactttgggaggctgaagtgggaggactgcttgagcccaggagttcgagaccagcctgggcaatacagtgagacaccacctctttaaaaaaagcgtagtcaggcatggtggcacatgcctgtgatcctagctacacatgaggc

SEQ ID NO: 707383 - DNA, 712 bp, Homo sapiens
gtttgaattgaggctttggccttaacacccaggaactgtgttctattacaatcgcttaggaagtaaagcctggtctcccatccctggttctctgctctcttgttacccctctgacccagccgctcgtgccccacctctccagccctcctcagttcccagccctgcctgccctgcccctccagggggccatgagtgcctgaaggggtgttctcataccccacaaggtcacagactaggggaagggagggaacaatattgtataatggaagccataaattccatgctgtttgggcgggtggcgggcgtgcgcaggaagcgcgatgaggaggtgacgggccgatggcctgtgagctcctctgccaggatgcggggaccatccgctcctcgagttctcgggaccgaggtcgggtgcaacaccccttcaatcctccagattgggtcttaggactggtcacgactggcccaaggcgatggtgcagtgggatatggaggtgcgggaggtagaccttgagcaccttttccttagagaggagactgttagccttcacacatcggagccgaacatctaggtcattgatggggaggtgacaagtggtcccctcaagaaatccgcttttgcctgtagaaggcaggataggagtgagaacacggccaggcggtggagaccagtccatctccttgactaaggccagaggctgcgtcaggagaacgg

SEQ ID NO: 707384 - DNA, 926 bp, Homo sapiens
tagtgtgtgcatgtgctgggttgtgtctccagggtaagcgttttaaatggaaggcccttctattcctgagggctcagagctgaccatgcatgaatgtatggcatgtccacttttctgtataaaagtataaagtggggttcttccatatgacaaatgagggaacaggtggtgtctatctgtatatcagaaagattatctagggtctatcctagtgataatacatagtcagcctattcctgtggcaccttccagatgagaatgagggagcgacacatccaaggacggacaggaccagacagttctgacaggggcgtgctggggtggttgggagtgcacagtgaacgcatttcctgttggatttacactcacctacgtgtaaaaaagaagacctcagagtgcatagcagctcatgacagggccccattcccagcagaggctaacaggagcttgtgtacgagtccaggcagaggagcttgtgggaagaccttcctggaccaaagggagctaacccaagaagcctatgatgggcacacagtacggcagcagtgaataacggaaaggacagaaccagaaacataaaccaggctaattgtactagcacaggggtccacctcaagtaaatccaacgattgataagtaacgagctaagacacgtaactacagcccagaagagtatagcagataagaagacagacacacacactgatcaggtacaggcgaatacaaatcactgaacccatgcgaagtaaccagtcacacttgaatgaatgctgccaacttagaacaatggggcacaaacgagaacaaaaaagatagtacaaagcacaccaacactagagagtatacatgacagatagacaagaagagacaaaaagaaagaaaccacgaaaagacgagaaacaagcacaacagaagaaacaaaagaa

SEQ ID NO: 707385 - DNA, 850 bp, Homo sapiens
cacgccttgctgccgccccgcagaaatgcttcggttacccacagtcttttcgcgcagcatgagaccggtgtccagaggttactggctcctcatctcacccgggcttatgccaaagatgttcatatttggtgtcagattgtccgctgagcccttaatgccttcacaggctgttaggacctctttataccgtatgtctgtggtcctgttacatatggagtgccaaagcggtaagcaacagttgcattattagagcacgaagttgtggagaagctcccaagagttagatcaatacagcatggatgatgacctgtttgccaaacgttcccaatttgagccttaaatcgcacttcacaataacaatcgaagcatgttggcacgacctaaaatcgttgctttcaagtactggttgctccaaatataccaacatagaatgatacgtaacgcctggcggatgtggcaactagcctagcgtggcctacatgttagcctgggggccgacggactcctaataaggcccgatgcggatacgggccttctgacgcacagcattctagccagaatgggctgcctaaattacccacggtggggatagagctctaggtggacgcacgccggttgtagacattggtttaatggcctcggtttgaaatagccgtcggtagaatctggctgcgaaacctttagacacatacggctggggtcttaaacacccccttgggtgcatacctcaacccccccctggataaggaacactttggccaccatgcgcgtttggacctaccgaactttgtcttggcctcaaaccgcggaggaaccaatacgaaacatttgggcccacgtaatccaattc

SEQ ID NO: 707386 - DNA, 580 bp, Homo sapiens
cttacagagcatttcatgtgtattataagagaaactcagttagtttacttaattaagacagtaaaatagcagcaagtaccaagacatcgtgcatctcttctatataagacaagttacttcatgtacatcagagttagaaatgttcagactggctttcttgaatacttaaatatagctcgaatcactggtaagatatggacatattttcccaactgtacatcagggaggagtgctttcattagtttcagaaaatgcagaccctcagacagccagcatgaccacaacattgagcaataagagaaatgaagcatatactttccaagcatttgccacagaaggtaatggagtctttacattagtggttgtctcttccctccataagttaagggttgtgctttgttgaggcatttaagagaaattattgggcatgccactagtgatacttagggtcatgggtgtaggggatgatttagtagagctagtgaggcttgtgttagtgaccattccatcttggagatgaatagttagagttgcagctgctgcttcatgtgaattgatagtctctggggatgtatcttct

SEQ ID NO: 707387 - DNA, 216 bp, Homo sapiens
cgggagtagtcccgaataactcaaatttctgaacgcattttatgctacatatgcgtatactttgcgatcctcaggtgttcgtgcccaatattctctctcaataagtccttcaatacgtttcttaaataacaactggacttggttaagaatcgcgcgcttcaacttgctgagttacctccggctactagaaacatatgtgctcgcatccttctattc

SEQ ID NO: 707388 - DNA, 314 bp, Homo sapiens
atcgcagacgccgctatatctgtgaggcactcctgttagcttagcggccttcgatcacacgccatcgcacacacccgagagctgtgacgccctcctgtgagcttaccggccttcgatcacacgccatcgcacacgcccctataactgtaacacacatccatgtaagcttaacggcatacgatcacacgccatcgcaaacacccacaaagcatgtgaaacaatccatgtaagcttaccggccttcaatcacacgccatcgcaaacgccccacacctgtttaaacacctcctgtaacccattacaggccttcgaat

SEQ ID NO: 707389 - DNA, 542 bp, Homo sapiens
tcttgctgaccactacaacggtgctgggcatcgatcgtcgcagtcaacagagtccttggcgaacgtagcagtgacatgattggtcatgctgctgtgctgggtcagaggccccatcagtgtgtccggatcaccaaagaatactttgttttctcttgtcagtttgtcggacatatcccattgttcatagccccgtaacacattgctattgatgtagtacgtggttggaagccagtgtggtgaatagcgctggggactggtgactgggccatagttgctagatccccattgcgttgatgggtgagacgttgttgagagacactggagatggagtgtcgttccatgtgtttacccgatggtgaagggtatctgtgcaatgtgttgaagcatctggctttaaagattccatcagtgatctggagtacttcgtacctatggtccttctgcagtttaaacattctcaaatagaggagtgataaacatcggtagcatagtactgctagctttttgtccccatccgaagccaagggacttgcaaagttctt

SEQ ID NO: 707390 - DNA, 1041 bp, Homo sapiens
cagctcggggacagcgcatgggtgctgctgagaccgctccggacgtgcgaagcgttcgcggtgcggtaggaagctgaagtcttcagcagaaccctgacctaggtagggagtctcaatggccctgggtgaagaaacaggcagaatgctggaagcatctgaagacacaaaggcccagtcctatgtggatgagtgtgagctgcatgtggatgctgggagctggacatcccagtggcccatgatgtggggatgcatgccccacagcctggaagctgagtggagtgtgctcatctcccctgtatggggggcagaacgggatacctgcccctaacttgctggattgggactgacccatgtggcgggaccctctagagaccacacgcagccacaggccagtgatgccaacatgagaggccctgtagctgagaggtcttgagcctgccatctcagatggccatgcgctccatgcactaccagtggggggtctggagaccattcgtgcgtcatccgtgggaaatgccatgtgtgtgaggaagaccaaggactttcttaccatccgagggagattaccctcagaactcgtggagcacgtttcgccagcaagcgtagcaactaagtttgcttccaggaccagtgagtgctgagtagccgtaaggatgagtccgagtcaccttagcagaatttgggacccaagggaacttggagaccttcaggtacaaacgagagaacttcaagctagtggattcagggggtagtcgtcgtttagaccatgataaaccagggtgggaaaaggtcccggatggctagaagtccccaagtgtaacccagaagttgcgttccatgctacttttcagccaaggcttagcaagcggccagttcttctcgttggatatctcctttccaaaagaatgggcagagtcaagatactacaaaaaggggaatcaagcaaaagaggacagaaaagggactggaaatagcctatcagtagagtacgaggtattagtagtttggagcagaaagatggattctacaccgtcacgtccg

SEQ ID NO: 707391 - DNA, 266 bp, Homo sapiens
  misc_feature (40)..(40): n is a, c, g, or t
  misc_feature (47)..(47): n is a, c, g, or t
ccccgatgaagcctgacggcaggctgggctccgccaccgnacgctcncaccagaccgagcccaccgcgagggctcctccaggatgcaaaaaaggtaaagaagcaaagatgaacctttaagcaaatacgaatctcagagactcacggcatagccataactgcagcctgtgagacccacaccctggacccagacagagccgcagccgtgtgtgttacccctccattgccacttgggggcactgggctaaccctgcccccaccccatcc

SEQ ID NO: 707392 - DNA, 152 bp, Homo sapiens
atagactcattcttgcaaacccccccccaataccaattcctattctaatgtaaacctaccacttgtgctgttcctccttgagcatatactttataggaaacctatctccaacagactgaaagtgaatcttcaccccaaaatggtcttcgggt

SEQ ID NO: 707393 - DNA, 172 bp, Homo sapiens
cctcggaccggatttccttacactagtaggctctctttcatctcacagtgatctaagtcttctatatcttcatccatctcttcttcttcctcttcttttgaagtcactgcttctgttgtcccattctgtctgtttctccactctcttgacttctctctctgtccctttcaca

SEQ ID NO: 707394 - DNA, 179 bp, Homo sapiens
tgcatattacccagtgtgtcacacgacattgcaaatcaagggcaaattaactccattacagtagataactgtcagaaactggcctggtattcgatgacgtggtgggcatgtggagataatcaacagtaaggatgtcaaagttcaggtaatgggtaaagtgccaaccatatccatcaaca

SEQ ID NO: 707395 - DNA, 174 bp, Homo sapiens
ccctcctctgcaactgtcttacttctttaggccaggtatgcactccacagcagtgtctgcctatcaggcctgatttggtcaacaattttacggctctggggttcaaaccccatatcaagcattctgtcacgcttcgtccactacaaggtacagtacctcggcgacacactctgt

SEQ ID NO: 707396 - DNA, 292 bp, Homo sapiens
gccagtttttccagcccccccccccccccccccctagtgggggggggccgctggccctttgccccaagttttaatgcccctgaagctgtgttttttcccccgcctgtgggggggaaaatttaggggggagggggaaaccaaacccccccccccctaaaatccttttttttttgggcctaacgccccccttttccgggttttgcgggagatatacccctttttttgggaagggttttttggggttttttttcccggggcccgttttttaaaatatttttttaaaaagttgtta

SEQ ID NO: 707397 - DNA, 100 bp, Homo sapiens
agttgatctagaggacccctcacggaacaataccagcatcaaaggctattcaaagggagcagcctcttcagtaagcacgaaacaggctctcatcagggat

SEQ ID NO: 707398 - DNA, 463 bp, Homo sapiens
  misc_feature (185)..(185): n is a, c, g, or t
ctctcatcaccttatttaaaattgcctcaataccctaccctcttttcctgctttattttccctgtaacacattcccttttaatatacccataattactgacttattttgtttattgcattcctccctcactagaatgaaagctccatgtatacaggatttttttttctattttcttcactgcttnatccttagctgttagaactgtgtctggcatacagtaagtggttcagtacctaagtgttgagtggataaatggatggatgggaaggatggataaaaagagtgcctggtagacctaacgcttcagctgccagattcctgaaggccccagaggaagaaaatgctacagaaatcaagagaagcatttaaggcacatatcttcaacatcaactcttcctatccacccacaatgctagatcccaacataaaatgaaataaaatttctacagaatcatcagcaaa

SEQ ID NO: 707399 - DNA, 382 bp, Homo sapiens
  misc_feature (74)..(74): n is a, c, g, or t
agttgagacaaggggccgggcgtggtggctcatgtctgtaatcccagcactttgggaggccaaggtgggccganctttaggtcaggagttcaagaccagcctggccaacatggtgaaaccccacctctactaaaaatacaaaaattagccgggcgcgatggtgcgtacctgtagtcccagctacttgggaggctgaggcaggagaatcgcttgaacccgggaggcggaggttgcagtgagccaagatcacacccgtgtactccagcctgggtgacagggcaagactccgtctcaaaataaagtaaataaataataaaaataaataaataaaatgagacaagttatcgccatgttgcccaggctgctgatattgaactcctgg

SEQ ID NO: 707400 - DNA, 129 bp, Homo sapiens
gcgagaggtcgagtacaaggttgctgatgattgtactaaatccccattgttatcttggcttagctccctggtgatgtgtcgtactggaaactgatttgtagttggtgaggtaacatacgtggagcgtct

SEQ ID NO: 707401 - DNA, 478 bp, Homo sapiens
  misc_feature (23)..(23): n is a, c, g, or t
gggcctggtcctggccgggttanggatggagctggtcctcgctccctgcgcctggggatgcccctgcctgcctgacgcccgcggctgagccaccggcgcatgtgacctgcgcgtcagcccagtcccatccgtaggcgcccggcgcccggcccgcagcggctcgttgtccccgcgagacaccgaccggtctcccgagcatgacacccgcacagacaggcctgacagcaatgcaggcgcagagcagctgatcactgaacgcgtaaggacgcgctagagcaaggaccgagaagccacaccatacagagcgaccagtgtaccagcggacgctagagacagtgtacagcggtagtaccagagacaaccagcattgaaaaacgaataggaataagaatagccacaaacaatctaaaaacatgcattgacatgagtattgaagcaaagaaaaaacaaacgggaaaacaaaaaggaaagggcacaa

SEQ ID NO: 707402 - DNA, 181 bp, Homo sapiens
ggaagtgacatcgtccttaaaccctgcgtggcaatccctgacggcaccgccgtgatgcccagggaggacagggcgacctggaggtccacctactcccttaaggatcatcccactattggatgattatccgcaatggtctcattgtgggggcagaaaatttgggctccaaggagatgcagca

SEQ ID NO: 707403 - DNA, 329 bp, Homo sapiens
  misc_feature (45)..(45): n is a, c, g, or t
gctgcctggccttaagaagtccagagccggacgtttcgccttttngggctggcggctgggaggagcgctcgggttcatgtcttccccagggggactgcgagtttcctgggtgcagcgaggcccgggagtttggtgccgcaagacctttgggcagccaaggcttggctattcacggcccgcagcctttacccggcagactttaacatccagtatgagatgtacaccatcgagcggattcagagcggaccaaccaccccggaaggttcttgtacgaaatgtttttgaatttccagaccagccggtggtttggagagaaatcagcattattt

SEQ ID NO: 707404 - DNA, 818 bp, Homo sapiens
tcgtggaaagtgacatcgtcctttaaaccctgcgtgacaatccctgacgcaccgccgtgatgcccagtgaagacagggcgaacctggaagtccaaactacttccttaagatcatccaactatgtgatgattatccgaaatgtttcattgtgggagcagacaattgtgggctccaagcagaatgcagcagatccgctatgtcccttcgcgggaaggcttgtggtgctgatgggcaaagaaacaccatgatgcgcaggggccatcctgaggcgcacccttgggaaaaacaaacccagcctctgggacgaaactcctggctggcctcattatccgggggacatttgtgggcgcttgtggtgttccacccacgcggcacgggaccttcacttgaggactcagggcacattgttgtggctgccccactaagtgtgccagcttgcttgccctgtgcttggtgtgccatttgccccctattgttgaaaaggtcactggtgccagcccccaggaaacacgtggtctcgtggcccggagaaaggactctccctttttttcccgagggccttttaagcgttattccgacccactaaaaagattctcccaggggcgccacccatttggaaacatcccttgcagtctggattgttgcccgcgtgcatccaaggactgtgtggacgacaacacgtggtggcagcccagcggaacgcgcagggctgctggacaaccattgcctccaacattctccccccttttctccttgtggggcttgctccacccagcacaggttggtccgacaactggggcggcattctacagctctga

SEQ ID NO: 707405 - DNA, 264 bp, Homo sapiens
acgatctatgcgctgtgggagatgcagacgagtcaggcaggtcactggctttgtcagggagtggatgcctggcataagatgagacaactgttccatttctgtggcgcttgttgccagctgctaaacttcttcatggttggccttctccaggctttcataatccatgatgaccttgttagtgatgagtgagaagccaaagactcgaagtccacagtgccgtgcaacgataacttctggtactgtactcatgccaacaagcgcctg

SEQ ID NO: 707406 - DNA, 260 bp, Homo sapiens
gatggggggcatgaaatgttttaatacaggcatgcaatgcataataatcacatcagggtaaatggggatccattacatcaagcatttatcctttgtgttacaaacaattcaattacactctttgagttatttaaaaatgtacaattggctgggcacaggggcttttacctgtcatcccaacactttgggaagctgaggcaagcgaatcacttgaacccgggaggcaaaggttgtattgagcttaaatcgtgcctcgtgcc

SEQ ID NO: 707407 - DNA, 652 bp, Homo sapiens
gagattgaatggctattcagctttcagctgtggacagagaaggatcagaaccgattatgcttatgatactgacagccatgatcgctccactgtacttatacctgggtgacagactttgtgtaccaaacaactgatacttactctttgtatatgtttaaagtattttgttaactcaataaaactgagacttattttctctacgatttaagttggtgaataataacaaatatttgggttataatttccctttagtattaagttagctgtagaaatggtgttgtatctgacctagtaacccatttgactttttaaagatgaattactaaatttttttaatgatatgaaaaaatgtaatttgctccctttacctcttatcaatatatttatgataccataagtacctgcaaggtgtggagttacagtccgagacagtctaaagaaagcactgatgatgagaggtctaatcccagagtgctgtgcttgttacagaatttacgaagtgtatggtttgtatgtgacgtgaaattttgttaaaaagaaaattacacattaaacttttgagttttcttaggatctttaccaaaacctatgggatttgaagtgttctctaggaaaaagtttttaattctaagttagcccggtactgtaggcc

SEQ ID NO: 707408 - DNA, 878 bp, Homo sapiens
gggagtgcccaagcatggcgggggccgtaaggtgcatggggtcgagtctcgatacatcgatcaacaggcgtagcctgttcctgagatggttgtatcggacatcacttgttcttgtcactgtaaaacatccgagtgcccgacagacattgggtgcatgcgtgctaataaagtctgcagagagaagacgaaaagaaggtgcgtatcatgaatgaagacagcagcatgagagaaagacagatgaaatagaacaatgttaaaggatatcccatatatggagaggccgagagcctgaggagtgattgtctagttttaacatgcttatgcctcggagacagatatgtgaggtggagaaagcggtgcacgttatttaagaaatttccaagtgcttgagttatactatgtccaaagcatagtgttgatctggatagacactggagtatggcactgggcatagaagagaagcgtggagcccgtttaccatgggtgcttagttgccatacgccaattagcgcccggagatggactaaggttgctgtgtctacgagagaactgcatcagaggtcaaaatagcggaacgagtctggggctgcgttggctggagggacgtagtctggtacagaagacttggcgatgaatgaggatagttgcacgagctaaagcgtagctcgctcctgataataatgcttggctgtatcgattaggggacatactgcctacaagtattctacctttatccgaatgtccatgccgcgacttcccaaaggctgggtcattcacccgggctgcgtaggccggaaaacgggacttcgccacaattcacgtgggttcagggcaatggggaatcgagaaaatgagttgggccccggaatggccggggc

SEQ ID NO: 707409 - DNA, 853 bp, Homo sapiens
  misc_feature (230)..(230): n is a, c, g, or t
  misc_feature (233)..(233): n is a, c, g, or t
  misc_feature (328)..(328): n is a, c, g, or t
  misc_feature (364)..(365): n is a, c, g, or t
  misc_feature (367)..(367): n is a, c, g, or t
  misc_feature (370)..(371): n is a, c, g, or t
  misc_feature (377)..(377): n is a, c, g, or t
  misc_feature (386)..(386): n is a, c, g, or t
  misc_feature (417)..(417): n is a, c, g, or t
  misc_feature (424)..(424): n is a, c, g, or t
  misc_feature (433)..(433): n is a, c, g, or t
  misc_feature (446)..(446): n is a, c, g, or t
  misc_feature (468)..(469): n is a, c, g, or t
  misc_feature (471)..(471): n is a, c, g, or t
  misc_feature (474)..(474): n is a, c, g, or t
  misc_feature (480)..(480): n is a, c, g, or t
  misc_feature (482)..(482): n is a, c, g, or t
  misc_feature (487)..(487): n is a, c, g, or t
  misc_feature (489)..(489): n is a, c, g, or t
  misc_feature (498)..(498): n is a, c, g, or t
  misc_feature (532)..(532): n is a, c, g, or t
  misc_feature (593)..(593): n is a, c, g, or t
  misc_feature (619)..(619): n is a, c, g, or t
  misc_feature (623)..(623): n is a, c, g, or t
  misc_feature (670)..(670): n is a, c, g, or t
  misc_feature (674)..(674): n is a, c, g, or t
  misc_feature (691)..(691): n is a, c, g, or t
  misc_feature (740)..(740): n is a, c, g, or t
  misc_feature (774)..(774): n is a, c, g, or t
  misc_feature (848)..(848): n is a, c, g, or t
ctggtgggtgcaggaaggccaggtctgccccctggacgcggacggaaagggattctcagtgacatccccgccccctcccgctgcctcggtccccacaggtatggaggtgtcccgggggcggcgtcgcggggcgcctcatgcccagacttcagggggctgtgcgtgcggctggcggcggactggcgacgctgggcgccctcgagcagcagcgagaggcgggcgcggaggtnctnagcgccggcgacggccctggcgcggaggaggactttctgcggcagctcggcagcctgctgcgggagctgcactgcccggatcgcgcggctgctgngggcggggatgggcgcggctgcgcttcgggaacccnntnccnnacttcnccttcttcnctttctcttctcaaatctccaagccaccgcncctcctntgcctgccnctctctgctgganccgagtcctaggccaccccttnntnaangggtantngaggnanccggcatgntccaataactggaccttaccctccaagccctggngctgcccagacctgcaccagggacccccgccagccagctgctgcaggagttgcatgctaangtagagagtcagagtcccctcccganctgngctaccccactttccttgtgggggtgggggtcctctctccacttctngaangagtattccaaccactngcctgttttttcttgagctgtgacttgcattctcacatctgtggcctangtcctcaggggtgttgggagctgagtttacagangggcccatcctctctgccccagttggcctctgacttcttctcccatcagatctcagagctgcagccttctctgncccca

SEQ ID NO: 707410 - DNA, 452 bp, Homo sapiens
ggccgttaggagaggcgggttaggaaagaaggtgagagactgctgcgcggattctggaaccatgaacatatttgatcgacagaatcaattagatgcgcttgacaatgtctcatataacccgaacaacgcagcagtcagctgaagaaggtctatgcaagttttgcccttagtatgtttgtggcggctgcagggtgctatgtccatatggtcactcatttcattcaggctggcctgctgtctgccttgggctccctgatattgatgatttggctgatggcaacacctcatagccgatgaagactgaagcagaacaagactgggacttcttgctggattatgcattccttacaggagttggcctgtggcccatgcccttggagttctttgtattgcgtgtcaaccgccagtcatccttcctcactgcttttcatagggcacggcacatgatcttt

SEQ ID NO: 707411 - DNA, 545 bp, Homo sapiens
agagggtcacgcaggcactgtttgcaaaggaggtcagttgccccatgtcatccagccaagaagtggtgtcctgcctccgacagaagcctggcaatgtcctcaatgatgcccagaccaagctcctggccgtgagtggccctttccactactggggtcctgtgatcgatggccacttcctccgtgagcctccagccagagcactgaagaggtctttatgggtagaggtcgatctgctcattgggagttctcaggacgacgggctcatcaacagagcaaaggctgtgaagcaatttgaggaaagtcgaggccggaccagtagcaaaaacagccttttaccaggcactgcagaattctctgggtggcgaggactcagatgcccgcgtcgaggctgctgctacatggtattactctctggagcactccacggatgactatgcctccttctcccgggctctggagaatgccacccgggactactttatcatctgccctataatcgacatggtcagtgcctgggcaaagagggccgaggaacggtctcatgt

SEQ ID NO: 707412 - DNA, 222 bp, Homo sapiens
ggaattggagatcagcctgggcaacatggcgaaacctcgtctctaccaaaaaaaaaaaaaagaaagggacggaaaaaaagggacgaaggaaggcttttttccttaactttgagaaaaacaggggggggggccagagcttggggaagggctcaaaaaagaactgagcctgggggggaaaaaaaacttggcctaggaaggtcaaggctgctataggtattgagg

SEQ ID NO: 707413 - DNA, 179 bp, Homo sapiens
catgagcaaccagcacaatgtcacactggatacaaaaacatactctaaaatacagtccagataacaactgtccccactgtccccaaaatgtactttacagctagtaaataaactaggatccaaggatccaatccaagtgttaacagaattgcattatggtacatcactgtctacctaca

SEQ ID NO: 707414 - DNA, 202 bp, Homo sapiens
tgtgtgcccagcctgttggccgctgggctggactgcagggccgtgaggctatttgcctgaacagctcaacaggtgagttgcgtgcgcgagtgcccttcgactattggcacacattcatggagctccagtaatgtgtgccctctctaccaattatattattcatccaggatctatctgtgcatatagatattactttatggag

SEQ ID NO: 707415 - DNA, 1292 bp, Homo sapiens
  misc_feature (1)..(2): n is a, c, g, or t
  misc_feature (545)..(545): n is a, c, g, or t
  misc_feature (601)..(601): n is a, c, g, or t
  misc_feature (676)..(676): n is a, c, g, or t
  misc_feature (716)..(716): n is a, c, g, or t
nngggggagcttctcagtgtgagctctgaatgcttcaggatgtcttccaatagccagcctttcctctgtgtaaaaggtttctctggagtaatggagatagcatgtgtgcaagtaggcaggagctccccttagtgtcagcttgagagcaaggaagggagaggagagctatgcctctgaaacaataccattttgcccccaatgccagttttatttcagagataaaatgccatgcttcagagccatcaatgataattgtttgagattgatgacctttggaagctgacagaatactaacttctgggagaagactagagtagatcaggatgatttcttggtatactctcagctgtttcccaccatgtgtttcctcttctttctgatatacagccaaaatacatttcccagtctgccttgcagttaagggaaactgaggtctcgtcaatggaatatgaatagagaaatgtgtaccacttccaggcctggcccatgaaaacctcccatatgctctctctctttcatcttccttttcccttcaggctggctgnaggggaggcagctcctgggagagatttggaagttggcagagctgctattaagctgngttcctgaatgatggcaagacagaggcccacttctctatcgtattcacctgcccaagtattgttgtgagcacganaaaaaatatctactgtagttgaggccatcttaaatacagnttctcttttaaaagccattcacgtccaccatttggcattaagcgcttttaaaaaaactgtgagtgccctgccttgccagaaagctgtaacaagacttaactccgggagactggctttcctggcattctgagaagcagaaggtttaaattacttccaggttgaaagggaaaagaaccatacaaaccaggaactcaattggggaggcagacataaggtctctccacccggatgtcaagctcgggccttaaacctgcgaatttgtacctcatggaaaggggactttcaggtgattaaggtacggacttgaaatggggaaatatcggatatctaatgggccacctatttccaggaacctttgaaagggcggaaagatggctacacgctatcgaggatagtttcccacctgtgttctttaaaaagggcaaagcttcactcagggacacagtctaaactcgtaacagagactggatcctttaggcccaagggccccggtcaaccggtcacaaatggccttgcgatttcatattggctctctgtctggtgcgacataatactcccccccactactacaccgct

SEQ ID NO: 707416 - DNA, 242 bp, Homo sapiens
ctgaatcatcttccctgttacctgctgccattgtaattgcttgcaggatttctactttcggcatcatactccacaatgctactagaatgctcttcttaatatgagggcctggtcatatcactatgtggctggaaattactgtccagggctattaccagcccccgccagcatatcagcttgacatacatgatgctgtatgagttagattccaactatctagccagcttgagctgccactgcta

SEQ ID NO: 707417 - DNA, 469 bp, Homo sapiens
cgatgctcatactactattaatcataaggaaaaggtgaatcaaaaccagctacaaataccatatacacacccacatggatggctctcagtaaaaacagacacgaaacaggagataacaaatgttgctgaagatgtagagaaattggaatgcttgtgtgttgctagtggcaatataaaatggtttggctgctgtgaaaacagtttggcactccctcaaagaaattaaacatagaattaccatatgacccagcaattccactctaaggtatacagtcatccctcagaactgtgagggattggttccaggacaccctctggataccaaagtctgcacaggctcaaatctctttatataaaatagcagcatttgcagataacctatgcacaccctcccatatacttgaaatcatctctagatcactcatcatgccgaatacaatgcctacacatcactgcattcacgtggatt

SEQ ID NO: 707418 - DNA, 102 bp, Homo sapiens
attccacattaaagccaagctatcgtggtgggattaaattatatatttttaaaacctgtttttaaaattttgtttcttgcactaaattatgtcagtacattg

SEQ ID NO: 707419 - DNA, 620 bp, Homo sapiens
caaaaggaaaagcttgggcggtgccgtcttcatttggaacaagggggggttcatgcctaaaagaaaaaaaaaaaaaaaaaaagaaaaaaaaaaaaataaaaaaaaaaaaaggggggggacccgcatttgttttttttcttcaaatgaatttgttgcatgacactagggagacaggaacacacaaggagttagtcgcccatgattatgttgtgccacataagccgtaatctgctggagggagagcgaggaggagcgagagcggggagaagacgagtgagacgccactgcaaagaagaaacgcacagagaagaaaagcaagcagcgaggagggcgcacgggaggcggagaggggagaaaagcggacacaaagcaataaagacaaatggagagagaaccccgccggcgacgcagcgagcatgtccagcgccactgacacatgatgtcgtgggaaatagccagcgcgggagaggggcgtggaaaacaacggaaggaacaagaaaaatgcacacacaaacaacgaacgaacacaacaaaaggaagagaacaagagaagacacgcaacaaccaaatgctgcgaaaaagaacaacagcagaaaaaaacagcagaggaggagacaaag

SEQ ID NO: 707420 - DNA, 1118 bp, Homo sapiens
gtgcccccatgccttatacaatccactccggaatgagtttctgtcatcgctggaggaaggggcttcattggtcacccccccggaggagctgccttccccatcagcttcatccctggggcccatcctgcactcctctgcctggggacgatagtcccactaccactgtgctccttcttcccccggatgagcaacctgaggctggccaacccgggctgggggggcgcccagggtctaagaggaggatgccaggaagggcagctgatgatggggagggcgatcgtatgggggcatgccattgccagactcagtgccccctacccctcctccaggacatgaaacaagctgagtggagtgccggcgggggcgcagtgactcgggtggaaggtggcccagcttgcgtggacagaggaagtggaccctgacaacagggagctttgtcaaataatgcccaccgccggtgggcattggctgcaatcccaacgacaaagtcattgggaccctggggtttcctacattggtttcggtacatgggtttgtgtggaggtccctccagtcaatgcgtgccctggcacttcaacacccgggactcaggtcaccatgggagtgacatcagtactggtgttgttgagggcttgtgcccgggttggtcaaggggtgcaacacaggagggagaaaagcccagaaagcagcccgaaccaacttctatcactggggaacggatacactagcacatatgcttcggaattgccatcaactctcaacgctacacaagacgccacaagcctcaatggacggcgacttgcatacacggaatcagtcgccaaacacagcacatgaaaacatatctcgtatgcatcggacgcggatccggcacaccgccgagatattgtgcctagttgtccaagagcctgtgaccaaaggcgccacatcttgcgggcccaagggtggcccgatgcatatgaccaatgccgggctattgagttgctaacatgcacttgatcgaccgagtgtacccctgaggatgagcactagaaaataataggtgaacaagcgcacaactaataccgagagaccgtgagtgataaagcaaggactagagtatgcaactcagcacgtgg

SEQ ID NO: 707421 - DNA, 102 bp, Homo sapiens
gatctggcatattggaaggagtggggatgggtgaggggatcgacgagtgaaagaggggatacgtccgtaggggtggtggaggggagtgcgagtgcggtcccg

SEQ ID NO: 707422 - DNA, 263 bp, Homo sapiens
atgtcgaggctcatcgtgtacttatgtttggtgttgcatgctctcatatctataggttatagttcatcaattttgcaaaattttgagtcttttttttttttccaaatattttcctctcccctctccctctttccctggaaacccaattacttgtagtttggactgcttgatatggtcccaaagatcatgatgctctgtggtattttttaaagggcttctggccactctggtatttcctttttcctatttttggacagtctcgc

SEQ ID NO: 707423 - DNA, 581 bp, Homo sapiens
aggatggagggggatggtcgggtttccaaaaaaaaaaacatggaatatcccctgggttaattggatgccccccaattccgcttttatgagggggaaacttccccactccgggtttttcctgagaaaagcccccgttttggctactcccggtttcggtttgggtcaaggggccgggactttccaaaccaaagcgggggttcccccccctatttttttcctttcgggccccattgagacaggggaggggaattttttttttattttttaggttaaatgagggggtttgggcccaaaatttcccttcccgattgggggtttggggttttgggaaattttttttattttttttttttaaaaaaaaaaaaaaaccccataatttttcccggggcccatttagcagtgaaacctttttaaccgccaaaattggggttttggttcaaaaacaagttgtatttttttcccccccgattatgggaaaaaaatcagttttgtttttgggggggggttttctatggggatcccccgtttttggggttgggggggccccttttgtttaaaaaaatttttttaatgttttgtta

SEQ ID NO: 707424 - DNA, 999 bp, Homo sapiens
cgctgggaccgggaatcccgcgagctgcggccttctggggacgcggcccggtggctacgtcgtgggccgatccgtggggacgcggggtcctggaggctgcgcggggtctgaggcggactcgcattttgggaactggctgaatgatgccgggctaatgtcctggagtcctatggcagtggcacattcccgcacagagtttcggcgactcgcccgtgtcgggagcctccaggcgcactggagcttggagggggcgcagggacagttgcttggtgcctttgcggaggacgctcaccgcctgagcagccacggtgggacccgtagtgccaggaggccccgggcgagccgtcaggtcggactggaacgtgtgatgcagtcaagccgtgtcaggagcgtggctgcagcgaggtctagaaggctcatgccaaggcgactcgtggatgggcccattccgccgaggctggcagccgcccggttgccctacgacatttgccaacaaggcttcaagggaccttggcactgcgctcacgggagattggctagattgctccaactggggtctaccctgtctagcctgaatgctggctcggtgatgacccgtgcttgggacctctttgcaactgagacgggaatgcaccgtcctgtcactcagaaactggtgcctgcaaggagccattctaagcagtcctggcacacccgggaaaggtgtggcgagacgcccgcatgtaggggagcccagtagtggacggattccgggacttcctccaagaaacgggggttgggacgagcggggccatactgccatggaagcagagagggtcgacgccagggaatgcctcgaaggcgagggtatcccccgggacaaccctgtggcctggggatggacccggttgaccgtcataagttcagataacctggatagaagggccaccgcggccttgggtggccccaagcaggcgccggaggaaccatgggccttaaccttacgccgtgggcgcccgg

SEQ ID NO: 707425 - DNA, 159 bp, Homo sapiens
aatgggcgagttgtagttggtcacgacgcgggtagggatagccaggaacctcagcactgtgcagtgcacggtggcgaagacccagcactggacatacttgacgcgctggcagccgtggttcttccagcgccgaaggatgtccacgctgccgatccagga

SEQ ID NO: 707426 - DNA, 101 bp, Homo sapiens
gcgcttccggagaaaatcagcggtctaattaattcctctggatttacaaaaggtgcaggtatgagcaggtctgaagactaacattttgtgaagttgtaaaa

SEQ ID NO: 707427 - DNA, 967 bp, Homo sapiens
  misc_feature (967)..(967): n is a, c, g, or t
tacccaatcatatgcgactgaatattgtactaatgattgaccgattcgcaggtgctataagaagtagaatatctgctcgattccaacatctactccctagaacgtgctcatatgtctagactatttctctgattggtccagatactatctcatctctgtatgttgctcatgcacgccactccctctgtcacccagatagtcgtcgattactggctcctactgcgtgtttcgtcttccatgtgaactagcgagtaggggttgtccctgttatgctcctgcttctgcttactgtgggcttgtttgacagtaccttgctctgagatggcttaatattgctggctgtagtcgtcccatcttcttggtaactgagggaccctgagggatgacgtttgccaacatagactatttactatgggtgatgccttgccaaaaacaagcatgcctaggtattgggcatcagtgccactcttcatgatttattactcaacatgggctatgcatctatttaagtagcacgatgtgggggcatcttggcgagctgtttgacatgctgtggtcatgctctgacctatttgacttcatactttgaagaattgatgttatgcctctttgctctgctttgtcctgccatttcagctcacactcaggaagaatataacagataagtccatggttgcatgacttcttctttttaatcccaagaattttttccgaaactttatccttgtgggaaacgttggtagcatttgtgctaagatggacgagaggcacaatcggaagagtaaagcggggcccccactttttagacacggttactaacaggtattacttgctccacatccgcttaagaaacactattcggagataaacctgacgaaaaacaggaaatataaaactggcatgacgttgacccttaacatgataggaaagacaacacaagcacgtatcccacacccaccaccatcgn

SEQ ID NO: 707428 - DNA, 342 bp, Homo sapiens
attatttctgaggtatgagaactcaacacaacgctcagagttgtacactgctatatgtgacagtgcgatgatttgtcaccagcagtagggtctgcggggaggattctgggtgcaggtgtctgctgtatcttagtgatggtggagaacttcccagtgggggagctgacctggctgggttgtcttaggaggtagtgagcccccaggaattgcaggtgtccaggcagacgtaagatttaagcgcttttttttactccatcagaaggggccaggcaacagagaggcagcttcctcaggaccctctggacactgcctgacttacattccctgtaccccagagtttgg

SEQ ID NO: 707429 - DNA, 743 bp, Homo sapiens
agcggaggttcttttgccaatggcaaccagcagagcttcccctgaagattgcagggcatgagttcaggggctacgaagcgattagacgagatgtctgccgtcacagtcctgggtgaactcaactcctctccccgagagaccagacacgtcactatctgaaagtcaacattggcattctaaatccatcacctgacggccacatccatgacaagcagaaaacgctagtccgtagacaaagagttggcagcgaagaagaggacgaagccccaattctcttctgtgacctacgtagagcactgccggcgactgtggtctgggagccaccgtgatacttcttttagctgccagcctgaagattcttcgtgccctgagtaacctagttcctcacgacgttattgccagcgctcgtgggagagttgtaacttcgctgctagcctgaaaagctggggaaatggtactggtacacatatgagttctatgatatttacacagggctaacatcgccatgcatctcgacagggggcttgttggcacacgatgaggcaatgctccccattgtcacatagctaggacgtccgagatagcttaagatgaaagaagctgaataataatttgagtcagaatgagaagtgccttcccttcactatcgtcaggagagatgtcctgtgagcaacgttcttgggggacactaggaggacattactgaacgcatcatgactgtaaagatcatatctgtgtcagaa

SEQ ID NO: 707430 - DNA, 998 bp, Homo sapiens
gccttgatctcaaccggagacgatcgaattctgaagatgcaggccttatccggagcaaccaaccggaaaggagagggatctacaatatccaaacaacggatcaacagtcgaaatccacctgcgaacgccgctgtgatggaagcgatgttctgactgcagatatgtgcggcttcactgtgggccgaagagaccacagaccactgacattccaaattggcaattgacacaagctctggagaaacatgcgagctgaggcacagcacactaatgtatatcatatcgttggaccaaatcatatggttctggcagcagtgccgtgcatagccgtaagatctcgggcatgtgaaccgtacgtgcgtgatgccttagtatactgacagattgcacttctaaggagccttcgcaagaaaggaccagaaagagagtccatgcggagactgcgatacccgaaacgcacacacataggcacgtcacaggctgtccacttagtctaacagaacgacaggggagaaaccccgataatacttgtcacagcggcaaggccaccattagccatggctagagaccgtgttggatctccaggcatcactgtgcaacaagtactactttagctcccatgaggcaatacgaagcactcaggagcactacttagagcttgactacatggacgacagacggccatttcgcaaagacaacatataccatcgtcacactcaaccacagaggaacagatttgagcctacgcagaataccacacggaaaccacgctgcaatacaccagtacaccggtcacacactaaacaccccccttagctacgttgcactaaatcacaatacattacgacagtaccaacaaagaccgcagatgtaacacccgagccggcacattatacgtacagagcaaacaacgtagccactctagtagcaacccaggcactcccacacaaccgacaaataggaccaatgcccccatttggtcctatccacgcagacttcat

SEQ ID NO: 707431 - DNA, 126 bp, Homo sapiens
gcttaccttaccctcccacaaatcaaccaacttattctcacaaccgaagaaagaatggacacctcccattgagggacaaaaaaaaaattcacactctggcctgtggcaagttcacccggtcatttc

SEQ ID NO: 707432 - DNA, 176 bp, Homo sapiens
  misc_feature (16)..(16): n is a, c, g, or t
aatgtaaggcaccatnatcagcgccctgacaaaacaggccattcggctctaccaatcagcaggatgtgggtggggccagataagagaataaaagcaggctgcccgagccagcattggcaactcgctggggtccctttctacgctgtggaagctttgttctttcactcttgtgcaat

SEQ ID NO: 707433 - DNA, 1160 bp, Homo sapiens
tcgcgcttcaagaagctggctgacatgtactggaggctgtgcgatggactgactaggggactcgagagaggcggtgccccagacccatgctgctggtgacatgcagaaatcacgttgctggtggtttttcacgctcctcttcccgttgcagcatgacgtctctggggacacaccacgagactggttactgatgcagtatagtatacgctttatactctctccactttactagctctaataagtcagtgttagaacaagtttcgacttatttcttaacgctttttttcttttcccatcactcttaacatggctggctgagtgtccaaaagatccccaaactattaatattccacaaccaacaacttatagccatcagaaggttcacccagccaccttgcccgactcactcaccgcgacatccggctctcccttttacccacgaaggggcacaagttccacctactctagctcctgtcgcactggtgcactataattttcaaacatcaacaccactcgcagtgattctgcctcatacataaccattggtcgtgctcccttctgccctcttaccacacttcaacaaacacggcacacacatccacaagcgcaccaatagtgaggaacgcgtgcaacttagggtatgccacctaacacgattcaccattgacagccctatacccctccgcagggtgctcaccgcctatatcacttggacaccaacaaggacctcctcacagcgtagcgtgggaacaccctcagtgtgtcgtcacacaaacggtcttgattttcctaccttctcacaagctctacttctaccccacccgcacaaccccctgtctcgactataactccacccatggactaactaaacaccctatcaccacataacgatactacctatccacaccactaccacccacccaacatatactacgaatatcgagataacgacgcccacgcatccactcaacacatacccagaaacacctgacgcctcattccgcacacaacgtaaccttcactcccaaggctcttgacgtgtctgtgtgccacattctgagtagtctcaccgcctgggtcatccagtcttcaccaccagtctatcattgttggacaaggcccatcaataaccccaggtttcatagcagaaatatattatc

SEQ ID NO: 707434 - DNA, 191 bp, Homo sapiens
gtctctacagatcccccttcgactcgtcatgtgatatcgagctgttccttgccagctgctagagttacgaacagagtcacacctagcagcccgctatgctctgtattagtattgtgaataaagagcttttgtcctgctatcttaaacctttcattaattgtcccacagtactgtgccgcttggcttcattt

SEQ ID NO: 707435 - DNA, 778 bp, Homo sapiens
ggctggctccggggagatagcgcctgtcggagtcggtgggtcggtcctcgtcgccggtcctccccctccccggtctccgggggagtgcgcggtggagtcctgactcccggagtgttctccgagtggagggagaatgcgtgcgactggcggcagtggagtaagcctgacgccggagacgtgatgctggtcctccggttgccccgctaaaccccacgagaggccaatgggcgaaccaggctcgcccgcaccgccagcctggacgacatcagatctagtccgccctgcgggaccctggtgggatctatgagcatgtggaggtggtcggcaatggaacctacggacatggttgtacaagggtcggcatgtcaagacgggacaagctgtgctggcatcaaggacaatggatgtacacagtcagagacgacggaggaagagatcaaaaacacgcgagatcaccatggcttgatggacatgtaactcttcaccaccggcaacaagcgccacactacgtagcgggaagccatacatcaaagtagagagcgccccctggggagaaccgatggagcaaggatctaggagtggttgatggacagattccatggtgaagcgcctaggattacaggaggaaccttgagaccttggcagtaaaggcaacagaacaaatggcacaagacccctatagaaggaagagacatggtattcagaaccgaatatcttgcatgagaagaaacctcaaagggatctggccaatctgcgaataaggcacaaaggggaaata

SEQ ID NO: 707436 - DNA, 481 bp, Homo sapiens
gaaagtaagggtcggctggccccccttccctgtcctgatgccgccagctaggaaagggcagtgaacttgcatatggggcttagccttctagtcacagcctctatatttgatgctagaaaacccatattttttaatggaagaaaaataaaaggggcttcccccttcatcccctcccttaaacatataatattttaaaggtcaaaaaagcaatccccccccctgcaaaagctctttttgagcccttggtggcatcaaagcaggaggagccccaaaaccccctttggtgtccccccagggtacctgctcaggaaccccttttgttttttgaaaagtcaaaaaaggacattggctcccgccctgtgagattttgtttttaaacttggaaggggggaattattttaaataaagtcctttaaaaatctttttaaaaaataggaagcggcttatatatttaataataaaaaaagggccccagctgcca

SEQ ID NO: 707437 - DNA, 160 bp, Homo sapiens
tggtgagcacatctatagctgaagaactaggcagtggctccagcgctgggcggtggtggtgacaagtgagccaggtcaagaagaatggatttggccctagagtaggggttctccacatgtgacctcggccctacaagactctcttaggactatgtcagtg

SEQ ID NO: 707438 - DNA, 453 bp, Homo sapiens
  misc_feature (2)..(2): n is a, c, g, or t
cnaaatttcacctggggctcctcattattcttctggaaccccagaacttgaaagatctaaaggaaattgaatcttagtagagctcatgtctaccagccccaagcccctgcagcggggagactgctgtttgtgcttatctgtgcaggcgctgaataaaacggggcagctaaattctccagttccatgtgcctcctaatgtttaaaagaaaaaagcaaagtaacttgttaaaaattgacttgcaaaaaagtagaaactgttgggtggtggtgtaaagaaatggcattttcccaccaaggacaagccatccagttgtcagtcacaccgtatgaagcagcaaaggtgaaggagagaaaagggtatgtgtacaagagttgctttgcatggtctcatctgagatggttgcattcgaactgttgtaagaattgtaagaatcttgacttttttacgtttgg

SEQ ID NO: 707439 - DNA, 163 bp, Homo sapiens
  misc_feature (16)..(16): n is a, c, g, or t
agcagactccgtctgnggaaaaaaaacgaatgagaccatttaaaaatgtaattcgtttttggctgatttaaaatgtttgctcacagtggtgttgcctgagttaaatagatggaatagctattacattttataaagtgggtctcattcttattattttctgagt

SEQ ID NO: 707440 - DNA, 100 bp, Homo sapiens
cagaacattcacctttaattctgttacaggttccagtatttgcgcctcgaattgagctcgaattcgagcctcgaattcgaggctcgaattcgacttctaa

SEQ ID NO: 707441 - DNA, 206 bp, Homo sapiens
ctacgtggaactggtcgaggtcgcccaagcgaaatttttaatgcaggtttggtagtataggacctgtgggttgggaggtactgtttgcagttaataaagttaaagctccgatcagggtctatctcgtctatgctgtgcttatgccctgccatcttcacgaggcggagcaagttccacattagtgcgggtaccggagctcgacattc

SEQ ID NO: 707442 - DNA, 187 bp, Homo sapiens
gcaccctgagtgtcatctcgctgaggctcttcctgctgctgtctccctggacgacctggctcgagcaacctgggcccacagccctgcatgtctcaccctgcatatcctaggtttgaagagaactgctcagatccgcttatttctgccagtatattttggacactttataatcattaaagcactttcc

SEQ ID NO: 707443 - DNA, 513 bp, Homo sapiens
ccccagttaacactgtcagggggggccaagggactttttttaccctgcctgaactcgagagcctagagcctctaatggacggggcaggccaccctgaagggaagacactagaagaggggcctgcagactcaagtttgacttccaggcgcagtcccccaaggagctgactctgcggaagggtgacattgtttacatccacgaggaggtggacaagaactggctgtagggaaagcacctctggcgcctgggcatattccttgttaattatatgaaggtgctgccggcacatgatatccttaaccccatcaagcccccgacctaccaggggctgtagtttgtagaggctgtggcccagaacaccttcatgggggacctgcaggtggagctgtccttccgaagggaacagcacatttgcctgatccgtaaggtggactagaactggtacgagggacgcattacgggcacggggcaccaaggcgtattccctgccagctacgtgcaggcgtctcgtga

SEQ ID NO: 707444 - DNA, 388 bp, Homo sapiens
cgatgtacttttcatccaaaatacgcgagggcacttcttatgacctgctcagcgcgataatggcaggcaaggtccgagagaccttcctgcacatggtgtctctccaaatggtcagtatgccaaggaaccatgtattagggtaatgtgtcctgaaccccatcactatgctctatacacattatttaaatggtttgcagcccatggattcctttgtattggtattgtggaaataaaatacaaataggtaataatagttacagtaaaaacaaacaaagcctgtttgaaaaaacctagacatagtcctcagtatatgctattgaaatgtcgatacactaaatcagaataagaatggaaactttaaagtgaaaaattccccttagttaaaaag

SEQ ID NO: 707445 - DNA, 487 bp, Homo sapiens
atccaccctggtaaaaggtcacttattcccaaattgatataaatgtttaacacaattcatatcaaccttccagtccaatgtttggtagatatagccaatattattataaaatatatatggaaaggcagaagaactaaagtagctgacacaacttagcaaaggagaataaaatgggatgaatccacccattgatttcaagttttgcttagccagtcatcaggagtgcgggatactggtgaaaggatatacacatagatccatgggacacaataagtgaccgggaacacgcgtgcacatatgcgcaactaatttttaacaaaggtgccaaagtagtttaatggaagaagatagccttttccacaaatggaactctagcagttagaaatcccaaataaatggacttcctcctaagtttccccccttaaaaaaacttaccccaaattctggaggttaatgttaaatatggacatatttatcttttagggga

SEQ ID NO: 707446 - DNA, 650 bp, Homo sapiens
agtttagcgcttgctttgtcttcctctgctctgcttccctacttaggaaaatttcaagctgcaggttcagcggctgccgtctttaacgagagcattcactacacttatggctggaattaggcgcttagtacttcaacggccctcaggcagactacaaaccgtgacaaacggtgtggaggatcttatttgtgcagataggattcgttacaaatgcaccagatcaagaattccagtaaaagggtttcaggcctcacctgaagatcatgagaagtaccatggggatccacagaacccttataaactgcatattgataccagcattaaaagtacaagaagactgccatattgacagaaagagctactaaagatgctaggattatacaaagcacgtacccatcatgctcacaagaatatccctacagtgaatgcagaattgaaagtcgttaagcatttgataacgagtaagcccttgaagttgccacaaggactttcacagggtgagacaggtttacaagaggcctaaaacactgtgagttaagactgcaatggcatttggaccttgtgagcagaaaggacatgattcctattgcccaacagatttccaatgggcacaatgttctaattgatggtcataagtgtttttttcctgg

SEQ ID NO: 707447 - DNA, 185 bp, Homo sapiens
  misc_feature (56)..(56): n is a, c, g, or t
tggtgataaaggcggatgaggggcatctctactggttgaccaaatccaccagcttnctcagtgactggtcctcagcctgccgatcagcagctgtctttaggttttctccccttcatccgcttatacaattggggtacctgagctctgaattctgtaagtcattgggtccataaagactttggtta

SEQ ID NO: 707448 - DNA, 331 bp, Homo sapiens
tgtttttttttattattttattttattttgttttctcccggggtattcttttggggtttttgtcagttttttgctttaattgatgggtcggttttttttccagtggttttttggccattgggccttttttgttttgttggttttttcttttcgattgtctttttttttgttttttttgttttttgtggtggtggtaggttgtaggttttttttttggttgtatttgtttttttttttttttagtttgtttgttttttttttgtattttatttagttttttttacctttgccattagatttttagtaaaataaaagcccggaccaaaaaaaa

SEQ ID NO: 707449 - DNA, 366 bp, Homo sapiens
  misc_feature (359)..(360): n is a, c, g, or t
tgcactccatcctgggtgacatagtgagaccctgtctcaaaaaaacaacaaaataaaacaaaaacttggcatcaaattaaataactattaagtattaattgtaattttaaaaaagacatattatggccaagtgtggtggctcgcgcctgtagtcccagcactttgggaggccgaggcgggcggatcatgaggtcaggagatcgcgaccatcctggctaacacggtgaagccctgtctctactaaaaatacacacacacaaaataagttagccgggcatggtggcatgtgcctgtaatcccagctactccagaggctgaggcaggagaatcgcttgaatgtggagataggaaggggtganngagcaa

SEQ ID NO: 707450 - DNA, 427 bp, Homo sapiens
gctactcgcgttgtcaaataaagatatttgtttcccggcgtagagttgactctacagacacaggttgcagcaaatagaacatgcgggatatgacaaaatgaaggagaaagttgaacgtattctttagcattgaataaattgctttattaacaggctattaatttattattatcctgaacagctctttggtgctgctggtgtcatggctattgagcatgcagattttgcaggtgtggaacgccttagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttaga

SEQ ID NO: 707451 - DNA, 138 bp, Homo sapiens
gtcaaggcatgacttgcctctagcaagctgtagtcttcccaggcccccacctttgccttgttaaaggattgttcctgtatgagaccaaagtatcagatttaatatagtcccagcagacttagaacacaggaaaattag

SEQ ID NO: 707452 - DNA, 409 bp, Homo sapiens
cacgcggggatatctctatgtgtgtttctataatgggcctctgacacagatgtggcgttggatatagagaaacactattgcgttaacatatggcacattatttaaagcgcgtgtttcacactatcctttcatatttattccttggataaatttgggagggacgcgcgagaccaaatttcctttcatatggaccattcccatagcgtttgaggaaaggggttttgagatgagaggattccaccaataactcggccaagggggattacacccaaatttcttaagaggagttctggatataaaggttagatatggcctgaaagttggttagagggacacagagagagccgggtctttggaagagtttcggcgttacattaccttcattagagtgagagaggttgcgctcttt

SEQ ID NO: 707453 - DNA, 188 bp, Homo sapiens
tagtcacatattactgggaggcttttttcattcctttccattcttttttctctattcttgtctgcatgtcttatttcagtaaggtggtcttcaaactcttatatcctttcttcggcttggtcgattaggctgtggatgcttaagaatttatcagcagttctccggtgcaaggcttcaacttcagtgtg

SEQ ID NO: 707454 - DNA, 1178 bp, Homo sapiens
ctaaaaaaaaaaaaaaagaaagaaagaaaaaaagcaacgaaacataaaacacacaagcgccccgttgcccccagttgacttcttgggccttctacagagccccctgccagccatgcattggggccgccggccgtgcatgccatgtcacggcgcgccctcacgatcgctagccccctcgtgtgctgtcctttccaagccgccacggtgcatttgtactatttcatcctatgccgcgcgttcatttatcttcaatcaacaaaaggcgttggagaactcggaagaactggacgatttttccccattttttaagattattgacagcccaagcgcgcctcgccatctttcaccctatctaacgctgtgctttgcccacttggacttccttgaaaagggggtgggaggagatcccatcggtcgcccacccttgggaagtgcctaaccttttattttaattcacagtttatacacgagcgaaacaagaaccgcctgattcacaggttgaacgaaaccacccctgggccctctcatcatggccgggattccccagtccctctgcacaggctgggaagggtccccgggctggacccacgggggcttcatctgggctgtgcctccggggacaacaatgggctgcttggccctgcccggggacatccagaggcgctgcacggccacccttgcctggctaaacagaacccaccaggagccaacgttgggctaggagagactgaaaaggaaatgtcagccagatagagcctggacaaacagggaccttcaatacgacgcactataccaccactcatcaccaattcggatagtacaccatatacgagacaacaccaaagtaaggaacggaacaacatcaaacacatatacaaagagtgctaccaccaaaaggaacaaacacgaggcaagcacacccaaccacagcacgaacgaaggccacacgagcccatgcctacccaaagtcaccacccacaatgcgcaaccaagacaaacaacctagtccgagacacccaacaaaggtcaggaaacaccacgcacaaccagcaggacgtagccccaaccgacgggacctagagacgacagaacacacaaacagacagaacgcaaacacaaccttcaacaccggcagcagagtagacatagactaacacaaccaactagaatggagcaaa

SEQ ID NO: 707455 - DNA, 432 bp, Homo sapiens
agccgatccccatgccaataacctccattggtgtgacactaactttagaaggtacatcttaccaagacaaggtgggggaagttcaggttctgtagcatccttcacctcatctgaaagcttgtagttgattttatgtattgcagcccattcaaaaataatcttgtaaagcatagtgtttgcttaaacttgagacagcttgcaatgtggcttccgtttagtgtgacacaaacctgttgtggactctctattataccacagaaattgttataaccaccacgtctatttgtcttccagaaggacacttgagagtcacttgtaaaagttggcctgtgctttcctattaaaaactgctgtgtaaatggtagttagtctcctgtttagtatgcggagtagctagatcaccctgcattcacaatgctctacattatgaaa

SEQ ID NO: 707456 - DNA, 150 bp, Homo sapiens
agactcgatggaaaatagcttgattactcctctctcatctgtcgattgtatagggaggcgagaggaacaggtgacagtctaccctcccttagcaggaatactcccacctgagctccgtagactaaccatctctccttacgccgatgcggg

SEQ ID NO: 707457 - DNA, 534 bp, Homo sapiens
  misc_feature (172)..(172): n is a, c, g, or t
ccgaattggtgcccgtgcctgagtgtggggcgaatactcagctgcagtatcagtgccagcttctattataatcctgtgcctcagcacggcagtggctgactagatatgagacagcggataagttgttagcagggtcacagccaacattggctgattactcatgacgcatgtncatgttgtacctgtgagtgtagcaccacctgtgagactgtagtagtgctgacgtaccagcagaggcagtcttgcagagcatccgagtgcgacaacgataccagatctgggatcagaggctaatgtccagctagcatgcaaccaagccagagtggtatgcgaagcacgggcattaagggttacttgtgtacatcagccagtagtggcagtggaagtctatacagtagcgtgagagtatgagaacctgcaggggcagtctcagctccagtacatgtttcagtaggcagccagatcgtcactgagcactagtagcaacagtgagagttgcaatactcgtctggtccgcgacttaatgccgacggc

SEQ ID NO: 707458 - DNA, 863 bp, Homo sapiens
ggtcggtcacgacgagggagaagcggacgtgtcatctgaaccagatgtctgagcttctgtagccgcgttgtagcaacacagggttcttacacgctgcttgtccaagggggtctgtaacaaaggcgtgggctttctcaaacgtgaacgatggtcccacacgggccttaaaaaggctgtgtctggcccaaaacaagactctcaccggttgggaaccaagcttcctgtttttttccgacccctctttttggggaaaaaacaccgccctccgtttgcctcagtgaatgcaccccgggaagaaaacatagccgggggacaaacgtagcccgagaccaaaacgggcaccgctgtggtccccaaggccccccagccccccggcttcatgaaacaacacctgtcgagagacccctcgtaagaaaagagacttatctcccctctgagggaaactggtcttctctgggcgaggacacacacagacaaaaactcaaggggaccacagaacgccaccccggggtagtacatcgcattgaggtggaacagaacaataatgtggtcacttccgcgcgaagacaagaaaatgatgggggggaaatacaaactcgtgtaggttctctctcttatgcaataatgactcccgaacatgtgtcactcgccccacgcaaaatatcctttggccgattcgtgggttataacaccggcggtcagtgtatgccatctcccccaatggacatatatctaatcattaagttgctgttataacaaaaataagccccacaatctggatagggaccccgagaagtcccaatcaacaaaaatttcggggccctagcacggaaaaaaaaacaaaataaaatccccacataaca

SEQ ID NO: 707459 - DNA, 108 bp, Homo sapiens
aaatcagtgctgtcaggaaaatgtacctgtctcttctactcaacacacaactgatgataggcccctgagctccctttccaagagaatatactaaacaaggacttaaca

SEQ ID NO: 707460 - DNA, 348 bp, Homo sapiens
gtaaagtttctcacactcaagtcgtcttcatagtttactgtccttttccaaacaaaagctaataacgccatacgcatccacacactccctcctggatgaacctaagtctcgtccccactgtcaccccaaggccagttatcaaacaaaagctaataacgccatacgcatccacacactccctcctggatgaacctaagtctcgtccccactgtcaccccaaggccagttatcaaaaactgttccttctctgccctcaaagactgaagccgcagccctgttctgcctctgctcaggaatctgattgctcttaaagtgctcttacaagattccgtcgatgtttgctccctc

SEQ ID NO: 707461 - DNA, 306 bp, Homo sapiens
  misc_feature (123)..(123): n is a, c, g, or t
  misc_feature (169)..(169): n is a, c, g, or t
  misc_feature (211)..(211): n is a, c, g, or t
  misc_feature (259)..(259): n is a, c, g, or t
  misc_feature (284)..(284): n is a, c, g, or t
gagcatgtaacggtgcaggtggtggtcgtgcggaaacgggaaggcctgctgcattccagccacatctcggaggagctgaccacaactacagagatgatgatgggccggttcgagcgggatgcnttcgacacgctgttcgaccacgccccggataagctcagcgtggtgnagaagtctctcatcacttttgtgaacaagcacctgaacaagntgaatttggaggtgacggaacttggagaccccagttttgcagattggngtgtacctggttctgctcatgggcnttcttggaagacttaacttttg

SEQ ID NO: 707462 - DNA, 146 bp, Homo sapiens
gttcacatgtggcgacggggtctcaggaaatggggaggcctgataagagtgagagaggggaagaagagttgatagaagagtcagaaacaaagattaataaagtttggcattaatatgggtgtggtacgtggtgacgtaaaacaatt

SEQ ID NO: 707463 - DNA, 314 bp, Homo sapiens
  misc_feature (33)..(33): n is a, c, g, or t
  misc_feature (37)..(37): n is a, c, g, or t
  misc_feature (77)..(77): n is a, c, g, or t
  misc_feature (261)..(261): n is a, c, g, or t
  misc_feature (274)..(274): n is a, c, g, or t
  misc_feature (287)..(287): n is a, c, g, or t
gaattcggcacgaggcaaccccgagatcccggncgcncctggagaggaacattggcttctggacacaagcctaaatnaggtctgttggccggcagtcactcaagagcaatccccagctttccttcgcaacacgaatggaagattggactttcctgggccaacacaagaggcatcctgaattccccgtcgtaactcgagaatcccgccgcaactcgagaaaaaccacgtgcttcccccgtcatcgcaagatgaagccctttncctctacagcgtntcaggaggaagtnccacggttaggaattgggaggttcgga

SEQ ID NO: 707464 - DNA, 268 bp, Homo sapiens
  misc_feature (124)..(124): n is a, c, g, or t
atcggtcctgcgtactgggcgtatgcccttttcctaacactcacaacaaaactactaatactaacatctcagacgctcaggaaatagaaaccgtctgaattgattatgtcggccgtttgtccangagtttcatagggggaccagccctaggcctgctttagattgtaaattaggtcatccatcgcacggttgccatcttgtcaatgggccagtaatcgtctggaatgattcattgaaacgacgacggtccactaatatttgactcttt

SEQ ID NO: 707465 - DNA, 295 bp, Homo sapiens
tggagagatttcagacagctttgaagattgtattgattcatttattttgaaaaaggggaggaggaggggagggactcttttgtttttcttccacccaggttttggcttcctgagggtttcttacagcgtttagggtttctttaggggcccagcttttcttcagtttttttgctacttcaacttttttgttcttccagtcttttaactaagacagagacactgcaaaccagcagacagagcatcacctttaaagtcctaaacagctgtcaatcttgaaatctcttccccgcaaaaa

SEQ ID NO: 707466 - DNA, 780 bp, Homo sapiens
gttggctggcgtgctgggaaaccatgatgtgccacgttggatgtcgtcttgtctcatctagcaagcggtctcaggagcagatgggcggtccagggattcgttgtgacatgtgtggcgggctggcgctgcattgttttccaccgcatcatagagggcttgcattcccagtatgagccgaatgtttcattgggcaacaagtcgaccaagaagagctaaaccagtctttgcaccacattgggaagctttccacctacttaacgtggcagcaaattgttttaacggcaggggaaggggtccaacaaacaaccacatttgggcgagctctgtctggggcagacacgttcacgagtggggcccatgtcaactttttacaccaagcgtcattatttatgtgggcacgagacaaatatgggcgccgcgtcataatgcgacttcgtacatcgttactatgacgcacgtcgtaggtggcaaacttcgttgtcattctaatacaccaagctgttggggtacgtaaaggaggaaattaagttacgagttacgcaattttataaagaaagtggttttggttgagttaagaattttagtgttgcaagaaggttgtgattaccttacagagtggggacatttctaggaagataagcagggataggttctatgagcgaaaagtaaattaaaccctgagaatttagtatagggacagaggatggtgttattattgaggagcgcaagccgataacgagaagggtaaagtaatgtgagttgctttagcacgattgaggg

SEQ ID NO: 707467 - DNA, 147 bp, Homo sapiens
gatccccggcgttgcgtgtcacttatgagtgggactactatgggatttagcggggtgatgcctgttgggggccagtgccctcctatttggggggtagggcgctaagctggacgtggtacaaaggctcatgaagacatcctgccgaat

SEQ ID NO: 707468 - DNA, 1883 bp, Homo sapiens
ggggggcggggaatccttccgcccttcttaggaggggctgcatcgcacgggggagagtgaactgacagacctcagtcactgacgacgggacaaacggagtcgacgaaggacaaacgccgtcaaacgccccaaccagcttccgtactttctccacgcccggcgcactcccccgcgacctcccgaggcacctccctccactcttcggcacacacgccagctaactctgactcgactacccagcgcagcctctgccgggaccctgctgcacctcgccccgctcccgcttccctcttctttctctggccggcatcgcccattcccagcaactcgcctctcgtcgcgcccctgcgccgcgcctgcgtccgtcccgctacagccacctccccaggctccccagcccagccgcgctcggccccagcgctccgggccccggcaccctgcacgcccgacccagcgcaccaccccccctggccggtggctggcctcccttgcagctaccgcccccttcaacttctggccgagctccccacttgcccgccctcccctcccttcgcacctggactggctcctacggccgcagcgactcctctctccgcatctccttgcgcctcccttggtctcccctctcatgcgccgttctttccactcctgtcccattttatctggtcccctcccttctgtgctcggcgcgcgcgccgactctgcccgcgtgacgcccgcactcccgccccaccggcccccctctcccaacgcgctagcccagcatcgtcccccgccctggcccgcctccttccccaattctctagcgcgtgcgcccaccatgtcacgctcgtgccatacgccctccggctccgcggcacttgtggtttggtgtttgttccggagtgtcgtcccccctcccccgcccctcccccccccgccgccgtcgccgcccctgccgccccgccccgcccgcgccctccgcgccctgcccggtcgccccctccgtcgcgtccgccgcccccgccccgccctcgcgcccgccccgccgcgctctcgcctcccccgcccacccgccgccgcccgcctctcacgcggccgccgccgctggccaccgcgcgccgccccgccgcaggccgccagcgccggcagcgccgctccgcgccgcacccggcgccttcacccacgactcgtgcgggcgcccgcgccgacggccgcgacgcccggcgggcagctggcgaccgaggcgcgcgcacgcgccgccaccgacgtgcacggccgcgcaccgcccagcacccacgtggcgctcctgcctggccccggcgccgtcggcgtgccgtggcgggcgcggccgtcgcggtgccgcgccggccgcgcggcggacgtgggaaggcggacgcggcgggtcgtcggcactcggctgcgagcgcgcaggcatggccagcggcgcccgccgcggcagccgccgcgccccgccgctcccgcaccgcgcccgcgtccgcccgccgcgcgacgcgcgcctgactccgccccgccgccgccgcccgccccacggcgcccagcgagcgcgccacgagcccatgcacagcgccacgagccagttcagcgggctcgatactacctcgtcccctcttctcactcctctcacacgcccgtcactcctccacactcctcacccacacactcgctgaccctctcctcctcgccgccccactcccgcacgacccgcccaccaccgtacccatctcctgctccctcttcgtctagctcgccacctctacctcctcctctcctctctctctcccccatctccgctctcccccagccaccaccacaccaccacagcacccgttcacgctccaccgcccgtccgcgccgatcgctcacaccaccctcataagaac

SEQ ID NO: 707469 - DNA, 142 bp, Homo sapiens
gttagtaggacaatctatcagcctcatagaatatatattgtagtataagtaacatgaaaacattctcctccgcgataagcctgcgtcagattaatacagctgaatgtgacaattaagcagcccaagtatctagcaatcaacc

SEQ ID NO: 707470 - DNA, 177 bp, Homo sapiens
cccgagcgccgttccggttgcaccgcgttcgttccgagtttcaggttcgtgctaagttagcgccgtcgtcgtctccctacagtcgccatcatgattatctaccgggccctcaataagaaacgatgagatgttctccgaaatctaaaagatccgggagatcgcggacggtttgtcgct

SEQ ID NO: 707471 - DNA, 435 bp, Homo sapiens
  misc_feature (266)..(266): n is a, c, g, or t
  misc_feature (302)..(302): n is a, c, g, or t
  misc_feature (337)..(337): n is a, c, g, or t
ctgcctcagcctcctgaatacctaggactacgggtgcgccaccagtcctacctaatttttgtatttttagtagagaacggggtttcacccatattggctgggctggtctcaaactcctgacctcaggtgatccgcccaccttggcctcccaaagtgctgggattacaagcgtgagccaccgcgcccagccaagttggttattgtatatattttgcattaaactgaacttcgatgaccaccagataatacaaatgttaatgaactanacggaaatatgtgccataggaaaatgggttagattnatcagaaaatctgttgagcagtaagaagtgggtangaaaacaaggtctcgttgcatgttgcaagggatataaaaccctaacccatttaaaaagatgaatgtcagcctgggcaacttagtgagaccttgtctgt

SEQ ID NO: 707472 - DNA, 193 bp, Homo sapiens
  misc_feature (4)..(4): n is a, c, g, or t
  misc_feature (17)..(17): n is a, c, g, or t
atcnttatgagccacanatcacaaggctgggatccatgctcagccatctgataaagaggggcttacttctgagcatggtattgatctacttctgtaattgtggggattcttaaaacgctctggtacgtatgacggtgttccccgaaccagctgtgaggatccgggaaaggaagagcgggagatacaaagattc

SEQ ID NO: 707473 - DNA, 189 bp, Homo sapiens
gttctattgtattcaaggctcctagttcgaccagatattgtgaacttcgttcacaccaatgtatgtcgctgaaccaccggagagccctatgctgtcagctgaattagcaggtcactctatgactagtgctgagtcttggggtactggcagagctgtggctctaattcccacatttcgaggtggtgtgac

SEQ ID NO: 707474 - DNA, 332 bp, Homo sapiens
  misc_feature (48)..(49): n is a, c, g, or t
  misc_feature (55)..(55): n is a, c, g, or t
  misc_feature (236)..(236): n is a, c, g, or t
  misc_feature (287)..(287): n is a, c, g, or t
  misc_feature (289)..(289): n is a, c, g, or t
aaagaaaagaaaaacaataacacacacatcagaccaaccacagagaannacatgntcacatggatgagtgttagggaagaagatctagcgcccttctccctccggaagaggtgggagtcggagcctcacccatacgttttcttcaatgacgaccacacaaccatgacattcatcggcttccatctgcagcccaacatcaacggcagtgtcgatgccatcagtcacttgactggganggtcatcaagagagacgtcatgaccagggacctgtaccagggcctgctgcncnagaggtgcccttcaatgtcgactttgataaactgcccagacac

SEQ ID NO: 707475 - DNA, 554 bp, Homo sapiens
tcactcggtacctgcttattgcccagggtgagactcaggaaactctcttccagtctccatccagctcgttaataggtgatgagatgagattcaggcagtgactatatgcaactcccttgtactttcctgtaagcacaagtttactgatcaatgataggagtgtgttgatcacaggtctagtccgtctgtgctttggtgagtcgaatactgccggcctagagtgctcaaatcgacttgcaatagggatgatcatcgacatggaatctgtgccttctagcttggccatatgtcccccattgttcccgtattgatattatgttgatatcagcgaaccgtgcatctatcattgcctgcagagtctataagcatttatgattccttgtaattattgatcatgtggtcttttgttgctatactaagggtctaaatctgattcaggttagctgttgatgcctttgactgtaactgtaattctctaactttcaacccttttatcatcaaggacctcaactattattttttgttccatatttgaaaacttttggtgttccaga

SEQ ID NO: 707476 - DNA, 354 bp, Homo sapiens
  misc_feature (42)..(42): n is a, c, g, or t
  misc_feature (54)..(54): n is a, c, g, or t
  misc_feature (122)..(122): n is a, c, g, or t
  misc_feature (200)..(200): n is a, c, g, or t
  misc_feature (256)..(257): n is a, c, g, or t
  misc_feature (292)..(292): n is a, c, g, or t
ggagtagaggctcagtgagctatggtcacactagtgtacgcngccgggtgacanggtgagaccctgtctcttaaaaaaacaacaaacaaaaatagtgataatgtatatttagcataaataanatgtctacaaatgaattttagaatgtgtagatgagattagaggattgaggaaggaatgagtcttacctttggtagttnggagttggagcagcagctaaagctacgcagcaaagacaaccagaaaattcatgggnnaacagttttgacctgtctttcagctccaagttctngggtcctttttctaagcagctcccagtttgttccatagcattccaccaattttcctttaagc

SEQ ID NO: 707477 - DNA, 104 bp, Homo sapiens
gacttctagagagatcccctcctgctatctcgccgctttctgcttctgccatccgaggacaactatattaagttggatttttggagcagtgctcttggtgagcg

SEQ ID NO: 707478 - DNA, 625 bp, Homo sapiens
  misc_feature (43)..(43): n is a, c, g, or t
  misc_feature (106)..(106): n is a, c, g, or t
  misc_feature (122)..(122): n is a, c, g, or t
  misc_feature (189)..(189): n is a, c, g, or t
  misc_feature (194)..(194): n is a, c, g, or t
  misc_feature (201)..(201): n is a, c, g, or t
  misc_feature (210)..(210): n is a, c, g, or t
  misc_feature (212)..(212): n is a, c, g, or t
  misc_feature (217)..(217): n is a, c, g, or t
  misc_feature (245)..(245): n is a, c, g, or t
  misc_feature (259)..(260): n is a, c, g, or t
  misc_feature (310)..(310): n is a, c, g, or t
  misc_feature (323)..(323): n is a, c, g, or t
  misc_feature (388)..(388): n is a, c, g, or t
  misc_feature (394)..(394): n is a, c, g, or t
  misc_feature (420)..(420): n is a, c, g, or t
  misc_feature (497)..(497): n is a, c, g, or t
  misc_feature (502)..(502): n is a, c, g, or t
  misc_feature (560)..(560): n is a, c, g, or t
  misc_feature (572)..(572): n is a, c, g, or t
  misc_feature (576)..(577): n is a, c, g, or t
  misc_feature (600)..(600): n is a, c, g, or t
  misc_feature (610)..(610): n is a, c, g, or t
  misc_feature (621)..(621): n is a, c, g, or t
cctgcctttaaaaaaaatcagcattggtcctattaaggccatnaggataaattcttaagcctacaaaagacgccttagtactactgcgcccaggcccaataatgtnaactaaaatctgactncaaagcccaggtgtagtttctagttccatttctacagtcattcagaagcacgttttaacttgatttncagangtcagtngaggacccnancagtnctatcaacctctataagagggggacatntagcctacttgctnntacccttctagccatatccaccccttatttttaatgggacaccagggcancccatttattgcnataaactaaggttttccccgggaaaaaacaaggcttttctctagaccagctggactggtcatggngggagntttataaaagtggctgtttgccagtnaaaaaagggttcatttctcgaactttttccttttccttttctgggctccttatctttttctggttttgaaggctttnaagantttgtctttttcttgatcatggcatcagtttctatagcatcttggtctttctcatcanattgagagttancttnntttaattcttcattgtattccgnaaccagggangggctttttcngtgt

SEQ ID NO: 707479 - DNA, 484 bp, Homo sapiens
  misc_feature (241)..(241): n is a, c, g, or t
  misc_feature (283)..(283): n is a, c, g, or t
  misc_feature (291)..(291): n is a, c, g, or t
  misc_feature (322)..(322): n is a, c, g, or t
  misc_feature (328)..(328): n is a, c, g, or t
  misc_feature (338)..(338): n is a, c, g, or t
  misc_feature (363)..(363): n is a, c, g, or t
  misc_feature (424)..(424): n is a, c, g, or t
  misc_feature (430)..(430): n is a, c, g, or t
tttccattacataggcaaagtttgttttttcccatatcaaagccaaatattatttgatgtactgaccaataatatatgtagaaagaataacagcaaaatatcttatttctttatataatttaatatataccctattaacaccagtgtgcagatgtacagtctgacagtatactaaatagttagtattaaaaattactttaaaaatgttttcaacattaggtactggtggaaccagagctgntattttgtcatcatatcatttatgtgttgcaaaggaaaagtnaaatttcnggagcattaggaatgtactggtattttatgnagattncaaatctcanacattatgaaacctccaatctatgngcctataaacactttaacacttgctatctggtcataaggtcttaaatatgaaccataaacncatttncaagctttgtttaagcaattgctgttaattggcactttaggcctgtacattgtg

SEQ ID NO: 707480 - DNA, 271 bp, Homo sapiens
tcggaaatagcgacgtatgtgcgggtgtggcctgaaaagaaaaaaggaaagaaacatactccccaccagtgaactggaagcagaaacaggagctttggggtcccacaggatagattctgtctctgtgctgagagtctgctcatttggaggagccccagggcccattcactccagtgagacgcccacccatgtgggggaccccttggtgggatgacagcctggcggccagtcgcgtaaattttccggcgtaccgaggctcgaacttcggtaa

SEQ ID NO: 707481 - DNA, 471 bp, Homo sapiens
  misc_feature (45)..(45): n is a, c, g, or t
  misc_feature (96)..(97): n is a, c, g, or t
  misc_feature (168)..(168): n is a, c, g, or t
  misc_feature (170)..(170): n is a, c, g, or t
  misc_feature (197)..(198): n is a, c, g, or t
  misc_feature (216)..(216): n is a, c, g, or t
  misc_feature (261)..(261): n is a, c, g, or t
  misc_feature (268)..(268): n is a, c, g, or t
  misc_feature (273)..(273): n is a, c, g, or t
  misc_feature (462)..(462): n is a, c, g, or t
tccgggcgcttggagaagatggtgctgcggcggctgctggccgcntgcgtgcacagcccgcagctggtggaacgtctgtcagagtcgcggcctatnngacgtgcggcgcactcacggccgttcgcactgcatgcaggcccagcgtgcggggcaggacgcggcccgccncntgcaggacctcgcggctgggccgtggnntcccgtgtgccgccgcgntgaggatgttagagactccttcacccaggagcgtactccgcggcntccgagncgtcnggggccaccaccaaggtagccagaggggccctggcgcaaacatttaatcctgggctgtgcggggccgaggcgcttgcttttccttccgggctctacagtggcatcaatgtggaggggtcattccgggcactgcgcgcggcttcgaatcccgactgggattgttggcctgcaagacatcccacgcataanagctaggca

SEQ ID NO: 707482 - DNA, 93 bp, Homo sapiens
  misc_feature (68)..(68): n is a, c, g, or t
  misc_feature (70)..(70): n is a, c, g, or t
gatctaaaaaatacaaaatgtagacaattactattcaggtgcttacttttaagccaatatgtagcagngnaaaactaatttctctgtggcagt

SEQ ID NO: 707483 - DNA, 188 bp, Homo sapiens
  misc_feature (98)..(98): n is a, c, g, or t
tatcatacagtccttgagctggctactctctagcgagctcagctctcctgagctggcggacgaggaactgagctccagagagtattcagcgagcctgncacagcttgctgtcagaagtacactcgagcgtcagctgcgctgctgcagcgagtcctctcgtctctacacgctatcagcggtgtatagct

SEQ ID NO: 707484 - DNA, 157 bp, Homo sapiens
gaggctgaatggagtcacggggcgcgcacgcggggaaacactacaaggtgcggcttgatgagtacgatcactccaagcccatccaggtgcaacagacagaagcccatttgagcgagcactggagagaagcacaccactgtcctactgtggacgtcag

SEQ ID NO: 707485 - DNA, 894 bp, Homo sapiens
  misc_feature (658)..(658): n is a, c, g, or t
  misc_feature (763)..(763): n is a, c, g, or t
gaacatgtggtgacaaaattcatgtctgtcgcgaatccgaggctgttcatcttataaaagcggtgtccgggttgctgaactgtgtcccaggaggaggagaacatgctcaaggaaaagtctggaagtataagatgtcatggttggggtgccaaaggcagctcccaagggcagcatgcggacgtctatctcaaagcctcggataccatggtcctagaggggactacccaaggatggagctccgtgggttgacactttttctgtgaaaagaacactgaggcaccagtctgggtgggtttgtaatcactgtaactgcagtattgtgtacaaggtgtctaaacatgtgtacaagactaaccgccagttccctgcaggcgtgagctgaacctcagggggtaagcgtgatcctgtcattctggtcaccaatagcaggagggtcctggcactacgccagatttccaccatgtgctgctaatatcccagctccagccagaacccatctgcagctgaatgctctaacttcacggtagcagttacagctgaagtgcatcagatctggcaggcacactgagtcaccaggtagcgctgctactggaggtagagacgggccttcggagatggtgcccagcaggtcaaaccaactggctctgtcaggaacagncgattgcatgggaactctatgggagtggcttttaaccttccgatgaggttaaaagggtgtagacccttccttctcagaaaattttctaccgggttgtttgaagcnttgaaatttgaggaacccccctaagggggcggggtaatagagaaagaagcccttgagggagattccttagagaggttttaagaactttgaaaaccgcccttttaaggtcgtttggggtgtgggacagaaat

SEQ ID NO: 707486 - DNA, 495 bp, Homo sapiens
agaccctactctagaaagcactcttctgggcattgggttgggaagtggctaagacagggttcttcaggtttagttggcaagtatatgatcactaccaaataatgagatgtacagatagtaaattggcagttgagaggagagaaaacaatgggctgtgactgttgtggaaagtttactggaagaactcaatttaggtcttaaaagagagatcctttggatgggagaggagggcattgtaggtagaaagaacagttgatgctgagaagcaggtctaggcaaggcttatttaagaggagtgtcgttggagataccaggctgtgtctaagggtgatgttaggattaatgagaaattaaggagcaaagataggttatggccagtgagtgactttagaacattataccagtctttccggcagaatttaaaattattttctgtaccttttctcctttaaaaagcattttatcttgaatcatgcaagtctataggtaagatta

SEQ ID NO: 707487 - DNA, 344 bp, Homo sapiens
agacagccaagattttcatagaaggcctaccacgacagcatccgtgaccaccatagaacacaaagcccaagatggaattgtcaaaatattttcaaactccaagaaagaggattgtgtctggttaactccaaagaaaccacctgtctgacaactacaccggccacagctgcaccccagcacctggcaaaagctactgtaatttaggatcctaccacaaccctgaaacaattgcctttttagttgtcgactaccaagtcaaagcacaaacacactagctcctaaaccttacctcaggcttttactagaattaagccctcccacgggatccgtgcacgttaacgatt

SEQ ID NO: 707488 - DNA, 109 bp, Homo sapiens
acctcagtggacaattaccagttgtcctgtcctgttcagtcaactcagcacagcaatcaagggttggagctggaatatgtgatcatgcacttggcacatcccttttcct

SEQ ID NO: 707489 - DNA, 196 bp, Homo sapiens
gaggttgcagtgagcgagatcattcaggcaacagaatgagacttgttaacaaaaacaaaaagtgacttgatttacggggaaaaaaatgacctggctatattcagtcagactctggcaaaaagtctcacggtgtcaatgtgaatgctcaaggtcttggggggggtgtcccctatcagactacaggtgttcagaggca

SEQ ID NO: 707490 - DNA, 279 bp, Homo sapiens
gaggaatctttaaagagggagagtgggcatgggaggaggaattaagctattagtcatattttatttagaaaactagatcttaagtaactgtagaaaaatgttaacaattattaacttggaataaaggttaaatgggattatgttactatattttttaataatgtgaaatattttatattttgaaaattaaaaataaatagtagatttttataaaagtggaatatgaaatgaagtataatgtgataatttgggattagtttaaataaaacagatttatta

SEQ ID NO: 707491 - DNA, 214 bp, Homo sapiens
gtacccctgcatcattgtgcccacagtcttctgatacatcttagcgaacatctgtttcatttgtacaaggtccatctcacttcgagtgaccacaatccggaccagggtgtaatcatcttgcgccaacaccttttcatagcatagtacagcttctcagcaaagaaagcaggacggttcagggcacactgcaagatgtatacgaatgttcagtggc

SEQ ID NO: 707492 - DNA, 442 bp, Homo sapiens
  misc_feature (166)..(166): n is a, c, g, or t
  misc_feature (244)..(244): n is a, c, g, or t
  misc_feature (246)..(246): n is a, c, g, or t
  misc_feature (248)..(248): n is a, c, g, or t
  misc_feature (250)..(250): n is a, c, g, or t
  misc_feature (252)..(252): n is a, c, g, or t
  misc_feature (256)..(256): n is a, c, g, or t
  misc_feature (259)..(261): n is a, c, g, or t
  misc_feature (393)..(393): n is a, c, g, or t
  misc_feature (405)..(405): n is a, c, g, or t
catgataagcaaaattttaaactttggtagttaaacctttatgttgcctcccctctggctgccagctgtggggatgtgcttctcccttaaggactttggcaagaataacaagttcattggaatttgactttctgacatagagcagacagccttgccctgtcatgcnaggcctttcatgtgaagttaccatttattagctgcttctgtctctccagggaaggatttccttttataagcctgggcnangngnangatngtnnnattccccatgtgataccagagttggaataggctgtagtgagattagggccaggactgtcccattttggattcttgaatggtttctgttacaacttgtcatggggaaaaagtaacacttattttttttttccncccttagaaggnccaaaatactaaatgcatttgagaaagccggtagttt

SEQ ID NO: 707493 - DNA, 1155 bp, Homo sapiens
gctcatgaacactctcctgcaatggacactcagggtgggtgactgcgatggcttctccaccttcgatgttcccatcttcacatgaagagttcttggaccacgaacaaagcgctgttgaggcgtgagcttcggcgcgttgcggtaccagatgaattgtggtccttcgtagtgagcagaatcgcggttacttgcagaggcacacgcagatcattgagcagcgcgcgcgatccgctctggagcaggagctggctgctggaggagcgtgagtgacgctggtcgctgctgctgtcgtgcctccaggtgcccgtgcgccagtgcgctctacctgcctagacgttcggcctactactgccctggtgcccgggtcacgggctgagaacgtctcagcgctggggcactctggaccttctacattgtgccccggcttcagcgtgacgcctatctaacgcgagcccgtccagacgactagaagcgtcactcgtctccgcaatcacggaatagtcctggcccaggttcgccagcgagtcacctgttgaggaattgcgccgggtccccacgaatgcggagggagacgtcttgtgggcgcggccttgacaagagcgcacaacccctgtgggacagataacggctgttgggtccaggccttttgggggcctggattcagcaatcgctgtcacccattgtgggggcattccaagacccaccattacagagtttaactttacttgctaggaatacccttttagctttgtccaatctccccagggcacccgttgtgaaatcgcgggagaaaagggcattccgcttgcgtactatacagcccatgaaggaaatccttcaacaagcacagaaggggttggccccctccctcaggagcgaacaagcccaccgcggctagccctaggtcttctccgaggccagccccatggacacatgtggggagcatcgtaaagaccccaagcgccccaagtacaacgtgcagggaacttcccccaacagttacttcacgtaacgtgggtggtctgggtccaataagtcccacacacggaaaggcttgcttttgtgcaggacttaccttgaagatgtccgccgcatttctggtaccccgacatgtgtttggaggtcggtttgacccattcttgctcacactcatcc

SEQ ID NO: 707494 - DNA, 863 bp, Homo sapiens
  misc_feature (380)..(380): n is a, c, g, or t
  misc_feature (863)..(863): n is a, c, g, or t
gccagtttgaatcgcggtgcgacgaaggataggtggtggatctcaccgtggtccgataagccttttctctgccttgtttgttagagtcagcgaaatcgaaatggtgcggaaaagtgttggaaaaggattccggaaatgtccaagacaagaggctggttccccggctcgaagagagcccgggtttgcaggtccccatggtgggcccgtatttcatcgacacttaaaaattctaggacgaccagctcatttgacgtgttgtggcgcgccaattggccgtttgttgtaccagggcaagcacattcgttgggattatacctttacaagcggaagggagagataaaactttggaaacacatgggcgcaagggacacatgtgcctnttcaaaagggaacttaaaagaggcttacaagaagggggtataaaccccctttgcgttccattttgtgcaactttggtgctcacatacccatggcgacgcatttgacaaccaacttgggcatttcctcctccaattacaagggcctaaaccattgtggctggtgtggagtggcgtgttcctttcccccaacaagtatttccccaagaagaatttcttcctgggattttggggaacacagaaaggcggcgaccaactaaggaaagcactgtggtcctaaaaagaggggaattggccgttgggagatttccccttgtgggtagattcctacgaagggaacttcttaaaaaataactctcataaacacaagttttggccccaggttggtgggagctgagattcccccagtgtggggtactcttggcatttcctccttgggtaacaaaacacacacaacaaatttttgtggcgccgtttgttgggacn

SEQ ID NO: 707495 - DNA, 134 bp, Homo sapiens
cggttcggataaccgactggagagggatgcacgatggtcggacattgtgctcagaagagggggtgtactgggtaggtgcatgtgcttctgtgcaaatcctggtcccgaagatggcgggggagggcacgagtgag

SEQ ID NO: 707496 - DNA, 206 bp, Homo sapiens
agcttcctttagacttattcttatcatatattcaatatcatagccatttaggcacctatgtggtgcagaagcagactgctttgcctcagcatggtcacagtattcaccagtggtaagtattaaagagcgctaagacatacagcaagcacagactcaatgtgctgactagctattcacatacaactactgacattctgtaagctaat

SEQ ID NO: 707497 - DNA, 259 bp, Homo sapiens
atatggttccaatgtatcctgcttacaaaacgggtctcggcaattatttccaaagggtattggtgaagaattatgcttcggaaagaaatggatgttagacgtgataagtggaccaatcttcgactatcacgtataatggctcacatgacacagaagactaaataacacagtacgtggaaggcagttccattcctgttccagactcacgtactacatctataatcacccagctgatctggatttcacctcagtcctgccc

SEQ ID NO: 707498 - DNA, 441 bp, Homo sapiens
acttagaaaacaaaagacaaaaaaaacgctattcttcaataaacattctgatccagtacatctgagtggcttgactatcactatatttaatctataccaaatggtttattattcacccctcaaatttgaccacagttaacctgtacccattatgcacacccaccatcttacataacattcattaatgggcacccttatcccttatttcagatcccttccctgaaaagtcatacatacatatatcacttaggccattagtttaataggctttggtatgcatgtatgtacataggacactaacataggttggccttcttcatttctttcagattgggagtccaaatatggccctgagacaatatctccagaaactgatatatatgaaataactttacccaaacatgtaataaagcaaataagtaaaacacttggcctcgaggc

SEQ ID NO: 707499 - DNA, 133 bp, Homo sapiens
cgacctccccggctcatgttatcctccgacctcagcagcctcgagctccccggctcatgtgatcctcccacctcagcagcctcgactcccaggctcatgtgatcctcccacctctaggaatcccggcggccga

SEQ ID NO: 707500 - DNA, 150 bp, Homo sapiens
ctcatgctttatacttcacggagaaacaaaacaaaacatgcaacaaactggtaggaaacttccccagctggattaggagttatgaaaaacccaaagctaatagcatacttagtggtgaaatagtaagagctttccctcagaaactgggaa

SEQ ID NO: 707501 - DNA, 529 bp, Homo sapiens
ctgacatcgctccggggtcagtgctggatattggtatgggcatggctgcttggtagtagcacagttccagcactgaccccggagcagaagaatggatgctgtactgacatctgctcacctgcatcgtggccacctgtgcaatgggcatcctggtctgcagatgagtccactgtggagcatttgccaaagcggccttgcagatccattttgcgtactctctggacgcacgacaatctcctgaccgtcgcaatcgcacacccctggggtctgccctgtctttcacctctggtctccatggcctctgtcattgccttcggtacccatgcctccggacctgcacctcttgcccgcttggcaaatccccctccttgcatgctcttctcgcgcgctgtgctttgtgtctatgtccccttcatcactgcccagtcgcctagcaaccacgcctccctttacccccccaccgcaacaacgtggcccgctgccctctcgcacttggggtgtctggtcccctcctcttcccgcgcaccag

SEQ ID NO: 707502 - DNA, 255 bp, Homo sapiens
ttgggcactgtgttttatttttttcaaggaactccacaagagcagtcctgtatctgctttccttaccattgaacctacagtgcccagcacatagtgggcactcgacacatacttgttaaaggaatgaacaaccagatgagtgaccaaactggaaacaaccatccaatgcaaggataatactagaatccatgattcctgtcccgagatttctttcttttttaacctttggtctgctgagattcatttatgtgcagt

SEQ ID NO: 707503 - DNA, 110 bp, Homo sapiens
aagacaccctgaaagacacaaccttgggtaacatctgttatattctcctagaacaggaattcttcataaaaatgttcttccaggttcggaaggataaaatcaaattccca

SEQ ID NO: 707504 - DNA, 2779 bp, Homo sapiens
  misc_feature (33)..(33): n is a, c, g, or t
attactgtgagcctccttgtcagcactccaccnaagcctctgcctcagccttactgtgagtctggttgacagtagcttctaagatgtcccagcaacacacactgccagtgaccctctcccctgccctcagtcaggagctcctcaagactgttcctcctccagtcaatacccatcaggagcaaatgaaacagccaactccactgcctcccccatgccagaaggtgcctgtcgagctcccagtggaggtcccatcaaagcaagaggaaaagcacatgactgctgtaaagggactgcctgagcaagaatgtgagcaacagcagaaggagccacaggagcaggagctgcagcaacagcactgggaacagcatgaggaatatcagaaagcagaaaacccagagcagcagcttaagcaggagaaaacacaaagggatcagcagctaaacaaacagctggaagaagagaagaagctcttagaccagcaactggatcaagagctagtcaagagagatgagcaactgggaatgaagaaagagcaactgttggagctcccagagcagcaggaggggcacctgaagcacctagagcagcaggagggacagctgaagcacccggagcagcaggaggggcagctggagctcccagagcagcaggaggggcagctggagctcccagagcagcaggaggggcagctggagctcccagagcagcaggaggggcagctggaggtcccagagcagcaggaggggcagctggagctcccacagcagcaggaggggcagctggagctctctgagcagcaggaggggcagctggagctctctgagcagcaggaggggcagctggagctctctgagcagcaggagggacagctgaagcacctggagcaccaggaggggcagctggaggtcccagaggagcagatggggcagctgaagtacctggaacagcaggaggggcagctgaagcacctggatcagcaggagaagcagccagagctcccagagcagcagatggggcagctgaagcacctggagcagcaggaggggcagcctaagcatctggagcagcaggaggggcaactggagcagctggaggagcaggaggggcagctgaagcacctggagcagcaggaggggcagctggagcacctggagcaccaggaagggcagctggggctcccagagcagcaggtgctgcagctgaagcagctagagaagcagcaggggcagccaaagcacctggaggaggaggaggggcagctgaagcacctggtgcagcaggaggggcagctgaagcatctggtgcagcaggaggggcagctggagcagcaggagaggcaggtggagcacctggagcagcaggtggggcagctgaagcacctagaggagcaggagggacaactgaagcatctggagcagcagcaggggcagttggaggtcccagagcagcaggtggggcagccaaagaacctggagcaggaggagaagcaactggagctcccagagcagcaagagggccaggtgaagcacctggagaagcaggaggcacagctggagctcccagagcagcaggtaggacagccaaagcacctggaacagcaggaaaagcacctagagcacccagagcagcaggacggacaactaaaacatctggagcagcaggaggggcagctgaaggacctggagcagcagaaggggcagctggagcagcctgtgtttgccccagctccaggccaggtccaagacattcaaccagccctgcccacaaagggagaagtattgcttcctgtagagcaccagcagcagaagcaggaggtgcagtggccacccaaacataaataaccacccgcagtgtccagaggccctcagatcgtctcatacaagggaagagagagccactggctccacttatttcgggtccgctaggtggcccgtctcatctgtgaacttgactctgtccctctacatgtctctttaatggggtgagggtgggggagagagggaattattgtccagtgccaaccccaatgaccccaatcccaacctcaggtgagcagagcctctacttgagggactattgttactataggaatccttacttccccagtattgaagctgaatcagtgagtgtgtacaatgatacataataaatcctggaagtcttgggatcctaaaaaaaaaaaaataaaaaaaaaaaaaaaaaaaaaaaaaaaaaaaaaaaaaaagggggggggggctaaatatatatccctcgcgaggagggggccccaaacatcaaagccgcgcaccaccagacttattgtgtgagaacacaaggagggggccaccaaaaagaggaagggacactgatataaataagggacagcaggagcggacggaaggagagatataagaaaaacacagcagacgatggggaaaaaaagaagcgagacgacacgaggagaggacacccaatcgagaagaaaaagaacacacccaaataaatataggcgagggagagacggacagaccaacaagtgtggacacaacaaacacaccatcaagcaaggaaaataaaaaaaaagaaccctcaagaggggggtaaaactatatatcaacaatattcaagaatggtgagttaatacggggtgggtggtgaacaccaactcggagagagatatatatgttggtaaccgaggtttgggaaaaaaggtgacagggcaaacacgcgaggagataaatataagaactctcgacaaaatatttatatcacaggggaagaacctatagaaaaaaagagg

SEQ ID NO: 707505 - DNA, 2299 bp, Homo sapiens
  misc_feature (33)..(33): n is a, c, g, or t
attactgtgagcctccttgtcagcactccaccnaagcctctgcctcagccttactgtgagtctggttgacagtagcttctaagatgtcccagcaacacacactgccagtgaccctctcccctgccctcagtcaggagctcctcaagactgttcctcctccagtcaatacccatcaggagcaaatgaaacagccaactccactgcctcccccatgccagaaggtgcctgtcgagctcccagtggaggtcccatcaaagcaagaggaaaagcacatgactgctgtaaagggactgcctgagcaagaatgtgagcaacagcagaaggagccacaggagcaggagctgcagcaacagcactgggaacagcatgaggaatatcagaaagcagaaaacccagagcagcagcttaagcaggagaaaacacaaagggatcagcagctaaacaaacagctggaagaagagaagaagctcttagaccagcaactggatcaagagctagtcaagagagatgagcaactgggaatgaagaaagagcaactgttggagctcccagagcagcaggaggggcacctgaagcacctagagcagcaggagggacagctgaagcacccggagcagcaggaggggcagctggagctcccagagcagcaggaggggcagctggagctcccagagcagcaggaggggcagctggagctcccagagcagcaggaggggcagctggaggtcccagagcagcaggaggggcagctggagctcccacagcagcaggaggggcagctggagctctctgagcagcaggaggggcagctggagctctctgagcagcaggaggggcagctggagctctctgagcagcaggagggacagctgaagcacctggagcaccaggaggggcagctggaggtcccagaggagcagatggggcagctgaagtacctggaacagcaggaggggcagctgaagcacctggatcagcaggagaagcagccagagctcccagagcagcagatggggcagctgaagcacctggagcagcaggaggggcagcctaagcatctggagcagcaggaggggcaactggagcagctggaggagcaggaggggcagctgaagcacctggagcagcaggaggggcagctggagcacctggagcaccaggaagggcagctggggctcccagagcagcaggtgctgcagctgaagcagctagagaagcagcaggggcagccaaagcacctggaggaggaggaggggcagctgaagcacctggtgcagcaggaggggcagctgaagcatctggtgcagcaggaggggcagctggagcagcaggagaggcaggtggagcacctggagcagcaggtggggcagctgaagcacctagaggagcaggagggacaactgaagcatctggagcagcagcaggggcagttggaggtcccagagcagcaggtggggcagccaaagaacctggagcaggaggagaagcaactggagctcccagagcagcaagagggccaggtgaagcacctggagaagcaggaggcacagctggagctcccagagcagcaggtaggacagccaaagcacctggaacagcaggaaaagcacctagagcacccagagcagcaggacggacaactaaaacatctggagcagcaggaggggcagctgaaggacctggagcagcagaaggggcagctggagcagcctgtgtttgccccagctccaggccaggtccaagacattcaaccagccctgcccacaaagggagaagtattgcttcctgtagagcaccagcagcagaagcaggaggtgcagtggccacccaaacataaataaccacccgcagtgtccagaggccctcagatcgtctcatacaagggaagagagagccactggctccacttatttcgggtccgctaggtggcccgtctcatctgtgaacttgactctgtccctctacatgtctctttaatggggtgagggtgggggagagagggaattattgtccagtgccaaccccaatgaccccaatcccaacctcaggtgagcagagcctctacttgagggactattgttactataggaatccttacttccccagtattgaagctgaatcagtgagtgtgtacaatgatacataataaatcctggaagtcttgggatcctatattctctttagcattttcttctatcacaccacataaaaacctgtgtatgggtcaatggctgcaagagactcccacggcccattctcaaaggaggacagactctttttaaatttgtcactcaaaccg

SEQ ID NO: 707506 - DNA, 277 bp, Homo sapiens
ggggcccccccccattaaattggggtgggtccccccctaggccccccccggttttccccttttttttcccccccgtattttttttggaaattttcacggaaacccctttcccccccgaacccccttttcccccttttcccccccacccgaaattaccccccccccaacaaaaccaaaaatggagccccccccccggggggccccctttaaaaaaaagggaccccccccccccccagaaattggcccccccctttttttaccccatttttccccaaca

SEQ ID NO: 707507 - DNA, 271 bp, Homo sapiens
  misc_feature (258)..(258): n is a, c, g, or t
ttcacgcccacatgactctgtgttggaaatgtggaaacgatggaatggttgggccctcataccaccatcttgtctcagtcattggacagtggcacagccataagaaaatcataaacttgttccaaaagctgagtataccctgtaggagccaacagtggtatgctgtcaggtgatcacagtcttgaagcagggcagtttttttttgtttgtttgtttgtttgagaccatgtctcgctctgtctcccatgctggagtgcngtggcacgatctc

SEQ ID NO: 707508 - DNA, 1173 bp, Homo sapiens
taaattcgcggccgcgtcgacgcaggacggacaactaaaacatctggagcagcaggaggggcagctgaaggacctggagcagcagaaggggcagctggagcagcctgtgtttgccccagctccaggccaggtccaagacattcaaccagccctgcccacaaagggagaagtattgcttcctgtagagcaccagcagcagaagcaggaggtgcagtggccacccaaacataaataaccacccgcagtgtccagaggccctcagatcgtctcatacaagggaagagagagccactggctccacttatttcgggtccgctaggtggcccgtctcatctgtgaacttgactctgtccctctacatgtctctttaatggggtgagggtgggggagagagggaattattgtccagtgccaaccccaatgaccccaatcccaacctcaggtgagcagagcctctacttgagggactattgttactataggaatccttacttccccagtattgaagctgaatcagtgagtgtgtacaatgatacataataaatcctggaagtcttgggatcctaaaaaaaaaaaaataaaaaaaaaaaaaaaaaaaaaaaaaaaaaaaaaaaaaaagggggggggggctaaatatatatccctcgcgaggagggggccccaaacatcaaagccgcgcaccaccagacttattgtgtgagaacacaaggagggggccaccaaaaagaggaagggacactgatataaataagggacagcaggagcggacggaaggagagatataagaaaaacacagcagacgatggggaaaaaaagaagcgagacgacacgaggagaggacacccaatcgagaagaaaaagaacacacccaaataaatataggcgagggagagacggacagaccaacaagtgtggacacaacaaacacaccatcaagcaaggaaaataaaaaaaaagaaccctcaagaggggggtaaaactatatatcaacaatattcaagaatggtgagttaatacggggtgggtggtgaacaccaactcggagagagatatatatgttggtaaccgaggtttgggaaaaaaggtgacagggcaaacacgcgaggagataaatataagaactctcgacaaaatatttatatcacaggggaagaacctatagaaaaaaagagg

SEQ ID NO: 707509 - DNA, 654 bp, Homo sapiens
atttcagaaaaatcagaaaatggaggttctgggtccctccgagcaaaattggatctttcagaaggacctagtaaacccacgacacttgcaggacaattccttaaggagggaagcacccttacaggagtagatttcgaacttggggacactggctaaaggcttcccttaaagaagagcggtttggtagtggacgatacctgggggattggtgatcgacctggaaaagtgatggcgccttagggattacaatagccgtcattgccgataaggtggtttttaaaaacactttaacaacttggatggaggttaaacaaactaaaaacgttttaggtggcttcccacaataaataagacgctctttagaaaaggatcgaattaaatagaccggactgggaatgctttgttggaaaggaacagctcaattctaagggaggcccattcattaaaatctcaagtcaattgaaattttgggggggtaaagttttaaatttatttccaggggcaaagtcgaaaaaaagggcttaagggggtaaaatcaagcctcaaggcttaaatatgggaggctcaaggggaattgagttttcactccctttttaagggccggaggtaccttgtttcaaaggggaaattgaaaccccttccttggggtttggg

SEQ ID NO: 707510 - DNA, 699 bp, Homo sapiens
tactacagtcaggttgctacagctgttgttatccacagcgacaagaggatgggagaggaagtcctgggtctgcaaccgttggagacagagcttgatgacgtggtactatacattgctacagtgcatcagctctgttgccgaagtagtcttcgtcagggcggacgatgcgtcagtgcgcttcagatactctgcgcctccgcagatgttctacctatctctccatggaccttcaggctcctcctaggatgtatcctggggtacgtcacaagctgccacaaccaatctattgcactggcatagatcatcggagttcggaatagagacacaggttgggctagctagtgtcggcccaaaggaaatggttgctcgtaacatccatggccgtcccgtgatagaattctagggtgtagcccgtatcggaaccttgcatgtattcatcagcgtaccatgaatccgggcgtcaacgagtcagtgtgtctggcatgtgtccagctcagtgtgcatccgtgtgcagctggaatcacatgccaaggtctagtgtcaatgtgccagatgattcatatcacgacccgtaaatcaagatgatcccatcatgccgttttgatggtgtgctgggcaatgtgcacgtgatactccgggggatagtggtgcaatcctgcagagagagagaaactaaaccgcttattagctccattatga

SEQ ID NO: 707511 - DNA, 228 bp, Homo sapiens
aggagagccactacgcgccacgagatgggctgccaggtgaacaagggttggccacagtgcgggaaaggtagggagtcccagccctgctgacagggctccggagctcactggggaccgagatggaaggtcccacctcacagagcctagcttgcgactgcctctggcatgcttgcgagtaatttgacagagacttaattagtaaattaagatggcagaaaattaaaactt

SEQ ID NO: 707512 - DNA, 701 bp, Homo sapiens
  misc_feature (701)..(701): n is a, c, g, or t
gaggcagccgggtgcttcgcagccggagctcgaggctctgtagcacccagttggacccagtctgcccagtgcacctgccctgctgcccctgtggacctgtctccttgcgcctccacagatggatgtgtgatgttctgatgcgatcccacctgctgtgctgtgcctactccgtctggtggtgccatgtgatgctgtggtgaatgctgaatgtgcatgagatgacccctgtggaccccaagctgcttgtactcttccctgcctgccctgaacctaccgatgaccacacatttcagacaaggtgtgcccctttcctaattgtgtggctctctgtgcctgagatgtaccaagggagacaagtgattttgcgtttcgcagagtgtagttgagtcaagtcgaggtggcatggaaggaatgaatcgttcggcgaaatttgtggcactacggacactgagggttgacgatgggcccattggacggcatttgtgggccccccaagacccttttccgcgagatgccgctcgggggtgccttatcacacactggtggcactttggtgcgatcttcacattaccccgttacctttggcccggacaagcattatacagttacacgagcgccaactggcttttaaacaatgcccccactgtcggccttcaatctgtttggacaccggaaagtgtggtccagacgtcgagagattn

SEQ ID NO: 707513 - DNA, 298 bp, Homo sapiens
ttacatttttaattttgtaaaatttttttactcttttgtgatgtcatttagcttgagcactcattgttcaactgcacaaaaatattctttatatccttattctctaagcatttttctatttttagttttttactttttaatttttttgttaaaaactaagacacatacacacacataaacctaagcctacccgtggtcaggatcatcaataccactgtcttccacctccatatcttgtcccacttgaaggtcttcagggtcagtaacatgaatggagctgtcatctatgataacaatg

SEQ ID NO: 707514 - DNA, 188 bp, Homo sapiens
tagtcctccaagctggtccctgacgctgcctcctctattcatcttgctcactgtctcctccatctgatatcacgaggggaacatcttccttggctgtcatcttcatttcaatcctgagctagcgctcgaaggtcagcaatgccactgacagtagaatcagaagcatctagcaggatgctcacagtgct

SEQ ID NO: 707515 - DNA, 166 bp, Homo sapiens
cttagtagatgacgggttcaccttgttggcaggatggtctctatcttctgacctcgtgatcctgccaccttggtctcccaaagtgctgggattacaagcgtgacgcacagtgcccagtctgatgtgctattttctgtatgttcttttgtatctttcacatttggtg

SEQ ID NO: 707516 - DNA, 305 bp, Homo sapiens
accttccctcgtgttactcccccgtgttgaattggaagaggcatagccccagtgctcagaaggcccagtgctgctgggtctggtggtggactgcgtgtgtgccccaatggtgcagctgctggaagtcaccactagggggtgatggagatggaagggggccaccccaaggtccattaaacaaccatgtactcctttcgtagtgagccgaaccccatcccgctccaccgctttttaaagccccccagccgctgtcggtgagatttgggcttgggtagtggacggaggatgtaccaccatgaggcaat

SEQ ID NO: 707517 - DNA, 323 bp, Homo sapiens
gtagcaagtggggtggagcagtcatttcttcacaggcagctttttcctgtgagctgtgcttccgatcttgaggttctgtacctggcagcacgcgggtggtgcctgaggctgtcagctctgctgggccacggtgggtggggctgctgcctcccactctggcattttgcttcaatctggacagacgcttcttgggctgctgctctgttgtctctaggttaggtctttctgctcatttcctttccaggcatttgtccctgtcctctagtcctgttgcgtgatgatggttccgtgttgtgatttgtccctgtcctctagtcctgttg

SEQ ID NO: 707518 - DNA, 445 bp, Homo sapiens
  misc_feature (25)..(25): n is a, c, g, or t
  misc_feature (42)..(42): n is a, c, g, or t
  misc_feature (45)..(45): n is a, c, g, or t
  misc_feature (53)..(53): n is a, c, g, or t
  misc_feature (62)..(62): n is a, c, g, or t
  misc_feature (68)..(68): n is a, c, g, or t
  misc_feature (91)..(91): n is a, c, g, or t
  misc_feature (114)..(114): n is a, c, g, or t
  misc_feature (233)..(233): n is a, c, g, or t
  misc_feature (306)..(306): n is a, c, g, or t
  misc_feature (323)..(323): n is a, c, g, or t
  misc_feature (380)..(380): n is a, c, g, or t
  misc_feature (393)..(393): n is a, c, g, or t
agggggttgagggtgcacagacctnccctgcccatgctgggntgncctgcagnttttgactnccaatncagtgataccagcaccacattgnacagggaggatcaaatttcctgnacttacatttgcactggcttcttgtttaggctgaatcctaaaataaattaggtcaaaaaattccaacaagtaggccaggggctgcagaggacactccagtgcagagggagaaggacttntaattttcaaaggcagggctggttttccaacccaggcctctgagaaaccatttctttgctatcctctgccttnccaagtccctcttgggncggttcaagcccaagcttgttcgtgtagcttcagaagttccctctctgacccagggngagtccatactgnccctgatcccagaaggaatgctgacccctcgtcgtatgaactgtgcatagtc

SEQ ID NO: 707519 - DNA, 382 bp, Homo sapiens
cgacaagcttcagagacatggtatgatagcgaaccgggaggatcctatggcattgaggcttccctgtagctctatgaacatagagccgatagctttttaaaggtgaccaatctgtggctacgcgccacgggcttattgcctgtaatcgcagcagtttgggaggccgaggcaggtggatcacctgaggtcaggagttcaaggccatccgggggcaacatgctgaaaccccgtctctaccaggaatacaaaaactagcgaggcgtggtggcgggtgccggtaactcccagctactgtggaggcgggatggatcacttgaactcgaggaggtgggggttgcagtgagccgagatcgtgctgctgcactccatcctgaggtgactg

SEQ ID NO: 707520 - DNA, 355 bp, Homo sapiens
ctatttcctgtgttctgactgtattctgaatacaagagaatatttaccttttaaaaattgcttccatggctgggcgcagtggttcacgtctgtaatcccagcactttgggaggctgaggcgggtggatcacgaggtcaggagatcgagaccatcctggctaacatggtgaaaccccgtctctactaaaaaatacaaaaaaattagccgggcgtggtcgtgggcgcctgtagtcccagctactcgggaggctgaagcaggagaatggcgtgaacccaggaggcagagcttgcagtgagtcgagatcacgccactgcactccagcctgggcaacagagcgagactctgtctcaaaaa

SEQ ID NO: 707521 - DNA, 900 bp, Homo sapiens
ggaccactgtggttctactatgccttctgaccccgtcttggactatcaactgggagaatgtggagccacttgaacaggctcctcttctggagcatattttcttctgtcacttgtagaaaagctgtattggattgtgaggcaatgaaaacaaatgaattcccttctccatgtttggactcaaagactaaggtggttatgaagggtcaaaatgtatctatgttttgttcccataagaacaaatcactgcagatcacctattcattgtttcgacgtaagacacacctgggaacccaggatggaaaaggtgaacctgcgatttttaacctaagcatcacagaagcccatgaatcaggcccctacaaatgcaaagcccaagttaccagctgttcaaaatacagtcgtgacttcagcttcacgattgtcgacccggtgacttccccagtgctgaacattatggtcattcaaacagaaacagaccgacatataacattacattgcctctcagtcaatggctcgctgcccatcaattacactttctttgaaaaccatgttgccatatcaccagctatttccaagtatgacagggagcctgctgaatttaacttaaccaagaagaatcctggagaagaggaagagtataggtgtgaagctaaaaacagattgcctaactatgcaacatacagtcaccctgtcaccatgccctcaacaggcggagacagctgtcctttctgtctgaagctactacttccagggttattactgttgctggtggtgataatcctaattctggctttttgggtactgcccaaatacaaaacagaaaagtttgagaaataatgtgcccagggaccgtggagacacagccatggaagttggaatctatgcaaatatctatacacg

SEQ ID NO: 707522 - DNA, 801 bp, Homo sapiens
  misc_feature (158)..(158): n is a, c, g, or t
gagaccgcgctgtgttggcgctgccgttgactgccatcgtgccaggccctcgggtgagtgtcggggccgagcacggccgaaggacgggttgctgtggggcccgctgggagtccgtttcttctgagtctgcccgggagggcttcctgtatagtatgagntcccccgggtggtggaaccctcgacctttatagtggaactcagattcgttgacttacacgaattgttagagcatgccacagtctagtaattatggaccaacgtggaatgtacatcataatagtcaatacactctcaagagcgacctgggaacgaggctcgtgctgaggaaattcgaagtaaattgttgctcatggggagaatcttgctggtatgctgagagggtcataatcgctccaggaaatacctggggcaccagtggcatgctggcttgaagatttgcctgcctgtccacgtgggagctgacttcccaaatgtgctggtcgcattcgactgccgtggaagctctcactaacagcagatccacggcagccgttccggtgggcccatcggcattccatgcaggatgctgaccctcaggggctggagtcgaacgagcctgctgcacgggaggcactcgttaatgtttaagccctaccataccattgcgcatgtgtattcaccaatgattctccgtctgcgcctatgtggatgtcgcaatacgcatgcagaaggaagggaatcacactcaatgtgcttgatgtgacagcatgcttgctcggaacgattcggacgcatgtgtggaccaattcccggggaaccatg

SEQ ID NO: 707523 - DNA, 2087 bp, Homo sapiens
  misc_feature (1865)..(1865): n is a, c, g, or t
  misc_feature (1884)..(1884): n is a, c, g, or t
  misc_feature (1925)..(1925): n is a, c, g, or t
tctcttcaacagccacccaaagcactcacttcaagtccaacatagtagcacaaacagcaggctgcatcagcagtcacgtgcatggtcatcacagcagccagaggtcaggcaattcataacacacattccagctcaacaatcagtcagcacaacatcatcatcatcaattccaacagatcacatcatctctgcgtgttcagccacagatatgtcgtcatgcacagagcacctccacaacacatgagtcccacagagcagcacaacaacacacatcagcgccagccaatataaagcgcggcagtcatgagatacaaacaaactacgacaaatgaaaccaagacaacaaaagcacgacaccaacgaatccatcagcccaagaaccccaccataataatgagatacacaataagtaacaataataacaccatgcacacatccaatacgaaaccaacaccggcaaactatgaccatacacaacgacaaacacaaaggaacacgccaagcgcgacaagcaaagggcacagttccgacgacgaacacttaacataggaggacagcagggtagggaacgacggaacgaaagcaccccagcagcgtaccaaggagcaccacacctgctactaacaccaaacgagaaccacaggaaccaacgaggtaacatgttaccacaacatacaggacacttaggatacacccaccaaagaggacaccctaaaacgagcgcacttataggaagagcgagccacaagcacatcagacaggacacaacaaaattaggatatacaccaccaaccatacagaagacacattcacggctgcggccacacgcaatccattcaaactcacttagaccaccgcatataatacagacgatagtatacataataagatgtatagtacacgcccgatgaaatttacagtatcggttaccccatataaggacaaacgcattatatccacaccaagaaggtgcgccaagccgcaggctaacacgcaattgataacaattcaaccgacacataccaacacaacacacacacaatcagcaacaagcatacgcatgcttatccgaatcataacgacacatataccatacacactacatacaacaacactcagttacggttcaatacaaaacataccattttatcaacaacaaacacacaagacaaaaaaaacatataatctacacatcacaaccaaactatactactttaataacatcactacactacacacaacctaatctcactatcacactaacacaacagcaaacacacactacagactgaatataataatacatcaacatatcacacaacaatattaaacatagatataaaaaccataacattatatcattacgcaaccaactgaatcgaatcaacgttactacaacttacaccaaagttcatttcatataacaaagtatcagatgagccaaaacactaacataataccacgactaacaaaatcatcaacatcatccatatacgcaaatcaacgctactatagcaactctacacatactaaactagacacaaactacaaccaatatagtacaatagcatactaacaaatactaatacataaaccactatcaacacaagcaagcggagaggactatacgaacaagactcaccggactatcagtccgaagcctaagagagagtagacaaggacagatcagagtagcgagagtactaacgcaggacacacgacgattcagttagcagtcagaacgaggcgtagacatagtactatgatgaccgagacagaaccaatccgacggcatgccgagaacccctgcagatggccatactctagacagcatggtaccgagacttcgcatcggtcttgatgancagcacgctactgaacgancgatagctcatgcatgagatcagtgagtcgagaatacgtanagacgcatctgtagcacattcgtaccacgaacatagcagacagacgcgagcagactgggcatcgcagactcaacagacgcggaggtatcgagccgcagactacagacaccatcaacgccgagcgtcagatgcacgacacggttagtctgaatcaccagcata

SEQ ID NO: 707524 - DNA, 875 bp, Homo sapiens
gccgagcgccgccatggactctgttgtccagagggcctgtgacgagctgcccggcgcctgcctgtcgcctgtgcgggccgcccaaacctgaccgagctgttcagcgagtcacggcgcctggctctgtagtgagctggtggcgggcggccccgagagccttctgctgtgcttctctgcgatcgcgagcgcctggctcgtttcctgaaccccgatgagtgtgcgcgccattctgcgcgcggcggagaggccggggaccggagtggcgctggctgtgtcggctgtgctgtgtgtgccgacggactctgttcggctcctcgcatcgtactgtctcttctggtgcaccgtacttccccggagctaggtctgggaccttggtacgccaccgcatgtgtgcgagccttggcttggcccgtcttctagccaggggcagtcctaacctggtggctgccacgcgtgtcgagacgcacttccagccccggcgggcgctggcgaaggtggccccttacgggttgcaagggacgctctgcgccagcagctccggctcggcgcgagaggtgattgcaggtggtcatggacgtgttcacatgacatcgaacatcttcagaagacctggcaagaaatatgcaggaccacagggagttgctgtgtatatccttctggaccaggctctcctcttctcaatttatggcatatgtgcatgcctcttgaaagttcagtcctgaacaggaaaaagttaatgacagttcggactattcacaggaacttatctacttttgcaaggtcaggaactaacgatcattgcggaagtgttcacgagaaagttcaccgtcgattgatggcctccggtggcaacaggcttgtaccagtgtaccttg

SEQ ID NO: 707525 - DNA, 526 bp, Homo sapiens
  misc_feature (7)..(7): n is a, c, g, or t
  misc_feature (15)..(15): n is a, c, g, or t
  misc_feature (27)..(27): n is a, c, g, or t
  misc_feature (91)..(91): n is a, c, g, or t
  misc_feature (157)..(157): n is a, c, g, or t
  misc_feature (208)..(208): n is a, c, g, or t
  misc_feature (216)..(216): n is a, c, g, or t
  misc_feature (219)..(219): n is a, c, g, or t
  misc_feature (225)..(225): n is a, c, g, or t
  misc_feature (289)..(289): n is a, c, g, or t
  misc_feature (323)..(323): n is a, c, g, or t
  misc_feature (406)..(406): n is a, c, g, or t
  misc_feature (426)..(427): n is a, c, g, or t
  misc_feature (436)..(437): n is a, c, g, or t
  misc_feature (445)..(445): n is a, c, g, or t
  misc_feature (454)..(454): n is a, c, g, or t
  misc_feature (523)..(523): n is a, c, g, or t
ggcggcncgggcagntcggagctccgngctgctgcttctggttctcattgtggccgccgtcgctgtccggctgccttgggctgccgaacanacaaggcgtgggccacagcacctcagaagccgacgcagctcgacgcaggggccgacaagaagggtnggcgatcgcgtgtcggagggcgccgcgcgggcaggcggacgggcgccaaanggggaaanagncggggncggcgggatcagccgctggccgggccggccggggaatttcgatgacctgacgcgaataccactncccagagtcggggaggagactgaagcaagccaanaaaatctaagaccccgaaaaatactccttcattgccacacgatacaccaaagacgcccaaagaagcaaatcacagtttagctngatggacatggcagagagtnncaccacaanncccccacncaaaaactngggccgagagatcttttgttctcgctgcgatctacacagttccttccacttgacagctaacagtttcanctg

SEQ ID NO: 707526 - DNA, 126 bp, Homo sapiens
acgtgtcacttctcatgtggaaatccatcttgcatactatcattcttgctccactggattccagtgtttttgtgcaaaaaagccatctcatgtgaagaaaactgcagatatgaaatgtccatcatg

SEQ ID NO: 707527 - DNA, 116 bp, Homo sapiens
gatgctccctcttcatgctcttgaactcatctcaccacactctggaacgaccggacattgacactcccacagtggcagggcccattctgtctgtggactgtgggttctcaatggaa

SEQ ID NO: 707528 - DNA, 731 bp, Homo sapiens
  misc_feature (447)..(447): n is a, c, g, or t
  misc_feature (515)..(515): n is a, c, g, or t
  misc_feature (533)..(533): n is a, c, g, or t
  misc_feature (540)..(540): n is a, c, g, or t
  misc_feature (549)..(549): n is a, c, g, or t
  misc_feature (569)..(569): n is a, c, g, or t
  misc_feature (573)..(573): n is a, c, g, or t
  misc_feature (580)..(580): n is a, c, g, or t
  misc_feature (584)..(584): n is a, c, g, or t
  misc_feature (587)..(587): n is a, c, g, or t
  misc_feature (591)..(591): n is a, c, g, or t
  misc_feature (596)..(597): n is a, c, g, or t
  misc_feature (604)..(604): n is a, c, g, or t
  misc_feature (611)..(611): n is a, c, g, or t
  misc_feature (618)..(618): n is a, c, g, or t
acttccgctgggacctgattcgtgcctgcgcaacatgcagcagcagcgggcagcagcgggcgcagggcagaatgcgcgaggacgtctcagcgggcgaagactgcggcccgctgcctgagggcgggcccgagccccggagcgagtggtgccaagccgggcccgcgcgagggcaagcgctcctactccatggagcacttgcgctggggcaagccggtgggcaagaagcggcgcccagtgaaggtgtaccctaacggcgccgaggacgagtcggacgaggacttccccctggagttcaagagggagctgactggtcagcgactccgggagggagatggccccgacggtcctgccgatgacggcgcaggagcccaggccgacctggagcacagtctgctggtggcgggcgagaagaaggacgagggcccctacaggatggagcacttccgntgggcagcccgcccaaggacaagcgctacggcggtttcatgacctccgagaagagccagacgcccctngtgacgctgttcacgccntcatcangaacgcctncaagaagggcgagtgaggcncagngggcccnaggntancctncccannaggcgancccaagnccttgcnctccctgactgctgcgggccaagcgaggggcctgggcatacaagctttaggcgcggttttcggagataaccttacattccaaaccaatcagcggggcggccagggtataggag

SEQ ID NO: 707529 - DNA, 216 bp, Homo sapiens
ggcgcctcctggggggtggggacacggtttcgtgaggagaattggaggtaaggctcgccaagctcgcggtctggaagctcctctgaaccccgagaataggagagagctcccgtcctctctcgtgtcctgatgcagcacctcgcaagtggaaggggtcgtcgcgggttaagcgcccgtgataggggaatcgggccccttctgggattcgagcggatc

SEQ ID NO: 707530 - DNA, 874 bp, Homo sapiens
agagagtagaaggggtgggaggcggaggtccgagcgcgccactgtgtctatgttaatcgggattgtgtcgggggtgcttcttgggtagcctgtcgcggtggacgctgtccatggcaatctattcctgggcgcgtgtgttgccgagagtttcgcgtattttggaagcgtgggcgattatttccggttgacggcgtctacaatctgggtgcaatcggggtcggccgcacgtttctttaagcctgtcgtcgtcgtgggacgtgaatattcggctggcggtcgtcagcgtggccagccgtctgtacaggagcccacctcgtgagtaggtctgcgatagcgtccgcccgcccaggttccccttggaatatcggcccaaagggcaatccgccttcattcctcgcgaagtcatccttccgcgcacatagtccacccgctttcgtattttcttagcactcttgcgcctttgcacgacgttgaagaacccccccgcttggtgggtgtagacaattacccagggcaaagtattcaatataagcaatcctggctttcagtcccacaatgaagcaaattctcgtgtcccgctcgtggacacacacgttcgggtggagtgacggcaaacccggagtcctcccttttggggcctgttccccctgagagtggggccacgacacgcccccccgggggatagggcgaggtctatgtcccccaggttgatgatatgtagctgggtaagcccactggcgccccgaatcttacacgagaacagggaacaataggggcatttgctcgccccaccgggaggatcttcagagtgggcgaccattttgttcttgaaaacacattttttcaaacaaacaactaaaacaacccacataac

SEQ ID NO: 707531 - DNA, 672 bp, Homo sapiens
  misc_feature (45)..(45): n is a, c, g, or t
  misc_feature (57)..(57): n is a, c, g, or t
  misc_feature (122)..(122): n is a, c, g, or t
  misc_feature (143)..(143): n is a, c, g, or t
  misc_feature (237)..(237): n is a, c, g, or t
  misc_feature (242)..(242): n is a, c, g, or t
  misc_feature (289)..(289): n is a, c, g, or t
  misc_feature (320)..(320): n is a, c, g, or t
  misc_feature (322)..(323): n is a, c, g, or t
  misc_feature (345)..(345): n is a, c, g, or t
  misc_feature (355)..(355): n is a, c, g, or t
  misc_feature (358)..(358): n is a, c, g, or t
  misc_feature (388)..(388): n is a, c, g, or t
  misc_feature (392)..(392): n is a, c, g, or t
  misc_feature (415)..(416): n is a, c, g, or t
  misc_feature (421)..(421): n is a, c, g, or t
  misc_feature (440)..(441): n is a, c, g, or t
  misc_feature (444)..(444): n is a, c, g, or t
  misc_feature (465)..(466): n is a, c, g, or t
  misc_feature (481)..(481): n is a, c, g, or t
  misc_feature (484)..(484): n is a, c, g, or t
  misc_feature (487)..(487): n is a, c, g, or t
  misc_feature (489)..(489): n is a, c, g, or t
  misc_feature (496)..(496): n is a, c, g, or t
  misc_feature (505)..(505): n is a, c, g, or t
  misc_feature (529)..(529): n is a, c, g, or t
  misc_feature (531)..(532): n is a, c, g, or t
  misc_feature (535)..(535): n is a, c, g, or t
  misc_feature (537)..(538): n is a, c, g, or t
  misc_feature (547)..(547): n is a, c, g, or t
tggtaagcggttcatgatgtttccttgggaattcccggataagtncaggaaaacatnctgcatgtggtatctagtcggatgtacttatccatctcattacaaacaaaaacacacagacggcnattggtagctctgtaatcctngaatacggaagtaaattttcttctttcctggacttggacattggtagctatactggttcccattttggtttttacaaatccttggggtctaatnctggngagcctacctatagcacgggattaaaatggtctggcatcatttcttnagttatccagttaactttaaacactggtggnannaagtgtaaaccagcccatgacnggttttggtnctngttaaagaacttcatggtccagtttccatngatnatggtgtagggacagacggtgtnnatgtncggtgcggtccgggaccanngtnaattacacttacgacgtattnnagttccacttcacanggnttngnccccagngaccctttnatcctttctaggccatttctggtngnngtngnngtggcagtnccccttggcatggtatggcttggacaacggtaattggaatcagatctgaagaggacggtcccagcaacctacacagcactactcgggggattacctcaaacaacaacacgcacaccacaaagcgc

SEQ ID NO: 707532 - DNA, 721 bp, Homo sapiens
  misc_feature (447)..(447): n is a, c, g, or t
  misc_feature (515)..(515): n is a, c, g, or t
  misc_feature (533)..(533): n is a, c, g, or t
  misc_feature (540)..(540): n is a, c, g, or t
  misc_feature (549)..(549): n is a, c, g, or t
  misc_feature (569)..(569): n is a, c, g, or t
  misc_feature (573)..(573): n is a, c, g, or t
  misc_feature (580)..(580): n is a, c, g, or t
  misc_feature (584)..(584): n is a, c, g, or t
  misc_feature (587)..(587): n is a, c, g, or t
  misc_feature (591)..(591): n is a, c, g, or t
  misc_feature (596)..(597): n is a, c, g, or t
  misc_feature (604)..(604): n is a, c, g, or t
  misc_feature (611)..(611): n is a, c, g, or t
  misc_feature (618)..(618): n is a, c, g, or t
acttccgctgggacctgattcgtgcctgcgcaacatgcagcagcagcgggcagcagcgggcgcagggcagaatgcgcgaggacgtctcagcgggcgaagactgcggcccgctgcctgagggcgggcccgagccccggagcgagtggtgccaagccgggcccgcgcgagggcaagcgctcctactccatggagcacttgcgctggggcaagccggtgggcaagaagcggcgcccagtgaaggtgtaccctaacggcgccgaggacgagtcggacgaggacttccccctggagttcaagagggagctgactggtcagcgactccgggagggagatggccccgacggtcctgccgatgacggcgcaggagcccaggccgacctggagcacagtctgctggtggcgggcgagaagaaggacgagggcccctacaggatggagcacttccgntgggcagcccgcccaaggacaagcgctacggcggtttcatgacctccgagaagagccagacgcccctngtgacgctgttcacgccntcatcangaacgcctncaagaagggcgagtgaggcncagngggcccnaggntancctncccannaggcgancccaagnccttgcnctcccctacacatatgccgccaccccgaacataggaggatcgtggcagataaaaaacataataaagctacctgtaaaagagaactcaaccatttcaaaaataa

SEQ ID NO: 707533 - DNA, 912 bp, Homo sapiens
  misc_feature (313)..(313): n is a, c, g, or t
  misc_feature (601)..(601): n is a, c, g, or t
tgtggcttcaaaaagcttttttccctttgggcccagggtctgtgtaggatattataaaaaagctgcctatgggcttgagagggagaagagggtttagggcaagaacgcccttattaattttgcgcagagggggcccttctaaaaatctcgcggggcgcctcaaaagggcctctgggctcgtcgctgtagaaagtagacgcctttctcagaaagaagattacctcggcccacgccacagcctctcgcggcgccacaccacagagctctgtgtgtggagaggtgtgtgcgtctcagagtgtggtggctcacaccnccaaactctttctctttataaatgagagtcttctcaaacttctcctctcatatctgtgagagaagagtgtgagagtctctctccagagagaagagtttccacgagagagagtagtggggggtctccggtgcgggagggacagaaaaaccccacaggggggtcttgagaagatatccacaaaagaggggccctctggtgtacacggtctatatattctctccacagggggcgcaccatggggacagtgtctataccacagtggggctgtctctgggggtgtttatatanccccactatctcactatttctaagggggtgggatctctcggtggaaagtgtctcgcgtggaaagaaaagaagcgcggcggccgcggcccaagcggctgtgggtatttggggcattcttatacgaggaaaaaagcgtctctcgatagagcccctttcggcgggcttttctctcctctcgggggcccaatatctcggggggaaaaaaaagagggggtctccaacgcgccttttccaagagagcccaatttttctatcggggggctcaaaaatataagaaaaccccccgagaagaaagagagtgtaaaggtaaa

SEQ ID NO: 707534 - DNA, 1061 bp, Homo sapiens
tctcccgaaaggtgtttttggagaaggttctgtttatccccccgccctcccctgtggaaaatatttggagccctgtaaagggtgaaggcgtttttttggggaagtcttttcccagcgcggggtctctccccaaggattttattccccctccccccctcttatggggtggtgggcaaactacttgttgtagggcccttgcttggaccgcgcgacctcgggggggagcccccaaatatttcttttattccccgcgtcccgccctttttgggagttgttaccccccccaagaaagcctttttggtttgggttttttgtggggaaatttttttaatccccagccaccctcgtgtggagacacacgaggaaatttcttgttaaaaagatactgtcccccgttcccacccgcattgggctatagaacgtttttcacctccaaaaagaccccctttgtttgggggagttcaccacactgtgcacactcactaagaccgagagccacggtgccctctgtcacttttatagtgtaaaatttggagattgaggaaaacgcctctcttgtgtttcccacgcgagaaatatttgggtcgcaccccactcgagaaagagaaggaataagtttttgttggtgtcccgcacagagagagcactcttcacttttagagtgtggagaaataatccctctccccgcagaagggataaccacctctgaagaaaccacctccgctttgttgtgttttataaaggccacccgagcctgttaaagttgctccctcaccccccacaggagaaaaatgagatgatcctcgccacaccttttaagaatttataaagtgattctttcgcccctgagtaaaataatatattttaaaaattatatagtttatataagtgtattaatattgtaaaaggccagtggttcaccaaaatagtgtccagtgttataattgtgtttagagttgttttgtgaatttttaaaggggtaaaataaacacataatatttttcttttatgggaatttattaaactttttgtagtataaaagttttcattttactgggtta

SEQ ID NO: 707535 - DNA, 414 bp, Homo sapiens
tatgcccggcctggtggcacggcccccggaattccagcagggctgaggcacccacagaatcgccttggaaccccggcacacaagaagggtgcaagtgagacccgaggggcacaccccctgcaactcctgcctgggccaaacgaatgggagctctgtttccaaaaaaaaaaaaaaaaaaaaaactacttctaattagctccatacttaatattttaacccagttgggttggtaacagtatatctttgcccactgctggccaattcttgttttgtcagcacttttccataactctggcccaagtgtcacctgatgtggccacgttttacagtcttgctattgtttcttgagtcccttaatctataagaagtatttttaaaatatataacatataaattttgtttcgttatagctcc

SEQ ID NO: 707536 - DNA, 564 bp, Homo sapiens
gtatacaagtaccagaagtatagaacaccaagcagatttaacccaaagaagactacctcaaggcatttaataatcaaactcccaaatggtcaaagataaatgaaaggactctaaaagcaacaggagaaaataaacaaataatatatagtggcgctccaaaatgtctgacagcagagagtggtatgacatacacaaagtgtggaaaaaaaaaaaaagatctcacctcttatactagtatagtatatccagcaaaaatatccttcatgcatggagatataaagactttcggagacaagcaaaagttgatatgtcatcaacaacagacctgtcctataagaaatgctaaagggataccttaagaaaaggacattaatgagcaataagaatcaattaaaaatacaaaactcactgatgatagtaaatatgcagagaaacgcaggatagtataacattataattgcgatgtttaaactactaatatcttgagtagaaagactaaaagacaaaccaatcaaaaataataactacagccaggcatagtggctcatgtctctaatcccagca

SEQ ID NO: 707537 - DNA, 942 bp, Homo sapiens
  misc_feature (7)..(8): n is a, c, g, or t
  misc_feature (37)..(38): n is a, c, g, or t
  misc_feature (41)..(41): n is a, c, g, or t
  misc_feature (43)..(43): n is a, c, g, or t
  misc_feature (48)..(48): n is a, c, g, or t
  misc_feature (68)..(68): n is a, c, g, or t
  misc_feature (433)..(433): n is a, c, g, or t
  misc_feature (589)..(589): n is a, c, g, or t
  misc_feature (601)..(601): n is a, c, g, or t
  misc_feature (612)..(612): n is a, c, g, or t
  misc_feature (614)..(614): n is a, c, g, or t
  misc_feature (617)..(617): n is a, c, g, or t
ttgccannagggctttagagccgcatttgaaaaaccnnctngnggctngaggtatccgcaggagcggncgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaaagcaagtcccgggactgcttcggatgcccttcagagagtggtgcgacgcctttctgtgtgatgctctctgggaaggctctcaaatccccagccntcatccagagtttggcagccgagtagggacttcctccccgttgtcctctacggaaggaagcgatggctatgggtcgtactcacctccgaggtactccggggtcttggggagttttctcccctaaaccatttcaactttttggggattctcgtcttngatgctcccccngtccttttccntngcnagttccttgttgacggttacagtttctggagtggattccgggcccattcttaacccaacctttatttaatccggttgataacagtgggcttccttttgtggaagaagcatggtcctgtaaggttgttagatcataaggcaggggttcaacaaaacactaagcaagaaaaagaacaacatttttggcgcggcgggcacagagagcataaatatgttgggggggcgcagagggaccagttgaggcgagacacggacgagggtgtgtacaaaaacgacggagcgggttaaacacgggtagagcgaggaacgcggaggcatcacggggg

SEQ ID NO: 707538 - DNA, 656 bp, Homo sapiens
  misc_feature (7)..(8): n is a, c, g, or t
  misc_feature (37)..(38): n is a, c, g, or t
  misc_feature (41)..(41): n is a, c, g, or t
  misc_feature (43)..(43): n is a, c, g, or t
  misc_feature (48)..(48): n is a, c, g, or t
  misc_feature (68)..(68): n is a, c, g, or t
  misc_feature (433)..(433): n is a, c, g, or t
ttgccannagggctttagagccgcatttgaaaaaccnnctngnggctngaggtatccgcaggagcggncgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaaagcaagtcccgggactgcttcggatgcccttcagagagtggtgcgacgcctttctgtgtgatgctctctgggaaggctctcaaatccccagccntcatccagagtttggcagccgagtagggacttcctccctgacttctactaaagtttccttctctaaccattttaatactttattggattctcgctcttgaatacctactctgttcattttacattgctaagtatcctggtgacagaatccagtctttcttgtatggaattccctgtcttaatcttttaatccctatctttaactttaatctcgttcgttaccc

SEQ ID NO: 707539 - DNA, 360 bp, Homo sapiens
cgttacgcctgtaatccccagcactttgggaggccgaggcaggcagatcacctgaggtcaggagttcgaggccagcctgaccaacatgatgaaacccgtctctactaaaaatacaaaagttagccgggcatggtggcaggcacctgtaaacccagatacttaggaggctgagccaggagaatagcttgaacccaggaggcggttgcagtgagctgagatcatgccattgcactccagcctgggcaacaagagcaaaactctgtctaaaaaaaaaagaaagaaaaagatgaaattatgtttttcacagagatacagcctactggaatcaccatgctggacagctggtaaggtacttagagt

SEQ ID NO: 707540 - DNA, 1048 bp, Homo sapiens
ggaggcctgcctgaggcgaccttcaggatgggactgtggctaccagtgttctctcgcgcgggtgtcgctgggctgtcggcctggaccttgcatgccgcaactggattcaacgttcgacaatatggcaactttgaggagatatcaccatggagactaaagtccatcaaagaacatccagaactcttaccaagtctatgaacacatggtagtcggcgagcaagacatatgcccgagctgatgagagagctgaaatccagctcgaattatatggatcgtggatcttgagctctgtatgaacacaagctgatatcaaggggggcctgactgacgagaagaagcaaccatccgttatgggtgtgtcctcagatcgaggactgtgtggtgctatgcattcctccatgtgctaatcagatgatacagcgaggttgcgtgactctaacagacagctggggaaagaagtccatgcttagtcgagaactcggtgagccaagagatcagagggcattactttgataggactcattgcgtgaccagatttctggtgagcattcgggagatagtgggcgaagacaaagtcccccatcttctggagatgcgtcagtcattgggcccttggggattaccgtacccttccggggcatcattggagtattgatagaaagggcctcccattacatctttgtacattaacagtgtcagggtctggtccgatcttcgctaattgaaggaccaggacaagacaaaagcccggattcttgttccccctgttaattaaccggtttggcaatgttgcctgggaccaggtccagtgaaggttgattcttactgcacgcgaattactgggaactggcctctgaacggtgggcctgagcgaacaaatttaacgccaagggaaattatccgaactcttggtgccaacgtggttccaatcctaactaaaatccactcctggaaaggggaagtccaacccacattggctggagcccacacagttgtgccccggattggaaccagccccaggggggacacaatgtgccagctcgcggaa

SEQ ID NO: 707541 - DNA, 627 bp, Homo sapiens
tggcgtctggtaccggtccggcagtattgggattgctccaagccattcacttccccaaatcttgtcgttgatgggtatgtgtttaaaacatgcacggtgaggccgggcgcagtggctcacgcctgtaatcccagcactttgggaggccaaggcgggtggatcatgaggtcaggagatcgagaccatcctggctaacaaggtgaaaccccgtctctaaaaatacaaaaaattagccgggcgcggtggcgggcacctgtagtcccagctactcgggaggctgaggcaggagaatggtgtgaacccgggaagcggaggttgcagtgagccgagattgcgccactgcagtccgcagtccggcctgggcgacagagcgagactccgtctcaaaaaaaaaaaaaaaaaaaaaaccagggcaagggggcatcaagcaagcccgggggcctcgggccaaggcaatgggaaggctgaggtgggaggagggatggagcctcgaggcaacttgaggcttgtagagaagctatgattatgccatgggattcccagcgggggcaacattagtaagaccccaatctctttaaacatgtgatttgggccattaaacaggtgccttaaggcatgttaatccaa

SEQ ID NO: 707542 - DNA, 1160 bp, Homo sapiens
gcacttgcttcacttgtcctcacaagtagaagattcttataacgcaagtgcagtccttttccacggctatggacagtctgcagaatgacgagagatcacctgtggaatgagctggagaactctcgaacacgtcagaggaagggaagcagaggtctgctagcgtcagccgttccaccagcccagcgtgaagtacagagtttaaccagaagcgtatgtcttacactgccaaaatgacacgagactagactactgcaggaattgaagaatctagcagcgagaaatacttacgagattactcacacgagatcactgagttacatccatctgaaggctcacagttcagcgagatagtcacagatacgacaagaatgcagttgtcacgagttatgcacaggaggagctcaggcaggaaaagctctcctggcaggcatgaagctgacattcgagcctccaggatatgagacgcacagacgtttccctaggggcacacgtacccagttgactacaggagacactgacaggaacgctacgaaaccctttaatagtgctgagtcattccgcgcactcagaaggacttccgccaagcgcaaccaaaatcactctagacagaggatacgtacattaaacgacgaaaactagagcacaagggacaatcaccaaaagcacgaacacggcagacaacatccagagagacctaccaccaaaaaaggataggagacaaaacgagcaacaagaaacaagtggggcaaaatccacccaaacaaagcccagctacagggatgaaccacaccaggaaaaagcgggaaacacaaagaagaaacagcgggggatcaagacatagaagaaccacacgaacaagaacaccacacaaagaggaaacccacacaggcaacaacaaaaatggaagacaaagcaatcaacaaaaggggaaaaaagtataccagaccaaaaaaacaagggcagacaagcacagagaaacatacacaaggcacacaccagacagcacacaggaaacaacaatacatacacatagcagaaacaaacgatggagcaaacaaagaaaacaaagacaaaaacacaacatggaccaaaacaacacaaggcgacacggcgagaaatcacccacgagcaacaacaagaccaggccgggcaagaagaac

SEQ ID NO: 707543 - DNA, 322 bp, Homo sapiens
atgtaacatagttgtctctgtccaagttcttctcatgataacaagactacctactccaactcttactgcctaacagtaaatccgggacattgactcccaagctcacattgtacaatctgtgttagaatttccctatttattagacacaggttgtgttagatatttatcgtgtgtattttaattcctttcataaaaacacaaaattaaaggcttggatactcagtcagagggttctttttactcgaccattcttttctttcttgagacagagtcacgctctgtcgtccaggctggagtgcggtggtgcgatctcgatgatcct

SEQ ID NO: 707544 - DNA, 526 bp, Homo sapiens
tggtagccactttcccatgcagctaccaaaccataactcacaggcccgggcagtggacacagcctttggaatggaagatgggtctgcaatgacttgggactgctggtatattggtagcatttgccaatttccatggtgtaaatagtcacatcatgactgatttcaaactaccaacattctgtcaacagtctccagaatttctgaaaatttaatgaacatctttgagaaccagtatggaccagctccagcataccactgcctagggcaaatgatgaaatggaacctctaccaaactgggaggcaggagttctgggtccaggaacagttttactggaactgaattcattgggtaatccctcatatttcctactctgggcctgagtttctccagctgtcaaaagatgaatatagtatttgctctgcctgcctcaaaggcattgggatgtcaagagccaatagcatggccaggcgtagtggctcaagactgtaattccagctctttgggaggctgaggcgggtggatcac

SEQ ID NO: 707545 - DNA, 915 bp, Homo sapiens
  misc_feature (415)..(415): n is a, c, g, or t
  misc_feature (513)..(513): n is a, c, g, or t
ctccagaggatcaggtgtccctttgtcttgtttcgtatttgagatggagtctcactgtctcacccaggctggagtgcagtggcatgatctcagctcactgcaacctctccctgacctggtttaagtgattctcctgtctcagcctcccaagtagctgggactacaggtgcgcaccaccatgcccggctaacttttaaaattttatgtggagatgaggtctccctatgttgcccagactggtcttgaactcctagcctcaagcagtccttcttccttggcctctcaaagtgttggaattacaggcatgagccatcctgcctggccttttacttattcttaaataaacttattccttgactaatctttacagaaagagatgttaacattaagtatgcctcttcactttggtctaaantttgtagtatctggcagctcttttttgtagtatattttgaggaagtggtgtccctttcctagattcatgctagacaaatttttctctctcttcttttntggagtgtgtgtatgtctgtgtgtgtgtgttttatttcattgggtttcagagacagaggttaaataattgtgcattcactgcttcatccttacaagaaaatatatgagctttaaattagataatgtatgtatagcacttagtatagtgcttggcacatagttagcatttaataaatggaagctttatggccaggcgcagtgactcattatctgtggtcccagcactttgggaggttgaggcgggtggatcacctgaagtcaggagtttgagaccagcctggcccacatggtgaaacctcatctctattaaaaatacaaaaattagctgggcgttggtggtgcgcaccttgatcccagctactcaggaggctgaggcaggagaattgttgaacccaggaggtg

SEQ ID NO: 707546 - DNA, 589 bp, Homo sapiens
ctgagcaatggagagataaaaactcagatggaggccaaagcatcatcttctttattgaagaaggcttaaaggaggcagtggcttagtgtgaagtcacatgggtctgtgctgggctgactttcccccttcccctagtatcacttgttttgggtaagtgaggccccacgcatcccggccagtggagtccgactcatagaagaaagcatcggaatgggaaatctgcccccctcctcacagttcataccccaggagcaaatgctaaatactgtcttgaattaacagagttactatgggttggccgggcacggtggctcatgcctctaatcccagcactttaggaggccgaggcgggtggatcatgaggtcaggagatcaagaccatcctggctaacacgctgaaaccccgtctccactaaaaaatacaaaaaacagctgggcatggtggcgggcgcctgtagtcccagccacttgggaggctgagacaggagaatggtgtgaacctgggaggcgggacttacagtaagctgagatcgtgccactgcgctccagcctgggtgacagagctaaactccgtctcaaaaaaaaaaaa

SEQ ID NO: 707547 - DNA, 938 bp, Homo sapiens
atatacaatataactgctctaatgctgctagtcgtagtctttaccacactaggtggttatgcctttattagcataaaacacaaaaaacttataacaggagctttacatattactgggatggggggtggttcgggatgggtgggcagctgctgaacccttagggcattacctctgtaatgtaggcgctttcaactgtactgctgcagacttttaacgtaccttaaagcttctcctgtgaacttcttagggaaatgtcaggttcagaactaaagtgtacgggtgggtctatgtagcgggggggagggtaacaatgggtggtcttccttgatattcatcttcacagaggttagtacacactcggagtacgtagaggaacttcatatacagtacttgatttggcaggttttcttctaccttgtgctctgccatggagctgttccactatgatatacaaacgcaagtgtagtattccattactatgtggctacagggcatcatatgtgataaaaactcaaccatgttagctgggacttagactccctacagttccttcaatggacacacgtaacatataaacaatcctatcgggtaattcaaaattacagattaaaacaggagcttacagaatcgggggtcacagcccactgcctccgtccatccccgacgccctaaaggtaaccccctggccccagtatcattccagcacagtaatcatgcaatatcaacggccccgtgcttacccaacaccgcgggtcctacaagaataccgggagagcgacaacggggggcaacaacagccaggaacccagcaccggcgcaaggcgaacgacccgcacacggggcgggcgctgcaccacacacaacccgaaacgcggacacacgaaggaacaagacacacgagcagaaggcacgaacaccacagtgacacgaccaacaca

SEQ ID NO: 707548 - DNA, 1015 bp, Homo sapiens
  misc_feature (1015)..(1015): n is a, c, g, or t
ggacgcgtgggcttcttttgtgttcccccccgaaacagagtctcgctctgtcacccaggtggaggtgcagtgagccaagatcgcaccactgcactccagcctgggcaaaaagagtgaaatcaccaccgcgccccccccccccaaaaaaaaatggccaggcatggtggtcacacctgtaatcccagactttgggaggcaaaggcaggtggatcacgaggtcaggggtgtcgagaccagcctgaccaacatggtgaaacccgttgtctctactaagaaatacaaaaattagccgggtgtggtggtgggcgcctgtaatcccaggtactcgggaggctgaagcaggagaattgcttgaacgcgggaggcggaggttgcattgaaagccaagatcgcgccattgcactccagcctgggcgaccagaggcgagactccgtctcaaaagaaaaaaagttctgatgttgaatatgtgtctccagggctttggggagatccaagttgttgttcctttcgtggagggtatggcttcacatatgggagagtgttggttttggaaatgagattcttacttctgttgtccatgcttgcaaaatttagatgttgagaggctataaagagtaaaaattgacatcagtgtctgaggtacagaagaatacgttttgcctgcgtgatattacaggggcataacgggtggtgattgaacaatgataaacatttgccggcacctaagttagcgttttccccggcattgcgggcgccacggggtggacccaggatcgggaattggaccacctgctatcaggaactctatccatatcaataaaaatccggggtggtgtggcatgtagcagcacatggggcggacaggtgcacccggggagcatcgacgcatcgctgcactggaaagactacacaaaacgggcaacacggcacaacacaagaggcagacaaacagagggacggaacgacatcactgctcacacgagatgctgcgagtcagacgtctcaactatgcgn

SEQ ID NO: 707549 - DNA, 108 bp, Homo sapiens
ggtccgccccgggctgccgccagccaagtgcaacttgaattgtctagagtatttttggagctttggaggttaccagacttgcgttttctgtgttgcaaaatccttcgc

SEQ ID NO: 707550 - DNA, 398 bp, Homo sapiens
ggtcggtcggtaccggtgttccttgtctggcataaacttaactgctccctgcgcataaacttaactgctccctgtagatacagaaactggtgcctctttttctgtcactgtgttgagcaggcagtctgttgtaatgacccccaaatcacagagacttagtaagtacttattcatgggccaggcgcagtggctcacgcctgtaatcccagcacttttggaggctgaggcaggtggatcacaagattaggagttcgagaacagcctgacccacatggtgaaaccccgtctttactaaaaatacaaaaattagccaggcctggtggcacgcgcctgtaatcccagttacacagaagactgaggcaggagaatcgcttgaacgcaggagacaaagggaaaca

SEQ ID NO: 707551 - DNA, 168 bp, Homo sapiens
tttctgtacagcatacttgatcataaccatgctcaagaaccacccaaccatcaagggttaaatgctttttgccttgctggataatgacttttaagtcagccaaaccatggtctgccgcaactaaggcacgttcaggctcagttgctaagtcttgcatgtgggcatcat

SEQ ID NO: 707552 - DNA, 117 bp, Homo sapiens
tgtggagtataaatagtcctactgcacaacatgagccagaatagataagcctttctacagcacaatcccccaaattcattgtacctcagagtgaatataccacacgaacggctcttg

SEQ ID NO: 707553 - DNA, 347 bp, Homo sapiens
tgtgcttgagcaggagttgtcctcctctgtgcagtcctgcgaatgggggccagccaggcccatactggaggggagaatctgttctcgagagcctgttggggtcgctgccagcctgtctcctctcgaggtctctccagttccccttctagaccaagggattttctcacgctccctgggataactgtccaagcaggcaggctgttctctggttccaactactttgccacaggatctctaaagaccgcccgaattggggctattgccagcggttagaagagaacccagggtccaagggcattgtgggcgagtccagagcacatccggtgttcgaagcgctggtaagcctt

SEQ ID NO: 707554 - DNA, 113 bp, Homo sapiens
acgtagtcggaccactttcagagtagtctaccgtacaaccctaacataaccattcttaatttaactatttatattatcctaactactaccgcattcctgctactctggaaagg

SEQ ID NO: 707555 - DNA, 729 bp, Homo sapiens
gaagaggagctggtgagaagactgacgataatggcgcctccggcccccggcccgtgactcgccggcggcgtccggtggtaggtgtagacgagctgtgcgacgtagaagaacgccttctacgatcgtgcaggctaccgagacatgtgcatagaacggaggcgcagctgggtgatagctatctaagacccacgtagacgagacggatggtgaagatggttgacgtcttcctgtatagagacgtagctggcgcagaggaaagtgcggtgtggtcctggatgatatcaagccctcctcggaccctgagctccagggcgtgcgcatgttggtgcgtgaactatcctcggcccatcggagaagatcaggaatgggagcatgcactggtgtgtccgaagctgtgcatcgcggatggagtatggacgcatgggagaccgttgtgacgtgagcaaacattcaacctattcctgtctcatggaccgcactgccatctatctccacgatcagaatccggatgccgacctgtcgtgcgctgcaccatgggtgtgactacgcctgtgaagttgcatcatgaccattgacagttgcggatccttgccttgagagcttggtagctgattggtagctcgcccggtaaggagctgcaagagaatgcgggaccggcgacgaggatgtcgagcctcagccagttcgtcactgcttggggtcagtcctgggcacgggtggtggagaagc

SEQ ID NO: 707556 - DNA, 366 bp, Homo sapiens
  misc_feature (366)..(366): n is a, c, g, or t
ggcacaaggcatgctgaattggcatatgacattacaataagtaaaccgtgttcgcatgtgcattttagatggcgtcaagctgtgccagccaggctggagctctatgggacaggatcagataactgcatcctcatgtgtagcaagttcaagcaaatctcctgcctgagctctccatgttgctgccattacaggtacctgcgacctcgcccatcaaactactgtgcttgcagtagatacagaggttcaccatcatggtgatgtaacgctccgctgagactgcagaccaagcgatccatagcatgttggactgacgcgctgggatcaccagagtgaacgaatgggcccggccgtacctagtcctctggn

SEQ ID NO: 707557 - DNA, 733 bp, Homo sapiens
agcggagtgtgcgataacacagtactacaacgaggtgcttacgtctcgttgggttgtctggctcctcgtcgctagcatcgcattgcttccttgaccaatgacgatggggtgcactctaaacagatgctccatgttattcttgtgggggtctgcagatgggcagatgttatggctacgctgagatccgaggggaaggagtaaggtggtgggcctttcaggttagcttgattgccaactccatggagtggttggacataggacggcgttgccgatcacactttctaagtgattattagtaacttcggagccgtagtctccaggacttgggattggggcccaaactcgtagggtagattgtatggacggatgaggactggtcttgagtcagccaagggaggatgtttgttacaagagttgagagcaggtaaacttgtctgtggtccactttcacctgattctagggcagtcccagtttcgtggtaagaactagttagaggtacaggctaagacccgagaagactttgggcaggggtggtgagcactctaggagggttcgtagcttcccgtgtatccccgtgcgctttttagtattcctccgtctaccgttgaagcttacagaagggtgaccaggctgtgtgtcaggatgtgaacgaacgctgtggtccatccaggcagggaaaaaacttactgagtatggagtgcatcagcccagagatcgtctaattggtaccaa

SEQ ID NO: 707558 - DNA, 231 bp, Homo sapiens
gtgaaatttgaggtgataatcaacttgacaaccttcaaggtacataacatttagatgagtaaatgtgttaaattttgtggaatggctttctgagctaaaataaattcaagtaagtttttttatttgagtgtatataacgtaataggacaatctgacttcccattcatcttagtaagtatgcatttagtagtctgcagtgtaattacagagacttggaaataaattaggtaa

SEQ ID NO: 707559 - DNA, 1434 bp, Homo sapiens
tcctggagtcctcgatggcgctggagagcgggaacgacaggcagtagctcgcgcggacgattgcaggcaggacatcaccaggagggcgaaggcgagccacggggaggggggccccgggacatttgcgcagcattggaggctgccaggggcttcggcctgctgtgtgtggccgtgtctccaccgagggcaccttgcgtgcccaggggttcctgcgttgccggatgatgtggccccacaagtgggacttgggttgaccgcctgatattgccccttcaagcggctcagcccccttggggcgcctgggcttttgggcacgagcaagtatcagggcattccaggggggaggtcaagggggcaattgggcggccgatggacccaggaactaaggggctgacgggcagagtgctcgtgtggccagggacgttggaagtagacgcatacttccagggggcaacggggcaagcagcactgggttgccgagcggcaaagcgcgccgcttggaagggcaggcccgctcaagagcggtgacgcactgtggccaggaaagccggcggagcaagggcgaacattgggggccactttcccagaaaaggcccccggatggtaccccgaagaggcgaccggtggtgcacccatttcgggaccggaggctcgggcggctagaaaccggcggaccgcccccggcggccatatccgagcggcttggcccatacaaaagggccggattctctgagggtggcccattggggggcaggcaaccggcaagtgtgccccgaggggggattcattccccgaagaccattggttcggagacaggggccactgtgctgcgccccccaaagcgctcagatggcctgtttggcccccagggattagggtgcgccagaaatgaacgcctgcccaaaagggggtctcccggggaattggggacccggttgtgaactcacggagcacgagggggaactcacttttggagcactttgcgggctccccggggagtatgtatgaaccagcagcccacgcggaatccacgagaaggcgaaaggcgggcaggacccgggcggcccctcttctgcccattggaataccacccgctttttaaacgcgagcttcgtggatgcacgccccattggcgtgcaaaccggacatgcgcgggcagtcctctcgctgcgcatattaaccgattccctttccaagggggtacagttccgcgagccaccttacgtggggattgggccccgatcattggggtctcctgcagaggacaccccgtagacaagtcttttgccaatgggagcattgcggctcctaaaccgccgaagatataaaggcgctttggaggcccatgtatggtctccccggaggcgacaaagcaaccatatttgacgctttgggaacattcgatattatggtggagcgatttcacacaacctg

SEQ ID NO: 707560 - DNA, 1000 bp, Homo sapiens
  misc_feature (21)..(21): n is a, c, g, or t
  misc_feature (63)..(63): n is a, c, g, or t
  misc_feature (78)..(78): n is a, c, g, or t
  misc_feature (113)..(113): n is a, c, g, or t
  misc_feature (134)..(134): n is a, c, g, or t
  misc_feature (152)..(152): n is a, c, g, or t
  misc_feature (178)..(178): n is a, c, g, or t
  misc_feature (182)..(182): n is a, c, g, or t
  misc_feature (206)..(206): n is a, c, g, or t
  misc_feature (244)..(244): n is a, c, g, or t
  misc_feature (290)..(290): n is a, c, g, or t
  misc_feature (402)..(402): n is a, c, g, or t
  misc_feature (404)..(404): n is a, c, g, or t
  misc_feature (424)..(424): n is a, c, g, or t
  misc_feature (429)..(429): n is a, c, g, or t
  misc_feature (441)..(441): n is a, c, g, or t
  misc_feature (460)..(460): n is a, c, g, or t
  misc_feature (465)..(465): n is a, c, g, or t
  misc_feature (472)..(472): n is a, c, g, or t
  misc_feature (476)..(476): n is a, c, g, or t
  misc_feature (480)..(480): n is a, c, g, or t
  misc_feature (482)..(484): n is a, c, g, or t
  misc_feature (492)..(492): n is a, c, g, or t
  misc_feature (495)..(495): n is a, c, g, or t
  misc_feature (498)..(498): n is a, c, g, or t
  misc_feature (500)..(501): n is a, c, g, or t
  misc_feature (510)..(510): n is a, c, g, or t
  misc_feature (522)..(523): n is a, c, g, or t
  misc_feature (530)..(531): n is a, c, g, or t
  misc_feature (536)..(537): n is a, c, g, or t
  misc_feature (546)..(546): n is a, c, g, or t
  misc_feature (549)..(550): n is a, c, g, or t
  misc_feature (553)..(553): n is a, c, g, or t
  misc_feature (555)..(555): n is a, c, g, or t
  misc_feature (558)..(558): n is a, c, g, or t
  misc_feature (562)..(563): n is a, c, g, or t
  misc_feature (573)..(573): n is a, c, g, or t
  misc_feature (580)..(580): n is a, c, g, or t
  misc_feature (586)..(586): n is a, c, g, or t
  misc_feature (597)..(597): n is a, c, g, or t
  misc_feature (605)..(605): n is a, c, g, or t
  misc_feature (616)..(616): n is a, c, g, or t
  misc_feature (623)..(623): n is a, c, g, or t
  misc_feature (625)..(625): n is a, c, g, or t
  misc_feature (629)..(630): n is a, c, g, or t
  misc_feature (634)..(634): n is a, c, g, or t
  misc_feature (640)..(640): n is a, c, g, or t
  misc_feature (642)..(642): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (668)..(668): n is a, c, g, or t
  misc_feature (671)..(672): n is a, c, g, or t
  misc_feature (675)..(675): n is a, c, g, or t
  misc_feature (677)..(678): n is a, c, g, or t
  misc_feature (680)..(680): n is a, c, g, or t
  misc_feature (683)..(683): n is a, c, g, or t
  misc_feature (690)..(692): n is a, c, g, or t
  misc_feature (694)..(694): n is a, c, g, or t
  misc_feature (700)..(701): n is a, c, g, or t
  misc_feature (759)..(759): n is a, c, g, or t
  misc_feature (769)..(769): n is a, c, g, or t
  misc_feature (776)..(776): n is a, c, g, or t
  misc_feature (780)..(780): n is a, c, g, or t
  misc_feature (787)..(787): n is a, c, g, or t
  misc_feature (792)..(792): n is a, c, g, or t
  misc_feature (797)..(797): n is a, c, g, or t
  misc_feature (799)..(799): n is a, c, g, or t
  misc_feature (809)..(809): n is a, c, g, or t
  misc_feature (812)..(812): n is a, c, g, or t
  misc_feature (814)..(814): n is a, c, g, or t
  misc_feature (822)..(822): n is a, c, g, or t
  misc_feature (824)..(824): n is a, c, g, or t
  misc_feature (836)..(837): n is a, c, g, or t
  misc_feature (842)..(842): n is a, c, g, or t
  misc_feature (844)..(845): n is a, c, g, or t
  misc_feature (847)..(847): n is a, c, g, or t
  misc_feature (859)..(859): n is a, c, g, or t
  misc_feature (861)..(861): n is a, c, g, or t
  misc_feature (863)..(864): n is a, c, g, or t
  misc_feature (980)..(980): n is a, c, g, or t
ggcactcaaccctggttgcgngggctacgtacgttcagtgcggaggtgacctggctcctcgangaggttacagcctcntcacccaggggcccgttactttgctctgtccagtntgtgcatcccacaaggtgccnacagtaatgacagtgcgnactggactgagtaccaggaccccagnactngcagcagtaagatcttccctggcnactgggacaaccactcccacaagaagaacttgtttganacgcccatcctggctcgctatgtgcgcatcctgcctgtagcctggnacaaccgcatcgccctgcgcctggagctgctgggctgttagtggccacctgccacccccaggtcttcctgctttccatgggcccgctgcctcttggcttctcagcccctttnantcaccatagggctggggacnggggnaggggagggtgntcagaggcagcaccaccanacagncaccccncccncccncnnncccacccnccnccncnnacgggcccngccccagccccnnagccccnnccccnnacccccagnccnnacngnccngttnnctaaggcacngaggganctgagnaggtctggganggacaggnaagggcaaagnagggcgngnggtnncccngccccngnccggaccnccgancccaggngcgtgngtnnctntnncnccnagccccnnncncacacnncacattcccatggtggcctcaagaaaggcccggaagcgccaggctggagataacagcntctcgcccgncggcccngcgncggcccnggggnaccangnggccacaacngcngnggcccccngnccccaagacacnnccccntnncnccctggttgccncncnngccccttgtcctgaagcccagcgacacagaagggggtggggcgggtctatggggagaaagggagcgaggtcagaggagggcatgggttggcagggtgggcgtttggggccctctangctggcttttcaccccagag

SEQ ID NO: 707561 - DNA, 153 bp, Homo sapiens
ttcaccatccaaaagagttaagtccatctctcccagaaattggccttaaatagagacagacgactctagattatcacggatgtgactagaaagaacttcaaggtttactggcttcacattcccactttcaaacggtccccacagagagagcgt

SEQ ID NO: 707562 - DNA, 1954 bp, Homo sapiens
  misc_feature (21)..(21): n is a, c, g, or t
  misc_feature (63)..(63): n is a, c, g, or t
  misc_feature (78)..(78): n is a, c, g, or t
  misc_feature (113)..(113): n is a, c, g, or t
  misc_feature (134)..(134): n is a, c, g, or t
  misc_feature (152)..(152): n is a, c, g, or t
  misc_feature (178)..(178): n is a, c, g, or t
  misc_feature (182)..(182): n is a, c, g, or t
  misc_feature (206)..(206): n is a, c, g, or t
  misc_feature (244)..(244): n is a, c, g, or t
  misc_feature (290)..(290): n is a, c, g, or t
  misc_feature (402)..(402): n is a, c, g, or t
  misc_feature (404)..(404): n is a, c, g, or t
  misc_feature (424)..(424): n is a, c, g, or t
  misc_feature (429)..(429): n is a, c, g, or t
  misc_feature (441)..(441): n is a, c, g, or t
  misc_feature (460)..(460): n is a, c, g, or t
  misc_feature (465)..(465): n is a, c, g, or t
  misc_feature (472)..(472): n is a, c, g, or t
  misc_feature (476)..(476): n is a, c, g, or t
  misc_feature (480)..(480): n is a, c, g, or t
  misc_feature (482)..(484): n is a, c, g, or t
  misc_feature (492)..(492): n is a, c, g, or t
  misc_feature (495)..(495): n is a, c, g, or t
  misc_feature (498)..(498): n is a, c, g, or t
  misc_feature (500)..(501): n is a, c, g, or t
  misc_feature (510)..(510): n is a, c, g, or t
  misc_feature (522)..(523): n is a, c, g, or t
  misc_feature (530)..(531): n is a, c, g, or t
  misc_feature (536)..(537): n is a, c, g, or t
  misc_feature (546)..(546): n is a, c, g, or t
  misc_feature (549)..(550): n is a, c, g, or t
  misc_feature (553)..(553): n is a, c, g, or t
  misc_feature (555)..(555): n is a, c, g, or t
  misc_feature (558)..(558): n is a, c, g, or t
  misc_feature (562)..(563): n is a, c, g, or t
  misc_feature (573)..(573): n is a, c, g, or t
  misc_feature (580)..(580): n is a, c, g, or t
  misc_feature (586)..(586): n is a, c, g, or t
  misc_feature (597)..(597): n is a, c, g, or t
  misc_feature (605)..(605): n is a, c, g, or t
  misc_feature (616)..(616): n is a, c, g, or t
  misc_feature (623)..(623): n is a, c, g, or t
  misc_feature (625)..(625): n is a, c, g, or t
  misc_feature (629)..(630): n is a, c, g, or t
  misc_feature (634)..(634): n is a, c, g, or t
  misc_feature (640)..(640): n is a, c, g, or t
  misc_feature (642)..(642): n is a, c, g, or t
  misc_feature (650)..(650): n is a, c, g, or t
  misc_feature (655)..(655): n is a, c, g, or t
  misc_feature (662)..(662): n is a, c, g, or t
  misc_feature (668)..(668): n is a, c, g, or t
  misc_feature (671)..(672): n is a, c, g, or t
  misc_feature (675)..(675): n is a, c, g, or t
  misc_feature (677)..(678): n is a, c, g, or t
  misc_feature (680)..(680): n is a, c, g, or t
  misc_feature (683)..(683): n is a, c, g, or t
  misc_feature (690)..(692): n is a, c, g, or t
  misc_feature (694)..(694): n is a, c, g, or t
  misc_feature (700)..(701): n is a, c, g, or t
  misc_feature (759)..(759): n is a, c, g, or t
ggcactcaaccctggttgcgngggctacgtacgttcagtgcggaggtgacctggctcctcgangaggttacagcctcntcacccaggggcccgttactttgctctgtccagtntgtgcatcccacaaggtgccnacagtaatgacagtgcgnactggactgagtaccaggaccccagnactngcagcagtaagatcttccctggcnactgggacaaccactcccacaagaagaacttgtttganacgcccatcctggctcgctatgtgcgcatcctgcctgtagcctggnacaaccgcatcgccctgcgcctggagctgctgggctgttagtggccacctgccacccccaggtcttcctgctttccatgggcccgctgcctcttggcttctcagcccctttnantcaccatagggctggggacnggggnaggggagggtgntcagaggcagcaccaccanacagncaccccncccncccncnnncccacccnccnccncnnacgggcccngccccagccccnnagccccnnccccnnacccccagnccnnacngnccngttnnctaaggcacngaggganctgagnaggtctggganggacaggnaagggcaaagnagggcgngnggtnncccngccccngnccggaccnccgancccaggngcgtgngtnnctntnncnccnagccccnnncncacacnncacattcccatggtggcctcaagaaaggcccggaagcgccaggctggagataacagcntctcgccctctttcccagcgtccagcctctgcacgtgagcccggtggccagaacctgaatgtgcgcgctccctgtacaccccacacgaagtacctttcacctcgtttgctcgttcctgtgttatggctcttgcttggcactctgtgttcctgtacatggcgcgcatggacagcggaagggggtggtggcgggggttcgtagtgtgaggaccatagaaggcgcatgctgacgggtacacgagcggaagtgcgccatgggtgtcgtgagtggttcgtggcgttctcgcgtgagccctctactgtctagcgactattataaaactctcccacaatgggatcgcacggcaagagaatcaccagacacagtagtacttctgtactcatttccgttgcaacgaggagaaagaagaccatcatatgcacacagaaaagaaccatagacaattcgagcaccatgaaaagatacacaaaaggtgagaacaacaaaacaagacatagtagagaaccaacataagtaacgcgcgagaggagcaccgtatacaccacatttgatatctacctacaatggagattaggccattctatcaattagaaaaccaatatgaattacactggaaaatgcgataaaagaagaaaaaacgaagaaatcaggagacgaatagagggcaggaagatcttaattgaaggaaaggaaaatagggggaagacgaaagaggacaaaaaagaggacgaggagcaataggaaagataagagacaaggagaatagagagcgataaatgggagggtcagcctaataatagagtgaagaatataataaaaacaccaagaagaaaaaacaaaggagcaataatttgtgagaaaaatagtagtctaaattaaaaaaattatcaagaggtaaaaagaaaagaagaaagaagaatgaacaatataataaataagatagaaaaaggaggagaacataagaaaagaaatataataatagctttcgaatagcgaggagaaaaaaattatagagacagaaagggagatattaaactataagcaaaataatatatctcaggcacgtgagaagaaaaaaaacaatagttagcgaaggaaacgagcgaagtacttataaagaagaaaggatcataaacgacaacgaagaggttagtgcgaagataaggagggtaaaataaattaggagtatacggac

SEQ ID NO: 707563 - DNA, 859 bp, Homo sapiens
  misc_feature (28)..(28): n is a, c, g, or t
  misc_feature (103)..(103): n is a, c, g, or t
  misc_feature (105)..(105): n is a, c, g, or t
  misc_feature (109)..(109): n is a, c, g, or t
  misc_feature (177)..(177): n is a, c, g, or t
  misc_feature (188)..(188): n is a, c, g, or t
  misc_feature (198)..(198): n is a, c, g, or t
  misc_feature (224)..(224): n is a, c, g, or t
  misc_feature (397)..(397): n is a, c, g, or t
  misc_feature (607)..(607): n is a, c, g, or t
  misc_feature (616)..(616): n is a, c, g, or t
  misc_feature (664)..(664): n is a, c, g, or t
  misc_feature (684)..(684): n is a, c, g, or t
  misc_feature (701)..(701): n is a, c, g, or t
  misc_feature (704)..(704): n is a, c, g, or t
  misc_feature (754)..(754): n is a, c, g, or t
ggatccgcggcgctgcccggggcggggnaaggaagcagccgaggagacgcacgtgcccggagtccgggagcggggagcctcttcatctctccatcctccctcngngcgngccctcagccgtcctcgtccgctcaccatgcacctcccctccaagaaagggccacatgcgtgccaggnacgcgagcccnggccacaggnacatagcagcctagaaggtgagtcangcgttaaaccacatgggtactcaccggggaaatgagataaatgccaagaagtgagagtttcataacatcgtatgggggagacggtaggacctgaacccggggagaccagaggtttctgggggcgattcacatgtagccaagatgtgaaggccctataagagtaaacaaggtanggagggaagaattttccaggcaggccaacagcaggttccaacagcagggccaacagaggtcccaaggcaggaacggtcttgcagcaggggaactggaggaggctcagctcagcatggtagagggctagtggtgcagcggagctgtggtgtgagaggggccaggtcatgcagaggccgatagagcacagcgaagacctcggtctttattcngggagacangggaagtcctcggaggaagttaagctgataagagacatcatgaagttngggccaggcgcagtggccangcctgtaatcataacanttngggaggctgacatgggaggatcgcctaagccaggagttcgagaccagccnggtcagcatagttgagaccccccgccccccgcccgccatccgctaaataaataaataagacataatgaagttttgaattgtaatgagatcactctggctgctgta

SEQ ID NO: 707564 - DNA, 404 bp, Homo sapiens
  misc_feature (186)..(186): n is a, c, g, or t
gccagtacggatgtggcatcatgttgcggctacagctctaccgaacagccatgatgggctggggggtccgcgcctctgcagaccatcccatcagggtgaccttcatctgcgagtatgtcgggtagctgatctctgatgctgaggctgatgtgagataggatgattcttacctcttcgactttgacnacaaggattgagaggtgtactgcatagatgcccgttacatatggctacatcagccgcttcatctaccacctgtgtgacccctacatcattcccgtccgggttcttcatgctgcaccatgacctgcgatttccacgcatcgccttcttcagttcccgagacctccggtctggggaggagctagggtttgactatcgcgaccgcttctgggtcatcgtac

SEQ ID NO: 707565 - DNA, 216 bp, Homo sapiens
cgatcattggttcacatctctgctgccgcaaccgcttcctcctgaacgctgtaaaagctgtccaaaaatgtcacagtcctttcgaaatttgcattctcagaaatatgtgactgtctgtcctccctccctctcgtgtgtccccaccagtccagtcggcgggatggaccagggagtgatcatgtcacggaatggcactaaaaatgcatttaattggca

SEQ ID NO: 707566 - DNA, 604 bp, Homo sapiens
  misc_feature (463)..(463): n is a, c, g, or t
  misc_feature (478)..(478): n is a, c, g, or t
  misc_feature (587)..(587): n is a, c, g, or t
  misc_feature (604)..(604): n is a, c, g, or t
ctctgcatatttcctggtgattattcctggatatactgcatttttgtagttgtgaattatagtacaagagaaaagcagtacctgacattcagatggagcatttttatatacaaccatgggaggggcagagagccatccagagtcacagccattgtatattgaatctgtcaatactgagcaaataaaacaaaagcattctgcataattctgttgatttttttttgtcataggaaagaagaaaagagtttgaaactaatctcagacaggtcttgagttggaaatagaagactttctcctactctggcctttgcctggatagactctgtgtttgggggcaatacaatagctcttttggctacagatatgtgcaccgggatgatagggcctgtggtcttacaggtaagtagatgagtactgtgaatatgcagtaataaatggaacactttataaattgacacagttngcattcaggattcanagagaaagaagattgtggacttttatcataacagtttcattttgaagtctgcctataatctggtacccttaattaaccaggctgtcttgcagcataacctgctgttaangccgacttctttctgtn

SEQ ID NO: 707567 - DNA, 347 bp, Homo sapiens
tttccattgttcaggcgggtgactgtggctctgctggtggggctgctgaggctcttgttttatgtgacttcttcgctcctggcccatttgagcacaccgccggttagcgggggcaggcctcctagggagaggagggtggatggcattcagggtgttagtcatgttagcttgtttccggtgcgagatacgtagtacgggtcgtggtgctggagtttaacgttgacgtagtaggaatgcggatagtagttaggactacctactatctagttaacattacgaatggttatgtaagggttgtacgagaagaccctgctattatacatcctatgtgggtaattgacggcgta

SEQ ID NO: 707568 - DNA, 285 bp, Homo sapiens
ggccatgctcctctgcaccggacttgttagagccgtcttgaggagtctgcttctccgtcacccgacatgtgagggacgtcttataggggtctgatcctccgcacccgacgtgctggagccgtctttgggggtctggcctccatctttctctcatgctgaatgcttcctgcccgtcaaacattggactccaagttcttcagctttgggacttgaattggcttccttgcttgcagatgacctattgtgggacctaaccctgtgatcaatgtgagtcaatactcctta

SEQ ID NO: 707569 - DNA, 224 bp, Homo sapiens
  misc_feature (190)..(190): n is a, c, g, or t
tgcaaacattgatagactgatgatcagactctagaggtatcccccacaagagacgagatgctagggaaagggaagagagtggctcagcctgcaggttaataggctacaaaagccaaggccaagaggctggcaggggagaggacagctcaccatgctccagcctgtgggtcttgggtgtaccggttatccncttctgccctgttgccatctcccatcctcgtctc

SEQ ID NO: 707570 - DNA, 713 bp, Homo sapiens
ggtgatcgaacagcatggcgtcggtggtgtggcgctgaggacccggagcagccgtgacatccttgctaagccccattccgggtacagctctctgctggtcagatacgcatccaagatagtcgggtggtagctccaaaaacctcggtggaagagtcatcaggcagacgccaaggctattaagaaaatggaaggtcatctatgtgtcatgctgggaacatcatgtgcaacacagcgccatttcctggtggtcacccaggtgcccatgtggggtgttgggaagaataaatgtctgtatgccctggaaagaggggcatagtccggtacactaaggaggtctacgtgcctcatcccgagaaacacggaggctgtggatctggatcaccaggctgccaaggtgtgcttgtgctgctacaagactttggtccacgtggttcctgccaatgccctgagggcgcccttcaaactggtagctatgtctttgatgtcctgtcgaggccatcgcacagagactggagtcccagtgtgaacaggacgatggctgactaccatgaagtcacgggtcgggggtggcgacatgggcctcccgaggaaaagggtctgttggatgggtgacctctgcaggagacctctgaaggtgcctgctgggaaaccctttgggagaactgacctgggggccaaaaataaaggtgaggcgggtcatggacggcattgga

SEQ ID NO: 707571 - DNA, 203 bp, Homo sapiens
agagaattgcttgaacccgggagctgaggttgcaatgggctgagatcgcgccactgcactccagcctgggtgacagagtgagactcatctcaaaaaaagacccagcaaataataggtgctcactaaaattggttggatgcctgaatgactattccattgtttcggaaggtaagtgcactaggccacttgcaacatctttctcc

SEQ ID NO: 707572 - DNA, 298 bp, Homo sapiens
cccgactagcccgacagtgcaaaggtgaagaactgaggatttacatactaaaacagaaacagggcagtcattatttaatttttaaaactctcatttaaatttgcaatgttttagccgggcgtggtggctcaagcctgtaatcccagcacttggggaggctggggcgggccgatcccctgaggttaggagttcgagaccagcctggccaacatggtgaaaatacaaaaattagctgggcgtggtgtaagaatccaggagccgcagggttttccttggagtgctgtcgggctagtcgggg

SEQ ID NO: 707573 - DNA, 185 bp, Homo sapiens
aaggctagaagacttagtagcttcagaagcagaagaggaagcagcaaaagaagattctgaagcagaggaagaagcagcagaagaggattctgaagcagaagaggaggcagcagaagaggattcagaagcagaagaagaagcagctgaagaggattcagaagcagaagaagaagcagctgaagaag

SEQ ID NO: 707574 - DNA, 252 bp, Homo sapiens
  misc_feature (168)..(168): n is a, c, g, or t
  misc_feature (252)..(252): n is a, c, g, or t
tgtgctgcggttcgcctctacgacggactccccacgcagacgttctgggaggccccagacggactccccaggttgtctgggtcttccacccgtcccacgccctctcgggttacgactcactacgacacaccggttctggactatacacatgactgggggtcacctccngttggtccacctgtggcgggacgcggggggtctcccgtgacctgacgcccaaaggggttacccgacgctcgacatttcgtaatn

SEQ ID NO: 707575 - DNA, 660 bp, Homo sapiens
aggagctgtactgataacttcactactgtatgcgatgcgttacttcactctgtttcatagaatttatagacaggtcttctagaatccataaagatagaatgtaaaagattgtgtttctgttctgaatcttccaaagccatctgcacagtgctagcatggtgactcagtgtcctccaagagtcatagtcagtacgagagggcagcaaatgactggtattttctatccaagcctcagtgctcttcagaaggtcactatattcctccatcttaactgtggccttattcaactgtgaggttctacactctgctctctgtgatacttgctgatactgctggaaaggaatcatcaagttatccatccattcttgagcctgtcctgggtcctgttcaacaatgtcctgaacttcagaatccagctcatttagtttggaatgccatagatctaactcgtcccacattttcttttgaatttcttgagctttctcaatatttctgcttttctgctgcaacatcttttcaacattatgaagcccattgttaatttcttctatttttctcctcattgcatatgatggtgagctttttaagacttcattgctaatcttctcatctatgtcttctaaagcttttctggattcttccacctgggattccatctct

SEQ ID NO: 707576 - DNA, 1182 bp, Homo sapiens
  misc_feature (184)..(184): n is a, c, g, or t
  misc_feature (927)..(927): n is a, c, g, or t
  misc_feature (972)..(972): n is a, c, g, or t
gaatgttgcactgtggtgtgtgccctgggcccatgttagtaaagatttctccaggttggaaggagcccgggtgggcccttgacggagcagaactgggcattgtttccttttggagttggtagagttcttctctctggtcctaatcctggtggatgtctgctcgcctgtagctcccaaagattgngtcaggttatttcacttctgcagtaaaaactgggcaaaaaccattcactccatgatattaccgaattatttgtttcacaggtgttcggaaagggcagtgcttcacccaaaggaacgttcgattatgttcatctagtatgccaaagctagcctcgattagcttagctggttactttgttagatcttaaatacacaggccagtcagttagcaccgaaagcctatagtctaggaatcacactgatttgctttgtgtgtttgagatatacatagccttttaactttcccttctgtgggagacaggaaaagccagagggtttgtcctctggaggctccctttactgtggggtgggttccatttcagcatgtaggcttgcaaatggaatatttgatgatgcaaacttacctggccagagatgaataggcatttctgaactcacatcagataaaactagccttgatgtgaggatggatggggtatctcacagcatcaatttacaagccataaggtgagcagtgtttttgctaaggaggggctgcagcaatgctgatcttccatctgattaaatgacactgggggtggtgggttggcttcccttcagcttcaaatgggtgctgttggccatccgttgtcttgcgccatcccaacatgtgtgtattcacttccttctctgccacctgtttcttatgtggacattttatccccttgagaggtagatcacatctccctgccagagatggagatnccagagtcctgggtccagtgcccacagcagccctgactcattgtngggcttctctgtccctaaacacccaagtttctctatttgtaaatagcgcatgttggcagacttaattgatgtttgtaagatgtttctagggttcctggattaatggtggcaatgtatccaagaagtgattgaaaaggttggcaactgcttagtgagagattgaaaccttgagctctctttttttccggacgagtcagtctctgcacttca

SEQ ID NO: 707577 - DNA, 1097 bp, Homo sapiens
  misc_feature (141)..(141): n is a, c, g, or t
ttggaggaatgcatgctcgcatcggagagggcggcaggctagctgtctgggagacggctatcacggatcgggcacgtgcctgcggggtcgcagtctctgtggctgctaggcccggatcggtaaccgatacggcgcaggagngtccacgctgctgctgtgtcgtcgtgtgccccagctagaatggatagggaacgccgggcagtggcgggttgtaaggctccgatgatgtggagttgcctacggttacatagtgatactacctagagtggagcacgtgtgacaagaatgtgtcgtgagaacgggaatctggggcctcgcttagttgacgacgatcatagtcattgagaattcagagatgatgctttgaactaagatatgcgtgacatagagggtaccgccaccctgtagaaggactagctggacaacgtctaggaagggcacctgttagtgaggccccttgttctgtgcagtgattcatccacactaaattgaattggaatgtgaccactgattggacacacgcgcggttacttgggccctagtcaacctttctcccttttttaaaagaacctttatgcgtagcaacgtggggtgctccttttgggtcaccgtccattgtctgggaacccaggctattcgacttacgacgaacagtttccttaaaaccaagctacttctcattcatttgcacacgtttcctaccattttgtcaattcaagacaaagaacggttactaaattatttccccttgagcttgggacgtccatagtttaaccaataacccccaaggggcgttccaatacagtgatctgcgccggagttatgagacatacgtccaaggcacctttctggacggatacaaccaattgaacggctttgcccttcgacgcgggtgggacataaccccaaggggttaaccaaggaaagacccgcgcctcggttctccgttgacgttttcatttccacaacactgcgaacaaacccgacggaacagcgcaacacgcactcccctccggcacttttgtccacgcatattgagcgttggcaaccaaatcagtatgcgaccatgtgttgcacattaacagcgcgcggtaccc

SEQ ID NO: 707578 - DNA, 121 bp, Homo sapiens
ccgcgagcgctacatgtctgactcgcgcttgggctgtccactactatgcgataagttacctgggtgaccgtgaccagcctgtcacaccaggccatgcggcgtattttctctttatactata

SEQ ID NO: 707579 - DNA, 160 bp, Homo sapiens
aaaagaattttgggggttttccctttggcttccctgggccttttatcccctccctggcctacccgaagatttatacccttttgaggctccagggagacggtggttttcccccttcctcctcctagccttttttcccaaaaggtaaacccaatggtggaga

SEQ ID NO: 707580 - DNA, 418 bp, Homo sapiens
tgggtcgactggggcctggattcggccagtttctgctctgcatccaaagatggtccgaagcattgtcacttcagtaacatcaagatgctcaatgacatgggacccgtgcagtggtacttaagtattcaaaatatacaagtacagattctctgacagaacccgaggacggggtcttcatcttcattcaccccagaggtgagagtgcgaggggagaacagcatcgtcagtggtgatatccaaaccaaggcctttggtgagcggggtggggtggggggggtttgctgttaatggaattggaattgtaagatgtgggcattgtgttgtgatgtgaactgagagtaatggcattgccgggcctgtgacctaaagtgaggctcgtaacgagcatggatctgactagacatgtcctcattacatg

SEQ ID NO: 707581 - DNA, 180 bp, Homo sapiens
gtcatgctcggtacctattctactgtgtagcttagttttaaagacaactttgaagtaaacaatgaaataaaagatgtacactaaaacctctagaagctcctagagtacacatactacgcgggatacctactaagagtacgacctagcaggcatagcaatgctataggcactagtgccgta

SEQ ID NO: 707582 - DNA, 220 bp, Homo sapiens
  misc_feature (73)..(73): n is a, c, g, or t
gatttatgctttatctcaaaggaatagagcattcttggaagataggggtctgtgtaggctgaatatatatgangcacttatggattaggtgctgacttttgaacctttgggtttaaaggggctaggccttaggtttgagctttgttaaattgggataagggtttgccctttccttaaatgtgtgccaggattagagccatttgtggaggttcccccccta

SEQ ID NO: 707583 - DNA, 98 bp, Homo sapiens
tctatgaatcatcattaagaactctgggagaacttttgaattcataaccaagccaacatctccagacatgtgagggtaggggaaagtgattcaaattg

SEQ ID NO: 707584 - DNA, 144 bp, Homo sapiens
gagtagatagagaaaggagctcagatcgtaataaggatcgcagtcgactcaagagaaaaaagcagagatcgtggaagggaacgagagcgggaaagagagagagagagagaacgagagcgagaacgaaaacggcatcttcatcgg

SEQ ID NO: 707585 - DNA, 103 bp, Homo sapiens
cgttaaaaccattacacactatcttggggaaaaggtcagaaagacctcctgactccatgttacagtagacaaaacaagttggactcttttggacctataaacc

SEQ ID NO: 707586 - DNA, 596 bp, Homo sapiens
cgtctcctccccagccaccatcgtcatatgctccgggccgaactgtgtggcccctgcctgtgccagccatgggctcgggatggactccctgggcccccacacccattgcgccagcccggaaggccagctttcgcttgttcctgcctcgggacaggccccgggtttcccccagcatcctgagtgtgtcccctctccccaccttcagaggccacccacctcagcaccaccggcctggccttgcctgcagactattaactataacccctagctcgacacccgtctgccgtccacggcgtctggaaccgcctcccggctcggggaggcccccgggctgggaacgcctgtgccctcctgcgccgaagcccacgccccctctgtccttccctggccctgctgccgaccccggaggctgccccgcctgtgggcggtcggccttccctccttcgctccttttttatattagtgattttaaaggggactcttcagggacttgtgtactggttatgggggtcccgaggcacctaggcttggggtggggaggtcccctgttccatatagaggaacccccaattattaaaggccccccatctggacca

SEQ ID NO: 707587 - DNA, 320 bp, Homo sapiens
  misc_feature (56)..(56): n is a, c, g, or t
  misc_feature (60)..(60): n is a, c, g, or t
  misc_feature (62)..(63): n is a, c, g, or t
  misc_feature (65)..(69): n is a, c, g, or t
  misc_feature (71)..(72): n is a, c, g, or t
  misc_feature (74)..(74): n is a, c, g, or t
  misc_feature (77)..(77): n is a, c, g, or t
  misc_feature (80)..(81): n is a, c, g, or t
  misc_feature (83)..(83): n is a, c, g, or t
  misc_feature (85)..(86): n is a, c, g, or t
  misc_feature (96)..(97): n is a, c, g, or t
  misc_feature (304)..(304): n is a, c, g, or t
  misc_feature (315)..(315): n is a, c, g, or t
tgacaatccaatcctgaaccacagaggcttgaagcgcgggtgacaatcgtgacaanccantnntnnnnnanngnggnttnntntnngtacgttgtnncgattgtcaccgttgtcacgattgtcaccggtgacaatcgtgacaatccaatcctgaaccacagaggcttgaagtagcagtaggttgtcacgattgtcaccacaatcgtgacaatccaatcctgaaccacagaggcttgaagtagcagtaggttgtcacgattgtcaccgttgtcacgattgtcaccggggatcctctaggggcgtnccaaaaagctnacgac

SEQ ID NO: 707588 - DNA, 119 bp, Homo sapiens
cgcggacgtcacgccatgtcacgactcttaatctttccaaacagaaagtgtgtacccattaaacagtaactccccatttcccagtcctttcagtctctgctaatcttttttttgttggg

SEQ ID NO: 707589 - DNA, 713 bp, Homo sapiens
cctggtgcacatttggggagtcacaagttggtgtcaacatgggccctctcttttgcctgggcctgcccagcacccaggcctccatgcctccatgcctccaggccaccaagcattgcccctttggcctttgaatttcaaatctaaggctagaaaggcatgcggagagccttcgggggcgctccaaacgccctctccccagcgcccctctttccggaccagacagccattgccccggggtgtgtttgctggaatggttttgacataccgtgaccacccacagcatggcccagagacttagcgtccctactgccgctctccgacatcctccagtggaggaggaacttcggtccctctggtgtcttgcccatccccctcccgtcccatgggcccggccctggacaccctcaggtgcctgtcccccagcccccaacaccccactcctatgcccccgtctgtcctctcccagaccaaatggaaccaacgctgcgcttctcgaagcgccccgcttgcgcgtgtaatggttcagcgtaatcccatggcgaaatgggggctcactccgccgaggaggactccggcagcagggccttcctgacccacagccagcttctgtccttcccccccggaaacacaagttcatttgtgtgatcatgtatagacctcagacggaagataggactgtaaataattgtaataaatacccgttgccactaatt

SEQ ID NO: 707590 - DNA, 263 bp, Homo sapiens
  misc_feature (247)..(247): n is a, c, g, or t
  misc_feature (258)..(258): n is a, c, g, or t
aggatccccaatcgtgacacccccagtagtttgtgatgggtggttgggtgggttgtcacgattgtcaccggtgacaatcgtgacaatccaatcctgaaccacagaggcttgaagtagcagtaggttgtcacgattgtcaccacaatcgtgacaatccaatcctgaaccacagaggcttgaagtagcagtaggttgtcacgattgtcaccgttgtcacgattgtcaccggggatcctctaggggcgtnccaaaaagctnacgac

SEQ ID NO: 707591 - DNA, 965 bp, Homo sapiens
ttgcgcgcgccccatatttaagagggggcgcgaagaaaatttgcgggccggggaggatattttcttgcgtggtgggggggaaagacaagatgtgtttcggtgtcggagaggaattatattgccgcgggacccacctcacctgcatgtgtggagcagtccagacggctatcacgacgggatggtggtcgtaacagtgactgggatgctccttcccgccgcgaggtgtaatcggcattgtggcccggttcaagccaactggagtggctgtcgttacttcgatgctagtgcgcgcgacgccaaaaatctgttcggccgtgtgcgcgtgcgcgcgcgaccactgtttgttgcgtgcgtagtgcggccgccaccctgccggttatttaagcaaaacgcacggattggctcctgcgggggaggtgttagaacgaattgcataagggccaatgtcattgtccgccgtgtgagtatcgtaccacaccaccacgtgccttcatctcattgggcagttgaccacgccgtgcaggtagtagggcgaccactcgccctctctggttatgttgtactagataaagccgtcctgccgcacgcgcgaggatataacaattgtgtttgtaggacgcctcgctctcgtcttgctcccactcgctcctcgtaaataaaagaaaggagggctctacgtaattcctttagttcaagacatattggagtgggccgcccctagcttcctcgggtattcaaggggtgtgtccggcactgatggcgttagtttctttcaacccgacaaaagactacaggctggggtgcgtctcgtcagaacaaagtcaacaattgttgcgtcgcatgttcatgtcgttggccccctcagttgagtaacaacacctccctctctggccctccgccctcatacagaaataaaccacagaccaaaaaacaaataaagaaaaacaaaacaaacaaccatatca

SEQ ID NO: 707592 - DNA, 300 bp, Homo sapiens
  misc_feature (56)..(56): n is a, c, g, or t
  misc_feature (60)..(60): n is a, c, g, or t
  misc_feature (62)..(63): n is a, c, g, or t
  misc_feature (65)..(69): n is a, c, g, or t
  misc_feature (71)..(72): n is a, c, g, or t
  misc_feature (74)..(74): n is a, c, g, or t
  misc_feature (77)..(77): n is a, c, g, or t
  misc_feature (80)..(81): n is a, c, g, or t
  misc_feature (83)..(83): n is a, c, g, or t
  misc_feature (85)..(86): n is a, c, g, or t
  misc_feature (96)..(97): n is a, c, g, or t
  misc_feature (284)..(284): n is a, c, g, or t
  misc_feature (295)..(295): n is a, c, g, or t
tgacaatccaatcctgaaccacagaggcttgaagcgcgggtgacaatcgtgacaanccantnntnnnnnanngnggnttnntntnngtacgttgtnncgattgtcaccgttgtcacgattgtcaccggtgacaatcgtgacaatccaatcctgaaccacagaggcttgaagtagcagtaggttgtcacgattgtcaccacgcgcctcgcgcaccgtcccggcaagcctctgtggttcaggattggagttgtcacgattgtcaccggggatcctctaggggcgtnccaaaaagctnacgac

SEQ ID NO: 707593 - DNA, 631 bp, Homo sapiens
  misc_feature (38)..(38): n is a, c, g, or t
  misc_feature (556)..(556): n is a, c, g, or t
gaccctagttttttcctaatgtcgaggggcaacctatnctttcaaccaactgatacacatgcttaaccctgatccaagcaatcgccaaccgaattaccttaaaccagaccgaatcattgcacaaccctatacgtaaaaaagttttttgggggaggcaattctctcaaacctaacacacaagacattcatcacgttaaggtataaccttttgaaaaagaatgcatgtacccctataagaaatattcatgtgccggctgatctagacgccaatctccgcaattcctataatcaactgattccctagaagaatggagggttctctaacataagtattcccctaactacgccattgcctttagcctttttactaaggcggtctctgcgcagaataaggcggcaaacagctttttattcgcaaaaggaattgtaaagcgtcaaaatataaaaaacgccttaccgaacttctgcttataaacttctttcaaggcctggaaaaagcaaaaaaatttcaacccctaaattgttcccctccgaaaatcctttaaaaaaagaacangtacaaagcctctaatcaacctttatttttggtatatacaatttctcttttagtcctcaccctcccaccaaagtg

SEQ ID NO: 707594 - DNA, 446 bp, Homo sapiens
  misc_feature (358)..(358): n is a, c, g, or t
  misc_feature (385)..(385): n is a, c, g, or t
  misc_feature (393)..(393): n is a, c, g, or t
  misc_feature (437)..(437): n is a, c, g, or t
  misc_feature (442)..(442): n is a, c, g, or t
aaatacccaccttgtttccccagaggaccagccaaaacctcgcctcgagtcacacatatgataattttcactccaattcagtattactccagccagttagcctacacaccgccacagcagcagcagcagcaaaccagaggctgccacccttgccaagcagtcatccagtgctaaaagacggcgatctccagccacccaattactacgaggtaatggagtttgatcccttagctcccactacagaagctgtttatgaagaaattgatggttaccaccagaaagaagctcaaagtcatagtgacttgctaagatacacaaagggccagctctctaaaaggaatactttgattcagcaganggcttgacagaccagacctggccacangggagagncccagttggaccattttctctgctggaagctttaacagaagagnttaancttg

SEQ ID NO: 707595 - DNA, 148 bp, Homo sapiens
taggtcattgtcccatgcatttgctagagatggaaatcgaaagatctctagagaaaacttcctcacagggtcggtcaagatcatcagaagtgtctgtctgtggagtgtatccttctgaaaggtggaaggtcccagttatcacgtccag

SEQ ID NO: 707596 - DNA, 913 bp, Homo sapiens
gacggtggctcacgcctgtaatcccagcactttgggaggccaaggcgggcggatcacgaggccaggagatcaagaccatcctggctaacacggtaaaaccccatctctactaaaaatacaaaaaattagccgggcgtggtggtgggcgcctgtagtcccagctacttgggaggctgaggcaggagaatggcataaacccaggaggccgagctgacaaagtgagctgagatccggccaacagagcgagactctgtctcaaaaaaaaaaaaaaaaaagttccaacccgttgggcttggtcccctgtgtgtatcccaactatggggaagcacttagggcagctaggattggtttgtatgccaaggatctactgcgggtcacccttattggagaacctctgttctctacaaacaattaacaaccttttccctcaagtgtgggtagcacaccctgtgagtcccttctaacttggggaaggctgaaggccaggaggaattgctctggaccccaggagtccagggctaccgggtggacaccagagaattcaggttggatgggcagagtcccagctgtgggttgaacagctgagaactggttgtgatcaaaacaactaaacagtaactcgtacaattagcaaccaaactattttgttgtggagcagcattctgcggccgcttgaagaaaaaagtgttttcttgaaacacaatcttgtttgtgggcgagcggggagcggcccaagtgttggttaagtgaaaactgtctgcgaacacggcgtgtccgacgagaagacaaccttggtggacgtaggaacacgtggtcttggggttctctctcccaattataaaaaagcggcggggggaaaccacaggggtttttggtaacatcctcgaagaggggagtacgacgaacgaccggg

SEQ ID NO: 707597 - DNA, 293 bp, Homo sapiens
tttttgggggggggagggggggcctccccccttttggggcccgggttttttgggattagccggtttattgtttaaccctttcccccttccccccccccttttttgggtgggtttcccggttttttaaagggggcccccccccccccttggggggggggggccctttttaactgaaaaactttccttttttttcttcccccctaaattggctttttttttccctttccccccccccctggggggtttttttcccttttttttttttggggttttttaaccctttggggttttta

SEQ ID NO: 707598 - DNA, 225 bp, Homo sapiens
ctgccacgaagtgggttcaactgagtgtgtacaaagttttggagtactagtgaagggatgaagaaggtcattccacacaagaacaacacaaattaagatttggatgcctggtcacagtcggccctacgccgtgttaatcccaagcacgttcgtggtgcagcggcgtaccgagactcgtaattcggtaatcataggtctatatgctatgttcctgctgtttaatat

SEQ ID NO: 707599 - DNA, 695 bp, Homo sapiens
  misc_feature (2)..(2): n is a, c, g, or t
  misc_feature (98)..(98): n is a, c, g, or t
  misc_feature (100)..(100): n is a, c, g, or t
  misc_feature (134)..(134): n is a, c, g, or t
  misc_feature (158)..(158): n is a, c, g, or t
  misc_feature (160)..(160): n is a, c, g, or t
  misc_feature (169)..(169): n is a, c, g, or t
  misc_feature (223)..(223): n is a, c, g, or t
  misc_feature (249)..(249): n is a, c, g, or t
  misc_feature (255)..(255): n is a, c, g, or t
  misc_feature (258)..(258): n is a, c, g, or t
  misc_feature (343)..(343): n is a, c, g, or t
  misc_feature (410)..(410): n is a, c, g, or t
  misc_feature (455)..(455): n is a, c, g, or t
  misc_feature (507)..(507): n is a, c, g, or t
  misc_feature (554)..(554): n is a, c, g, or t
  misc_feature (578)..(578): n is a, c, g, or t
  misc_feature (632)..(632): n is a, c, g, or t
  misc_feature (676)..(676): n is a, c, g, or t
  misc_feature (686)..(686): n is a, c, g, or t
anaggagaaaaaggtaggcagcaaacatttgttatattaaaacaaatgcagatagtaatattgaaatagtatataaaattgacattactttttgagananaggaagagacatcaaagacattttaagccgagcncctcatgagcttcctaaaccccgncnggggggggngacccctgcattctcgttctgtctaatattatcagtggggctgttttgacaganaagtctcagaagcagcgaattaagtncttacnaanttggcaatgtcccagtaagtaatataaataagtaaaaccacaggctttctcattttagagcattttaacctgctttttagaaggnctgagtaaacagaagctttatgcttgatttgaattttattttctcccaaagttatttttttcctccnataaatgttaacatgcttaactgagggtatggcatgtgagggggncagtgtgctaagacccatgtcgacttgggttggcattaccagaaatggagtnacaaatatactttccaaggctgttatcagaaatgcaaaactactcancttcggcaacaataacaaaaaggnaacaaaacaaaaaactgaagaacaaaagattatatataattagaacggtatggngtaatttaagcactggcaaatacttggctcttaaagaagggggngactcctgcnggatctgct

SEQ ID NO: 707600 - DNA, 177 bp, Homo sapiens
  misc_feature (131)..(131): n is a, c, g, or t
cactctcgtaatccaaagtgctgagattacaggcatgagccactgtccccagcctactatattgtcttatttactcatttgatgttaactgttgattctatatttgacaattgtaaagagtgttgcaaacnacattagaagtgcaaattttttttattctggattgccgaggtggag

SEQ ID NO: 707601 - DNA, 101 bp, Homo sapiens
taaagtcaagtgagttatatgactatatatatgcgggagggggtgatctaataagcactctttacgccgcacacgccactgtcaaggtgcagtcgcgggac

SEQ ID NO: 707602 - DNA, 350 bp, Homo sapiens
cacgaggcctgtctccggagctggaactggcggagagctgtgccgaggcgcaggacggggagctggacgggctgtggccgatcatcaccatcgtcatcatactcttcctgttaagcgtgtgcaacagtgccaccatcaccttcttcaaggtgaagtggatcttccccccggtggtggacctgaagcagaccatcatccccgactacatgaagatgatcggacagggggcctatggccaccctctgcggggtgtccagggccgcccataccccacacagcagccatggggcatagctcatccatcacccaagccatacctggccccgacctcaccgccctcaaacccatgg

SEQ ID NO: 707603 - DNA, 425 bp, Homo sapiens
acgttggtgaattgtatggtatgtaaattatagttcaataacatagttacaaaagataatcaaaagcatgaaagcactattgatgtggtttggatctgtgtcctcaccgagtctcatgttgaaatgtaagccccctggtgggaggcgatgggattatggggcagagtcctcacaaacggtttagcaccacccgctcagtgctgttctcctgatattgagtcctcatcacatctggttgcttcaaagtgtgtggtgcctcccctctgtctccctcctgctctggccatataagatgtgcctgcttctccttcgccttctaacatgattgtaagtttcctgaggcctccctagaagcaaaagctgctgtgcttcctgtaccatctacaggaccgtgagccaattaaacctcttttctttataaaaaa

SEQ ID NO: 707604 - DNA, 114 bp, Homo sapiens
acgtcacagcgctgcgccgacatgtgcccccgctgtcactgggatcacccttcctgtctggaggccagagtgaggaggaggcgtcatcaagctcaatgccattgggccagcggg

SEQ ID NO: 707605 - DNA, 1348 bp, Homo sapiens
ggtagaatttacgaggaggacacgagcctgtcttctgttacctcctaatgtggtaacaggactgatgccagaaatgtgcaccaggtcgcttgttcagatcttgcacagtggagaacgtctagtgccaaaggtttggagggggaggaggaggaaatcgagactttcgtggttaaaggttaacacctagatggtgctccctctattggctgtctcatttgataaatacatatttgagctgatgatctcgcgaatatagtatagcaggcgtgtagcagaaactgactagaagagtaggattggtagtgttcatgatggcgtatattgttggattcagtcttcagaaatcagaggacgtgagcctgtaggaaacgtaggtggctatttgaatgtcaacagttgggcgtgttaatagcgagggacgtactaggtgctcagtgcgactgacgtagttattgacaagaagtaaattcaggtgatgatgctgatggtctttgaggtgatgcaatttgcagggccccaactatctataggataaagatcttgtacagcatgtgttggggagtgattaatggtgacccctgatgtgtagaactgagccaatagatagctcatgctagcatgctggatctccagtatgtgaaaagttagaactagattctcacagcctcgaagtgacaaacttcctgtggatacagctctcgccaagcgataaattgcaacaactttgaaggataactgcgctgagattcatatgttccctgtgggggtcgggcaacatacctgaggttctggattaggggggtttggggtcataaggcgtcatgcaagtcacccccatagcaactgggtcgaaacaggcgtgtggagaaatatgcagggcggaggttccccagagacccagggaaacgccgaaaaagaagtccgggataaacccgcaggaaacgcgggcggtagaaaaacacaaggagagaaaagggcacgataaaagaacacaaaaaaaaggaaagacaaagacgggaagaagggggtagcgatcgagacagcaaccgcccaacgagagaccccccaaaccgcgggccacggggaggcaagaggagagaacaaaaaggagcacaaactgtcaagacagaaaggcagcccggggaacagagagagagccaaagaagagagaaccacaaccgaacagacaaagcaaataaaaaaagatagagcaaaaaggcgcggaagcgacagaggagaccaaaagaagagaggacgcaaacacaaagaggacgaaaacaaccagtgcaacgacaacaaaacaagacaggacaagaagtgcagaagaaggcccgagaagggaaaccac

SEQ ID NO: 707606 - DNA, 459 bp, Homo sapiens
aaaatgttctatttttaatttttgtggctacatagtagatggatatatttatggggtgtatgagatgttctgatataggtatgcaaagtgtaactatcttgtcatgctgaaaggggcatgcatcttctcagacatttatcctttgtcagtcaaacaatccatttatgctccatcaggtattttaaaatgtacaattaaattattttgactacagcaccctgttgcgttatcaaatactggatattaataatcacattatgcagcatggggtatctgtccctcaagcgtttattctttgtgattacaaacaatccaattatacttttttagttatttaaaaatgaactaagttattattgactatagacatcctgctgtgctatcaaatagtagatcgtattcattctttacaacttgctttgttacccccattaactattcccacttaccctgaagcac

SEQ ID NO: 707607 - DNA, 488 bp, Homo sapiens
  misc_feature (13)..(13): n is a, c, g, or t
  misc_feature (31)..(31): n is a, c, g, or t
  misc_feature (52)..(52): n is a, c, g, or t
  misc_feature (149)..(149): n is a, c, g, or t
  misc_feature (339)..(339): n is a, c, g, or t
  misc_feature (343)..(343): n is a, c, g, or t
  misc_feature (408)..(408): n is a, c, g, or t
tttttactgtcanaatcttgctagaaagacngcttggactacgtgaagccantagcacactggacagctgcaccttgagaccggggagatgctccgagatgtgcttcgcgaacaaggccacctgacccggggcactggggctaatttcntcggggttcaagtcccgcaacaacttgaggttcagccttggcagacgttggctccagacagcgtttggacccgccgcctccaccacccaaagttccgtgcgggatgagactgtccgcggaagcgagggtgtcgcttcgcccccgggcccgggtccgccccgctccgaggcctgctcggaagaaagacctngctncgcagttctcctcgcgctcccacacctggtccgcccagtcggaactcacccctacgccgccgccntgccgccgccgccgccgccggtcccggagccagagaagaaacagcaaccgcgcgcgccaaaagtatcgtcacttcctgta

SEQ ID NO: 707608 - DNA, 862 bp, Homo sapiens
  misc_feature (40)..(40): n is a, c, g, or t
  misc_feature (71)..(71): n is a, c, g, or t
  misc_feature (104)..(105): n is a, c, g, or t
  misc_feature (110)..(111): n is a, c, g, or t
  misc_feature (119)..(119): n is a, c, g, or t
  misc_feature (125)..(125): n is a, c, g, or t
  misc_feature (138)..(138): n is a, c, g, or t
  misc_feature (143)..(143): n is a, c, g, or t
  misc_feature (177)..(177): n is a, c, g, or t
  misc_feature (189)..(189): n is a, c, g, or t
  misc_feature (191)..(191): n is a, c, g, or t
  misc_feature (199)..(199): n is a, c, g, or t
  misc_feature (210)..(210): n is a, c, g, or t
  misc_feature (215)..(215): n is a, c, g, or t
  misc_feature (219)..(219): n is a, c, g, or t
  misc_feature (221)..(222): n is a, c, g, or t
  misc_feature (231)..(231): n is a, c, g, or t
  misc_feature (239)..(239): n is a, c, g, or t
  misc_feature (245)..(245): n is a, c, g, or t
  misc_feature (257)..(257): n is a, c, g, or t
  misc_feature (276)..(276): n is a, c, g, or t
  misc_feature (289)..(289): n is a, c, g, or t
  misc_feature (319)..(319): n is a, c, g, or t
  misc_feature (332)..(332): n is a, c, g, or t
  misc_feature (561)..(561): n is a, c, g, or t
  misc_feature (669)..(669): n is a, c, g, or t
  misc_feature (762)..(762): n is a, c, g, or t
  misc_feature (861)..(861): n is a, c, g, or t
ataggaaagtttgtaaaaagagggggtggtagggtgcggnattccgggatggtcctgagagggcatgcgcnctctccaccactgggttccctcggctaagaatnncccgnnccccagcnccgggntcgcgggcgcacnggggngggggcccgggtggggcgggggggtggcgagagnggcggcgccggncngcgcagcngagagggagcngggcncgcngnntcccggggncttccacnggagcnatccggacgggngggctcgggattgctcggnaccatcccgcagngttgagctgatattttttagtgtggggggngagattttgtggnggggatttaaggggtttttgttgtgactgctgggttgtatatatttattttctttcttggaactgggggtggggctcctcccactgagatgatggggcagtgcaaggggaatgggtgggagtatgggctgacggggatcggcgtggggatggtggttcttggggtgatgatgggcatgtggaacgtggtacccggcttcagcgcggccgagaagccaacagctcagggnagcaacaagaccgaggtgggtggcggcatcctcaagagcaagaccttctctgtggcctacgtgctggtcggggccggggtgatgctgctgctgctttctatctgcctnagtatcagggataagaggaagcagcggcagggcgaggacctggcccatgtccagcacccgacaggcgctgggcctcacgcccaggaggaaganagccaggaggaagaagaggaggatgaggaggctgcctcaaggtactatgttcccagctacgaggaagtgatgaacacaaactactcagaagcaaggggng

SEQ ID NO: 707609 - DNA, 343 bp, Homo sapiens
tcagctcggtaccgctctcgtgaactgatctttttcagaaacatcgcaaaaaatatataatcaatcaattgcttaaagttttcgtcaatatttttaaacattattttcaaatctttttttgttatttttttcattttttaggctctctttttaatagttcaggaaatctttctttgtttaactcattttaaaaaaaatccggcatttgatgttagcgggacaaaaattaatgttataaaagctattgttcaatagcatcaataatccatttaatattcggacaattttcaccatctttatatgtttcaataattattaaataagcaatcacatcatctgaata

SEQ ID NO: 707610 - DNA, 136 bp, Homo sapiens
acaattatactccgtaagcatcctatgaaaaaactcacttgtctcttgcccaaggtcatttccgagctagctagagcagtcatttatctggacaccaacttaggttattaaacaaaccagcatggctgcctggggg

SEQ ID NO: 707611 - DNA, 391 bp, Homo sapiens
  misc_feature (102)..(102): n is a, c, g, or t
  misc_feature (196)..(196): n is a, c, g, or t
cctcttccatattcttaatgtgtgtgacatgatgaatctctacttgacccttttctctttccatattttgtattcagtgaacaacaccatactacaactgcnctttaatcaattccgcacacacataataattcctacatcgttacccacaacatgaaacacacttccaagattgtctatccacaccatattccangctatctcagtaatcagcttaaactcagatatgttcctacactgcacattacatcatcttggttatgcgcttttccatgtagctcttactttctcatattcccatattttactagaaaggtggtactgtgctagatatggactctcctacttacctacagcatgcaataagccctgtgcttctaaattccaagta

SEQ ID NO: 707612 - DNA, 344 bp, Homo sapiens
tactccaagaggtgtatcaggagtaaaggtgatattctcatctcgcaccatctgtacactgtgcctctcttaagtggtaccgaaatctgaaaaacaggtgtgctgtataaactccaatcataagcactatacaggacatttaaaagaacaactaaggtttacgcagagcttgtattaggcccactggaacttcctaataacctaacacagtcagttacattagcacatgatgcctaagcagctattattaagcactcacagccgcgcaccacaccaggcaatggggggcggtctgtatcattagcaccattttacagttgggaaggcaatcagagtcagtcact

SEQ ID NO: 707613 - DNA, 194 bp, Homo sapiens
tgcagctgcagtttcactctgtggtaaaagctacagccccggcaaccaccggtgtcagtcaagagtccaaaagctgaagagcttggagtctgatatttgagggcaggaagcatccagcacaggagaaagatgaagtactggaagactcagccagtctagttcttccacgtttctctgcctgcttttatcctagc

SEQ ID NO: 707614 - DNA, 226 bp, Homo sapiens
aagcttaacgaggcagactagccgatcatcagataggtcaggatgccagatgacgtggtgcgtctcggatcctaggactcgacgcagtctagctagtctagggtctaggtatggctggtcgcgactgtctggctgtccagccagtgttccgatcagtagtggcttgctcggcgggcgctatctagcttcagtcagtatgtcagatctgatccggtgcgcgaggcag

SEQ ID NO: 707615 - DNA, 1106 bp, Homo sapiens
tgtagatctcggagttaatgtcgacacgaggaatctcctctatgtttaacctatgttgctcctccgcttcctttaccctgctgtcgacaagatacttcacatctgccttagaaccagagagggcttcctctagaagccaagggaaaggggtgctttaatagaggctagcttctgcttttctgccctggctgctgcccagtcgggatcagccccaacagccaaagcgcgccccaaagccaatccaccagagcccagcagcagtgaccttcctagagggccgctggaagcagctcctgcagagtcgcacttgagagccaagcataaaaacagacgtggcagggtgccaagatgcacctgtgccaagccaagggactgagagctatgcttgtaggccttcgctgccaattgggctggcctgtggatatcaccagggtgaacgctgcccgtatcaacaaaggagaattatgccctgactccagcggcctagaacccggagatctgttctcagcgaagaaccgcccggatgacaaatgattggaagtccacgcgaaggctcataacggagcaccatgcactcagactttgccctgaaaccatttcgaaaccgacttcaaccccaggttgggaaacaattcacaggtgaataacacaccaactgtttcgcacacagttgaagatagcatttgataagacggaggcattgggacactttcctagcaagcaagccgttcagaccggggattttcccaaaagcaacaaccgcctggtatgaccagacgggaacttccagcagggagtcaggaatctttcccctgaccctcacagacagaataaccaagatgaccatcatacatcgcgaaggggcatctaaaatagcacccaacccccatgaactgaccccggaggacatggagatgaaatggacggaatggaaatcccccaatccccaggtgtagaagccacaaacaacagcaccgtggaaaaaaaaaacaaaccccgtgagtccaggggccatcacaccgtcataacgtgaagccggtaacagaagaccaacaacaggacccgaccaaggcaagggagcacaaacaccaccgaacaaacgagaa

SEQ ID NO: 707616 - DNA, 282 bp, Homo sapiens
ttcggcacgaggcaaaggtagcataatcaactttgtttcctttaaaataggggaccctgttattgaattggcttccacggagggttcaagcttgtcttctttacttttttaacccacgtagaaatttgaccctcgccccgtagaaaggagggccggggcattgacaacaagcaaagacggaggaaggacccctattgggaggcttttaaattttatttaaattgcaaaacagtaccctcaacaaaaccccacaaggtccctaaaactacccaaaaccctggc

SEQ ID NO: 707617 - DNA, 760 bp, Homo sapiens
agcggctttccggacctggccgacgtcatgatggcgccatcatgggagtggacatccgacataactaggaccgaaaggtacggtgcaaggagcccaagatccaggatatctacctgaggctgttggatcaagcttatacaggttatctggtcagaagaaccatactccacattcaagccagggttgtgtagaagaggtagatctatgagtcgcacacaactcgtgggcgcactactgtgcctttcccggatgatccggaaagatgaagcttcctggccgggaaaacaagacggaccgatggattagtggggaccctataactgatgatgtgcgggttcacggaggtacccaatgctgaaggtatgtgctctgagcgtgaccagccgggctccgctagctcgatatgctcgagggctagggggcaatgactcctcgagctttcgatcagactggctgctggactcccactgaagggtctgtgggcacatgtcctgtcgtctccgggtcctcgctaaagcgcccgaagagagtgtaccgggccattatcgagcggaggcccccaggaagccccgcgacagccatcaccaaagccctacgtccgttccaagggccggaagttcgagcgtgccagaggtccgacgggaccagtccgagtgctacgaagagttaaccctggatcctacgtctcttattaccaaagatttttgctgactcaaaatctgacctctttccaatgtacatctcgtccatagccgagtag

SEQ ID NO: 707618 - DNA, 901 bp, Homo sapiens
gggagcactggagatctcgccgagctttaagttcacctcggtgtctgcagcagcctccgtttcctctcctaggcgacgagacccgagtggctagaagtatcaccatgtcatattctcaagatccgatgccagggagatcgttgtgactctcgcggagaatccgcgactgttcgaggttgatctcttcacctcagaaggtctcttcagatgctgcttgtgctccagatgtgtgcttcacactggtatctatgaaggccctagaagctccgggacactgataagactcgctatatggggaagggtgtctcacaaggcgtgtatgagcacatcaagtaaaactattagcagccatgacctggttacgtcacacgaaaactgaatcgtcatcagaaccaagagaagatggacgaaagctgactgatcgacgcactggactgtcaaccagagcacattacagtctaaagttatggctgcgaacgccattctggggcggtgtacccttgccgtactgacaaagctggtgccgtttgagaagggggtcccccatgtacccgacaagcatcgctgacttggcatgacaacgtctgaagttcatcctgccagtccctggctgtcacatgtcatcaatgggcggttctcatgctggcaacaacgctggccatgcacggagttcatgatcctaccagatcggatgcaggccaaacttcacgggaagccatgcgcataggagcagaggtataacatacaactggcagccatgtccatcaagggagaaaacacattggcaaaggatgcccaccaagaggcggagggtcgaacggcgcgctgcgcacccaagcactcttggagaataaacgacggctgcaaccatgtgaaaccgacactggcgcaacacgccacg

SEQ ID NO: 707619 - DNA, 100 bp, Homo sapiens
  misc_feature (14)..(14): n is a, c, g, or t
ccatactatgcttnatgataatgaagggaacgtctcttggtgactggtgtgcttctttgtttgggaggtggagaatgggagacccgccgctttggtggtg

SEQ ID NO: 707620 - DNA, 200 bp, Homo sapiens
aggcacggtgcaaagactactacgactgttgtggacagaagccactggctggtggctctcatccagaacgtcatgctcaagcgaatactcttatacatcgatcatgacaagtcagaggagtggaccacttagaaaggaaaccagggacttcaacccgttcgggagttttttcagattctgtttaacggcggttttgcaag

SEQ ID NO: 707621 - DNA, 1069 bp, Homo sapiens
gcctttctctcctcgactgtgaagcgggtccgggacctgtccagaggcagaccacaccggacctcgggggcgatgcggctgctgcccctgctgcagtgactgtccttctggtggccagcgttcctcggctcccctctgccgcgtgtggagctctcagcactccagccatcgtaggtctactgtgaactccagataacgcccatggttgtctatcagaggagacggccgtggttggatgctgggcctcaagcgagttacctagaaacatttgatctgccctccaacatacagaaacgtgcctcaaggtgtccgacatgacgaggcccccggatagacggtatatgcctctgtgtagcattgcgtgcgatcgtgtgcctaagagctagtgacgttctcatgctcaaggcgagatgaggcccccccgtgggcgcgttatcacagcgcattgggatgttgcgtccacgtagcccctttgcgtgcagtggttcagacattcctcatcatgcctacgatttgcagccgcatatcagcaccgcattactcacactcggacccttatgatgttccttaacctgcgaagaatgagctgaactagctaacatctctggttggcccactccatggagaaggttctggccaagatgcttgacgtgctccaagagctgatcctgtctatgctgcataggagaaggaagttctgaagtcacgccccagtaccatgtttggagagcccctggacgcagacgtggccacagtcacgggatgggcagacggggaggggggacactatcgcaaaggcacccctcatgttcgtcgttggcgttattataactggcgtggctttcgtggattccttatccgaaccttctggccgaaatttcttggtgaaagccaagaggcagagcgcatttcccccctccttcgtttcccaaaggatggccaagaaggtccgtcaccaaaggaatccccctggaaggcaaggctgggaactccctggttgcctggaacttgggggggatgcccaaattacaaaacgcacgcagagatgggagcatggatggggagaaac

SEQ ID NO: 707622 - DNA, 396 bp, Homo sapiens
gcttaggtggagtgaggatattgaggaaacctgtaagttaccctgtaatagagagcagacagccagagtctcacacaaataccttatccaggattctcatttgataaccaccctggtctgagcatcccatgtgccctgttgctctgctggtttaggaagcagcccccttgcagagatacccgtgattgacagaccacatctgctaccatgttggaagataatgagccgtgtttcacatttactttgatgcacagaacatcaggtgagatgtttttgaagcatccgtcatgattattggtaggtgggcttccagcccagggaggggggcagtatgttcaacacattgttcccaggcaggtagacccgcccgcgaatttagtagtagtaggcggcagc

SEQ ID NO: 707623 - DNA, 668 bp, Homo sapiens
  misc_feature (17)..(17): n is a, c, g, or t
  misc_feature (24)..(24): n is a, c, g, or t
  misc_feature (447)..(447): n is a, c, g, or t
  misc_feature (533)..(534): n is a, c, g, or t
  misc_feature (546)..(546): n is a, c, g, or t
  misc_feature (548)..(548): n is a, c, g, or t
  misc_feature (593)..(593): n is a, c, g, or t
  misc_feature (596)..(596): n is a, c, g, or t
  misc_feature (648)..(648): n is a, c, g, or t
  misc_feature (657)..(657): n is a, c, g, or t
gggcggaggcggggccngggaggnagcggaggaggcggaggcggcgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccgctggcccgccgacccgcccgccggctcgcccgccagcccctcggcgcccggcggcggcggcggcggtggcggcgacggtcgcaggaggtgccgtctgcctcccaggtgcgcgcttcgctcccggagccgcggaactcggcggccgncatggcgtccaacatggaccgggagatgatcctggcggattttcaggcatgtactggcattgaaaacattgacgaagctattacanntgcttgaacaanantaattgggacttagtggcagctatcaatggtgtaataccacaggnaanatggcattctacaaagtgaatatggaggtgagaccataccaggacctgcatntaatccagnaagtcatccag

SEQ ID NO: 707624 - DNA, 302 bp, Homo sapiens
ggggggcccccctggggggaaaaaaaaggccccccccccccctttttaaagcccccaaaaaacttcccgcccgttttttttttatgggcccgggaaaaaaaaaaaaaggccccccccttcccccaaaaaaatttggggttttcccccgggccaaccagggccaaatcctcccccccctaaaaaaaaggaagggccccccccaacccttggggggggttggggccccgggtttaaaaaaagggcaaccccggccccaaacccccagggctttttttttttccaaaaaaaagtttttttttgga

SEQ ID NO: 707625 - DNA, 615 bp, Homo sapiens
  misc_feature (17)..(17): n is a, c, g, or t
  misc_feature (24)..(24): n is a, c, g, or t
  misc_feature (394)..(394): n is a, c, g, or t
  misc_feature (480)..(481): n is a, c, g, or t
  misc_feature (493)..(493): n is a, c, g, or t
  misc_feature (495)..(495): n is a, c, g, or t
  misc_feature (540)..(540): n is a, c, g, or t
  misc_feature (543)..(543): n is a, c, g, or t
  misc_feature (595)..(595): n is a, c, g, or t
  misc_feature (604)..(604): n is a, c, g, or t
gggcggaggcggggccngggaggnagcggaggaggcggaggcggcgcggcgttcgcccgcccgctcgctcgctcggtttccccgcccccgccgggcttaacgccgctgaaggtatccgggtgcgcgctgtcgcaacctgccctcatcctggcccgcgactgtaagaccggacccacatccagaccaatcttcctgtccgggctgctgcgacgcgggctccgcaggttgcaggcgggcggccggggcgcctgaaggttaccgagtgcatgagcgcctagcgcttcccgcgctgccccgcccggcggcggcggcggtggcggcgacggtcgcaggaggtgccgtctgcctcccaggtgcgcgcttcgctcccggagccgcggaactcggcggccgncatggcgtccaacatggaccgggagatgatcctggcggattttcaggcatgtactggcattgaaaacattgacgaagctattacanntgcttgaacaanantaattgggacttagtggcagctatcaatggtgtaataccacaggnaanatggcattctacaaagtgaatatggaggtgagaccataccaggacctgcatntaatccagnaagtcatccag

SEQ ID NO: 707626 - DNA, 131 bp, Homo sapiens
cccgaaaaaattacaaacacaagtagtatcttacctctgaactgttccctgttcagatgaaaagatttgtgcctttaatgataaaagtgatctgcatagagtcaaaaattcaagccatggagtaaatggca

SEQ ID NO: 707627 - DNA, 122 bp, Homo sapiens
gcactacggggtatttggtatggcccaaaaaataaaatggtttgtgtgtgtatggggagtgaaaggggtgcaaatgctgtggtggagctggtgaagtgggaatgtggacagacgagtgtcat

SEQ ID NO: 707628 - DNA, 304 bp, Homo sapiens
tttttttccaaaaaaccggctttttttcccccagaatggattgggttttcccccttaaccaaagggggggggaatttttccccccgaatttgctttggggaatctttttggcggggaaaacccccccaagggtttgggggggggccccccaaaggtttgcccccccccccccccttgggggggagtttttttttttccccccccccccccctggtttgggggcccaaggctcccccgggggggccccctttttttttttggtttttttttgttccccccaaacccttttcattttttttggtta

SEQ ID NO: 707629 - DNA, 240 bp, Homo sapiens
ttgatgccccagtatgccaatgttacagtaccatatgcaggctaactgttttcttaaacgcctatcactagttatctttttatcgtaactcatcagacgatcccttgcgtacatgtactaagggtcttcctgtccgtgtctctagtagaattcttatataagatatatatcctcaggtaccgcagagggaaatgatgaagataattataaccatagcatcatatagcaacggactaatcc

SEQ ID NO: 707630 - DNA, 1133 bp, Homo sapiens
gaccaggagatgatgggaactagatggagtaaattagtgtcacgcaggaaggcaggaccgtgcagcattcaccaacctggattttggagtcagcgttcaaatctgagctctgctgtcttattgaggcggtgaccttggtttggataagttatgtaacctctctggccctctcacaaataaggataatcacggttggcatcaagattaacgctacaaataatgtgtgtcacatcgtcacaggaataaatcacatgatgaactgtccacggtactggcgtttacgtgcctggcacatacctaacgtgcttaataaactgagaggctatctgttagacccatcctgagccaagcctccctccatctctgcaagcagcagagcgaggcatcggctctgccctgtcatctctgacttctcctctctgctgcaagacgctcactgcgccatcaactacctgccgctctactctattcttgtctatctacatccctgcagtcacgcccacttgcacccacacgggctacaacagcactgccaacatctccgtactaaccccctacactcagccccaccacatacacgcccacctgcacaacccggaacagaaattagctttcaaaaaccacaccaagtccccctaaaagacaattaagagagagcccaaacctaccctaccagacgtaccatccccccaagcatagcctcggatcactatcacttaacgatcgaactctgctcctccagcacggcgctgcgcatcgagcaacacgatacaccataggcgcacgccaacgacccctgccacgagacccacggatatgcaccaaccgctcacccacatcttcccccccccaccaacctagcatgccctatgaaaaacaacacaccacctgcacacccacacacgcagaaccacagcgctccttcatatgatctccacaagctggcactcaaactgcaagaccaactgccaacacccacacccactcggcacctgcagaacacaacccaccgccactaacacaccacccaccatccaccacgcccacacaccaccaccagacaaccacacggcaccacccacgcaccagagcacatcaaacacggccaacccaccccccacacaatacaacac

SEQ ID NO: 707631 - DNA, 220 bp, Homo sapiens
agtagagggccacagcaagaattataaaaatcatggataaataagctagattttagaggcagtaggcagccagaaagaatggagaagctgcaatatttatggttaaagacatactatccccaaatctttctgaaaacctatggaacaaattcttcactccttggccccactcatagacaagtcctcacctctcaggctgaacaatgaatagaaaaaaaaa

SEQ ID NO: 707632 - DNA, 138 bp, Homo sapiens
actctagaggatcgcctactcaggaggccagctactcccccagctactcaggaggcagagggacagaatcacttgaatctggaggcagaggttacaatgagccgagatcgtgcactgcactccaggctcagcgacaaa

SEQ ID NO: 707633 - DNA, 126 bp, Homo sapiens
aaaaaggtacgctactgatgcgtacatgaggtatatggtccaaactaatagttttttctcccctaaaaatgagaaacgacagccaacgagaagaccacactattccctgtagagcctatgaaatca

SEQ ID NO: 707634 - DNA, 121 bp, Homo sapiens
  misc_feature (39)..(39): n is a, c, g, or t
actaagcgaaggcttgagaaagtctccttgtctgagcantgataaactatctagaaacatcccacaactatcagagtgacaatagctcatgctaactcaccgaggcaccccgagaaacaat

SEQ ID NO: 707635 - DNA, 251 bp, Homo sapiens
tggctcgtggtcccaagaagcatctgaagcggggtggcagctcccaaagcatttggatgcctggataaatttgacccggttgtgtttgctcctcggtccatccaccgggttccccacaaggttgagagagttgcttcccccttcactcactttccctgaggaccagacctttaaggagtgcccctgacagggagagtgagagataaagaagagtttgacatgcagcggttcattaaaaatcgatggcaagg

SEQ ID NO: 707636 - DNA, 956 bp, Homo sapiens
ccatcccgtcatcgcctctgacaccagtaaccaaaccgtatctcgccggagacaccgccttaaattttcctaaccacgccttcggaattcttaacgctggcccttccagtgattttattgggcacatgggccaacctcaactaaagggtaacgcccgcaccgcttttaccccacgagactcgaaataacatttagaagccactttcgtccttcccatcgctcgatggaacaggaaattcgaaccacgggtgtccttcatactaagaaacacaggagggattttgcggctagatttagcaaagtcaccatataagacaattcgagggtaacactgggcgaaaatataacatgagctataaaaaccctcttccgaagtccaagaaaaaaatatggtctcagaaaaaaacacccgggggtaaaaagagaccccccagcgcgcccttagaatgctgtgccctccttggggggctttattcaacccccctttaattctgaaatccataagatctcttttactcaagcctttctttctacgcccaagttatcccagatttatgggtggtaaggttggccattcaccatttccgagtatctatgtttgattacccatatataacaagcaacagacgttgtaataccggcccccagcacccaacgtggagcgcgtcactctagtatccactctccctttttagtttcagaacccagtgtgattatagatcactacctggccctgtacgttaatagttgagaatgagcactagctttcacaacagatacgcactgctgttacccccttgtggatccaatacatatgacgccagagagcacaagacctaacagagtggtgcgattggttgactccaaatcgataccactttatacgaccgcaccctgctgttttttttcttcgtattttttcgcacacattctactcaatttataacaccccacta

SEQ ID NO: 707637 - DNA, 326 bp, Homo sapiens
cgacagtcacgtctcacagtgcttactccaataccaagacagcattgtgtccaccaagtatataacatgtgtctgcgggcgcggtgaagcatggctctttagcatactacaggaagcaccattctttaggctgccatgccaccaaggaaacatttgagatcacagcactaggtctgggtgcctacccttatctcaaacaccagtagaattcacttcatgtcatgccggcactttcctgtttacctcagatcccaggaaaaggcccagctctctggttattttctcagcctcatccccaaacatatcgctctttacataattttttt

SEQ ID NO: 707638 - DNA, 529 bp, Homo sapiens
  misc_feature (2)..(2): n is a, c, g, or t
  misc_feature (12)..(12): n is a, c, g, or t
  misc_feature (27)..(27): n is a, c, g, or t
  misc_feature (38)..(38): n is a, c, g, or t
cnccctggctcnctctggtctccctgnccaagaaaccncctctgtcccaggaaccgtctggccggtctgggtttgtaatctcccttggggtcagcaaaggatgggactgcacatcaagaggcccaggcatctgggcatctggctgcagtgaggcaggcataggtgcaccctctgcagagaagctctcagcttcaatcctcttatcctcaatgtagccacggccccctcagaagcccatgggaatccctgcaaggtggctttgtctcatctgcggagttggctgatgcgatcggctcatgctggggccaaaaacatggcaagaaacgtcccactgtcaacctcccgggcaagcgtgtgcacctgcagctcagggccagcccaccacactgccttagtgacactgcagccgggggaccacaggccgccagcaggctgaggaacaatgccgtgtgacctttccttttgtaaaaaacaaaaactgcaatttttattcaaataaaaaaagggtaaaaataaaagttaataagga

SEQ ID NO: 707639 - DNA, 680 bp, Homo sapiens
cacggtggctcacgcctataatcccagcactttgggaggccgaggcgggtggattacctaaggtcaggagttcaagaccagcctggccagcatagtgaaaccccatctctactaaaaatacaaaaattagccaggcgcagtggcacacccctgtaatcccagctactcgggaggctgagggaggagaattgcttgagcccgggagacagaggttgcagtgagtcaagatcatgccactgcactccagcctggcaacagagcgagactgtcccccccccaaaaaaaaaaagagagagactgctttcaaagaggaccaagactacagtgaacattaaaacctggttggctggctgggcatgggtggctcacacctgtaatcccagcacttgtgggaggccgaggcggttggatcacctgaggtcagaagttcgagatcagcctgaccgacatagctggaaccctgtctttactaaaaatacaaaaattagctgggcatggtggcggcacctgtaatgccagctcctccagaggctgaggcaggagaattgcttgaacccagtaggtggaggttgcagtgagccacagttgcgccattggcactccagcctgggcaatgagtgaaactctgtctcaaataagcacaatttaaaggcaaaaacagaccctcagcacaaacaaca

SEQ ID NO: 707640 - DNA, 499 bp, Homo sapiens
tgtatgtacttcgcacgatatacctattaccaaagattgtgacaccttagttagtagcacttccaaagtaccccccgaaaagctgtttagaagaccgatttccatattgtctctacacaaagtgcatactagtatttcgcaataatcatcttcagatgtacgttttatttagtacatttcacagttttcaggtgattcaggccctcatgtacgattttcttgtcctttctttttccctgtttgtgaaatatgtgattccagttcaattcagagtgtatgattccgcttttcacgctgatcaagtaaatttatggtgtctcttttctgatcttcgacattaaaaactaaaaaggaaaaacacataatattctatagagtattaaatgagatactagccctaggcaggtcccattttcttatcaacttctagaaactgtcataaagaggactgcatctcccacagcaacactgtaattgggagttgtattcctcatcaagg

SEQ ID NO: 707641 - DNA, 640 bp, Homo sapiens
caggtgtgatggtatgcacctgtagtctcagctactcaggatgctgagtgcaggagaattaattggcctggacccatggaggtagaggttgcagatgagctgagatcgtgtcgcatgcacgttcaggcctgggccaataggagtgcagctccatcgtcaaaaaaaaaaacgccaaaatagacagaataaaaaggttgggaagacaaatatttgtgtcgtaaaagcaggggtttagtaacataagggtttaaaaagttaagccccgaaagacccagaaaacaatgtataaagttgtttatctccgacaatgattttgccgtgggtagcggtcttcattgtaaaatctttaaacgagaatgtaagcaatgaccaaggtgactaaaagattaccggccgtatttatggttcgccacaaccacaaacagaacgccccaaaaaagaaaggggtcgaacacacaataaggtggggggcggcaaaagagggacaaagtggggcaccggtgggggctgaatgccccgtaggtggtagcttggtgtacgagtgaaaggttttgcgctgggcaagaatgattttggttggcagttgagagcagagcaccacaggtgtggagttgagcccgcgagcacagaaaaggtgtga

SEQ ID NO: 707642 - DNA, 224 bp, Homo sapiens
gaggttccctgtcttgctctgactctccttggtgcccttcagggtgactttgtcgctctgtgtgccagacgcgtgcgacgctgaccatcaccccgcctgtactcttccgccaacctcccgcaagacctggcctctgcggatgaacgaaggtggcggtggtgcttggggtccaccagccatggagtcttccaccactattatccaggcttttggatcaaggacct

SEQ ID NO: 707643 - DNA, 845 bp, Homo sapiens
cctaattggaatttggtgaactccttcccacaccatacatttttctgggagggcctgtgatggctttcccgtgtactggtccacgttcccacctggcgactcctatgggatgcaggtcagcgtggaggaggtgctgaagaccgtgggcaacaaccgggacaaggggcggtccaaccacagtgccttcctctttggcttggggatgggggtggtggcccaccacagaccatgcctgagtaccgcctgaagcgcctgagcaactagcggatgggcatgcccagggtgcaagaccatactcttcgtccacagacagctcttctcagcatcctggagagtgactcagtagcagcatgtgcacgtgggttgtgggagctcttcttggatgctgcacagatggcatcatacaccatcacaatgcccagatcaagaaggggaaccgggtaatgtgagcggagtcctgctactgacagtgtgacgtctgctcagtatgcctggccctggtcggccgcagtgtcgccatgttcctatagcgcccgagtcgagcccagcatgcttagcagctcgtggaggctccttcttctgaaccagttcccactgatgtggtgactggaaggctgcatccgagcatggtggcagaggaagccatgtgcgcattatgaagacatccgtggcccagggcaatacacttgctacagcgcgagcgagccgaaacactgtgtgctgggggagccaggtcactgagggctcctcatcgtcagcagactgacctggaagcggatcaaagggactggccctggccaaacccggggggggcccccagctagggacgaagactgagggggaag

SEQ ID NO: 707644 - DNA, 678 bp, Homo sapiens
ggtcagtctctacgtgaccagtcaaggtgaagtactagtcgctgactgtggtaactatcgtatacaagtctttacccgcaaaggcttttctgaaggaaatccgccgtcggaccccagatggcattggatagactttgtagctgaagcttccttggggcagatctacccaacctcactcctctctcagatggcaatgaactgccaggggctgattggtgtgactgacagctatgataactccctcaaggtatatacctatggatggtccactgcaggtggcgctgtcacaggagccagtcgtgagtcaacaccatggggtatcacagtccttgccctagttctggccgagtttgtagtgaaccgatgtggaaggtggcaagctttggtgttccacagttgatcgaggatcaggggtggtcagatacagctgccgtatgtaggtgctgtgcgggaccgaaagtgtgtcatcctgtgatgctgagggcagcgtcatacttcacccagggacttaggcctcaatcgtggagaactcggacagaagtgagcagccgacctggagggtggtctttcgcccatgggctctgtatggcccgtgatgggcatgtctgggtcgccagatcagtcaatgtctgctcggagaatgaaggatttccgctgaaattgttggcatgtgtgtga

SEQ ID NO: 707645 - DNA, 117 bp, Homo sapiens
atatggatcacggcagatcaaaatatcaccaaagttaactccacagaaatggacatcaaatctgacctcgtgaggcccgacggggcgggggccacctctacaatgtgagcaggtcgg

SEQ ID NO: 707646 - DNA, 165 bp, Homo sapiens
taaagtattaatgcattaaccaaagtagtcactgtacaaggtataattagggggtttccagttggtataacacttggatagttggtagcatttttatgtatattgatcttgtttacagttaatattgtaatgtatcactaaccgagtataattcacgaaaagtaa

SEQ ID NO: 707647 - DNA, 132 bp, Homo sapiens
taacgtgtatatcttccataccaccttttctgcgggacgttcaatagcccatttcaaatacttaggccgttagttaatttcactatgggtcaaatatccaacgactgtgaatgtagagttttaaaaaaaaga

SEQ ID NO: 707648 - DNA, 1459 bp, Homo sapiens
tgccctcgctgccccaccgagtgttgtgcgcgcccctggtccgctgtgttgtcttgttctctttcggggcgggtgttttaatacccgctgggcgtcgtgactaatttttttgtggtccccaccataattattctctcgtgtgtgtggttacgtgttgtctcgcttgtcgtcgtgttctcccccgttgggggagaacccctaatggtgtttccccccacttcttggggggccccccccccaggtgttttctcttcctgggcggccccccgtgcgccacattgtgtgccccaagctgaaaaagacgcgtcttcctgctgtcttataaatatttgtcccccatggaacccctgggtgtctctccccagagttcccccctgtttgtggacccccactccccacggttgctcttggatcaccacacccacccggggtaatgaatgaaattggggcttatatcctcgttcccctgtaatgcccccccaaagtttagtagacaaaacttggggatatgagcaaagggtttatctttggggggttatagaaactgtgctctcccatattattagaacgggaaaagggggtacttggggaatcttttcccacgctgcttacaggagtttctttgggaaagaaggggcagaaattcccccggccttatttacaaacgtccacgctaccaactctttcttacagggtacatgtgccccctgtttccccccactttctgcaacggcgtttcaacacggggagaaggtctgttcaccccaccttattttatatcttccaccacctgtgtacacatatctgccccctatcccccaagcctctctacactctctcggaaagcagatatttctctgtgccccccacctctcctctgtgctcacaccatgtgggaaatactctcttccccctcttgtccccactctctttacccctctcgctctctcacagtctcagcgtccccttgtctcccccttgattctatcgagcgaataaggggagttcaaaggcgggtgttgtgcgaaggtgcgcgcgaataaagagagaccccacgcgcctgtgtgtcctcccctatagagcgcctctccacggagatacaccttctttccttaatattccccacccctcttttcttaacttcccccacataaaagcaattgacacacccccctcgaacttctcggaagttggtgtgatatctcgccaccactccaccttgtttgagagtccacgtgtcccccagaggacgaggggaaccctccctccactacttttttgcacacactgctcactttcttcctctttgcctgttgcttcccccctcacacaccacacttggttttgttttatcctaccactttgacgagtctttctatgtttatgttgaacttgctgctttttttcatattgaaaagatgacatcgcccccagagccccaaaatgaatgggaattgta

SEQ ID NO: 707649 - DNA, 614 bp, Homo sapiens
tccactaaaatcttaaaacttactcagctggttgcaaataaagggagtttcatatcaccaattggtagcaaaatggaatttttccataaactaaaatgttagacacatttgggtcttaatccatgtacacttttttattctctgtattttcccacttcacgtgtaaaaatagtatgtgctcacataagtgttcttatgggcatagtctagtggagaagtgcagaaacttcagaaacagtgtgtatgtattattgggactaggtggatccaggtttttggcagtgtatatatcttccggtagtggactaaagttatttacaaaacaggtgactttggattccaatgtgtgtgagcgtgtagtttagaattacctcaattttataatttttcttaaaatttttgcttataattctgtctaattattctcctttgtggggtttggggggggaggcggacgaaacaaacaacaacacaacaacacacacaacaacaacaacaaacaaagacagggggggggggcgccgccccaatagaatttttcccccagcgggaggcgcccaacagttcttcgccgttccccccgctttttgtgtggtcacaaagggggtgcccca

SEQ ID NO: 707650 - DNA, 729 bp, Homo sapiens
  misc_feature (162)..(162): n is a, c, g, or t
taaggtgacacggtatccaggtcctttctttttgcccccaaaagccctagcttgagaagataaaatggccaaggttgttgggaaaaaaaaagtgccgagcttctctagagaaaaatgtgaaggagatgctccgggccattgagaagatttagccaagaaatncccagatgtgccagacttttgagaagcacctgcaagcacaagctctttttttgagctatagtccatccctcatgaaaaatgcttgaccactgctggcaagcaggagggatgattccaactaatttcccaaaccccagtctcattggtaccagctttggggaaccacctcacttgagcccaaattggttttaagtgcattacaaagtttctggcatcactcccactcttgattaacaaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatata

SEQ ID NO: 707651 - DNA, 142 bp, Homo sapiens
  misc_feature (42)..(42): n is a, c, g, or t
  misc_feature (76)..(76): n is a, c, g, or t
  misc_feature (82)..(82): n is a, c, g, or t
  misc_feature (86)..(86): n is a, c, g, or t
  misc_feature (88)..(88): n is a, c, g, or t
  misc_feature (113)..(113): n is a, c, g, or t
  misc_feature (121)..(121): n is a, c, g, or t
tgggcgaagggggcgcgcgccatggcgaaggcgaagaaggtnggggcgcgaaggaagagactccggggagaagganggagcncgangnggaacggagaaggcaaaatcaaatncgttcgangtgaaagtaaaaaggaagaag

SEQ ID NO: 707652 - DNA, 138 bp, Homo sapiens
ccttaacatcccattaaaacctcatcacccttaccccgatcactgccaatatcccatctcacagcacgctttacacggcttaccgcctgttatcacttgcctgttacagcatggcctatttaacgcctcataaactct

SEQ ID NO: 707653 - DNA, 394 bp, Homo sapiens
agcactgaacctgcatagcctaagcaagactacgcaacgagaacaaatctggaggcatcacactacctgatttcaaactatactataaggccatagtcagcaaaacagcacggtactggtataaaaataggcacacagaccaatggaacagaatagagaacccagaaataaacccaaatacttacagccaatggatcttcgacaaagcaaacaaaaacataaagtggggaaaggataccctttttaacaatagcactgggataattggctggccgtatgtaggacaatgaaactggatcctatacaagatagattaaggacttaacgacctgaagctataaaaaattctagaaggtatcattggaaaaacccttctagacattggcttaggcga

SEQ ID NO: 707654 - DNA, 373 bp, Homo sapiens
gcggcccctactactactaaattcgcccccgcctcgactagagatgcacgagtaattggagaagctgcagatcttgtgacctctggaatgatggctggcaccttaccagaattcagactcctcacctcctcctagcctggtagggtctctcattagcttaagaaagcttagctccatcctggctaacagggtgaaaccccatctccactaaaaaatacaaaaaaattagccgggcgtggtgatgggcgcctgtggtcccagctacttgggaggctgaggcaggagaatggcgtgaacctgggaggcggacttgcagtgagccgagatctcgccactgccctccagactgagcgacagagtgagactctgtctc

SEQ ID NO: 707655 - DNA, 956 bp, Homo sapiens
ggaggaggaggcccggcgggcagtcctgcgagcttctgctgctgagagccgggattgctatcgactgggactgaagtactcatgacgatgccctgctgtacatgaccatcagccagcaagagtttgtgccgtcactggcgcttcctgacctgaagcaggtatggactgagcgaagagccagaattggcttttatgtccattgcagaatgctccctgacagtggcagcagtagtttggcacaggacggcagatcagacagacgtcgatgccaggctcagctatggacacatccgagccagaccatcggcaggatggagtgattacgagcgtgagtgcaggacccccgagcttctcttcaggacgtgtcgctagatgagacctccccacggtgttggtatccgccaacctaattagaaagccagttcgagatatgcgtagtgagggctcccctggccctccccaggtccaaccgagatggatcggggtcacgcatagggagcccacgtacacggaggggacaaggacggacgggaaccgttcgcatcacctttggacgggttaacacgggcgttagctagtacatcctggctataagggaggcaccgtgcccttggggagaagccaccgcgagatactacggggtcacgaactgctggtgcttaactcttggtaaaccccatttcactgcccgtaaatactacacatgccttcggggccaccgccgttcttctaagtacgggacgaacattcatgcccattattaaccacgcagcgaacgtgagaagggatcgaggacgcagacccagacggtggcgtcgggcgagcccgatgtccggacaaaaagtaggtctggcgccgagaggaagaagtggctcccacacgatagcttggttcccgctctttcccccacgaatcgccttgtggtgtggcaaccacagtgcgtgtgaccaatacag

SEQ ID NO: 707656 - DNA, 134 bp, Homo sapiens
acatgcacggacattccgtcatccaacagttgatcctaagtgagcacgcccacgggccgtggtcatggcctgtggcaccggaccagctgtagcccactctccttgcatggcgctctgtgatccccaaggaaggg

SEQ ID NO: 707657 - DNA, 184 bp, Homo sapiens
  misc_feature (155)..(155): n is a, c, g, or t
ctgaacgtggagagcacgagttagttgtagtccggcttgcggtggggcttgactttcctgttggtttgagcccctttttgttttgcctctgggtgttttctttggcccgcaggagggtgggtggagcaggtggacttggagtttctcttgagggnaataaaagttgtcatggtgaaaaaaaaaa

SEQ ID NO: 707658 - DNA, 250 bp, Homo sapiens
ctatgacttgcctaacatattatacgaatgtatatataaatttacctgtccttggatacctttcatagtcccaagtttcctttctctctcctgatctagcgttgctactactgacaataataactattgagacatggtgtattgcagacctgatgaggatcaattgtacactaaatgtcgtgagtggaccactatactagagatcatcatacttggggacagggctatgtcttataagagcctggcctgt

SEQ ID NO: 707659 - DNA, 340 bp, Homo sapiens
  misc_feature (101)..(101): n is a, c, g, or t
ctccatcacaaaaaaaaaaaaaggaaggaaaagaaaaaaaattgtatttctagtagagacggggattcaccatgttggccaggctgatcttgaattccttncctcaggtgatccacctgctttggcctcccaggatgctgggattataggcatgagccagctcacctggtctccatacccttaccaatagtgggtgttaccttatttaagtcttgacccatctgatgagtgtgtcattgtttcaaattgtatttctttggatactaatgaagtgttaaacattttttccaaattatatggtcttttataaatcttttattacgaatccagaaaaaaaaaa

SEQ ID NO: 707660 - DNA, 257 bp, Homo sapiens
gagatcgcgccattgcactccagcctggatgacagaacaagactttgtctcaaaaaaaaaaaatttatctcaaattttcaaaaccgggtttggtagtacatttaattggcttatcccaaagcagtggggttggcctgcgtggcagttaaatattaagctatacttccctttcaaataaggtatttccatcgttaagcctgtaaattctagttggtcattgttaagatttttatagtcattttaatatatctgtttag

SEQ ID NO: 707661 - DNA, 989 bp, Homo sapiens
  misc_feature (13)..(13): n is a, c, g, or t
  misc_feature (16)..(16): n is a, c, g, or t
  misc_feature (25)..(25): n is a, c, g, or t
caggctggtacgnccncggggtatngatatcgtcgacccacgcgctccgctgagttcttggtgtcgactcagattaacatatggtgctgacgctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatcttcaagggaaactggaaggcatacaattcatgaaagaagccacgacgaatgcaccattcagcattgcaactaacgaccagacagcaaaaacctgtgaacacatgatgtactcacgaagaacaaacatttgcactatggctacatcgacggaccttaacgtgccgctgctgctggaactgccttaccaacggcgaggagctcagcatggtcatcctgctgccggactgacattgaggacggagtccacgggcctgaaagaaacattgacggaacagttgacctttggaacagttgcactgagtggactaaacctgagactctcgatcctcattcgaacctaaatgtcagccttgcccaggttccacactgcccccacacgtcttcacctctccacctccgaccctcgaccgcctacggtgtgcccacgatcccttcaacagacgccacgcctgcatctcgccgccaatctaaggaagccacgacgacatatcgtcactatcgaccacacgcaccacaaagcgcaccagcgcgaacgcgcccacacaacgaccacaaccccgccacttcgcctcacacgctcggcatccagaacacctgacatgcctcgtcgcaagcccgacctgcacaagaccgcgaccgcgccgaatgacgtcgcactcatctcaataccggcagacaaatcgtcaaggtaccactccaatgctagagaggaaatcgaacaccctcagagagcgagatgcgcc

SEQ ID NO: 707662 - DNA, 430 bp, Homo sapiens
tgtgttggcacacgcctgtagtcccagctactcaggaggctgaggcacgataattgcttgaacctgggaggcagaagttgcagtgagctgagactgtgccactgcactccagcctgggcgacagagtgagactccctctccaaaaaaaaaaaaaaaagaaaaaaagggaactccaaactaattgggtggtataaaaatgttaaatggggttgcgcatgatagctcatgcttgtaatcccagcactgtgggaggcttaggcaggaggaggatagcctgagtccaggagttctggaccagcctgtacaatacagtgagatcccatctctacaaaaaattaaaatttaaaaattagctgggtgtggtggcttgtgtacctgtagtcctagctactcaggaggctaaagcagaaggattgcttgagcctaggag

SEQ ID NO: 707663 - DNA, 269 bp, Homo sapiens
agtgtgccccaccaggtgccctggatggagaaggcccagctcactcagcctgccagaaccacaagccttgcagcgcgatgtcccctgtgataatgtcagcagctgcccctcctccgatacctgctgccaactcacgtctggggcgtggggactgctgtccaatcccagaggctgtctgctgctcggaccacctttcactgctgcccccagtggctacacgtagtctagctagcgagggcaactgtcaagcgctagcagcgcgctcgtgg

SEQ ID NO: 707664 - DNA, 181 bp, Homo sapiens
ctagaggatccccagcgccggatcccccctaagacacatatgacccaccaccccatctctgaccatgaggccaccctgtaggtcctgggtctggtcctccctcatcccgctgccaggtcagtgtgatctccgcagggtagaaccccaaggcccagcacctcagggtggcctcatggtcagt

SEQ ID NO: 707665 - DNA, 83 bp, Homo sapiens
tcaagcttctaacgatgtacggggacatggaatttaaaagctaagtaagtataaaaaataaaatgttatatacaaaaaaaaaa

SEQ ID NO: 707666 - DNA, 3263 bp, Homo sapiens
agagagttgggagatgtaggtgtgtggataggatgggagaatggtaggtgtagtgtaggtggagctggtgatatgggtaggtgtatgtgagtcgatggtaagactggtggtggtggtagagaggaggtgtttatatgggagtgtaagggggaataaggttttgagagagatgaaagggatgggtagtgtggttggtgagttattaaggattgttgggggatgggttatagtgttttataattgttgataattgtagttttgatttgtggagggtgtagatttggtgtagggagatttgtggcatgttagttgtgtcattaatagatgttagggtgcggtgtcccggaggtcccagggtgttgcgtggtttccgcgtttctcgacgcgtgtgttgggtggcgtgtgccgtgtcctttgcgtgtgggatttcgcgtttcgtttttgagtgggggtcgcccgctggggtgcgaggtgatagtgtcgtgggtgagggtgtaaagctgtggtgggcgcgcgttggtgggagatatggtgtggaggggtgccggcctgtttttgttgttttgtttttttttttttaaaacaaatatttttaattaaattttcaaacatgaaagtataaacgttaatatttgttgaaaaatatatacggcatttcccccgtgtgaacacaatggcttccggtaacactacccacttacaatgagatcttttaggcacttgggtgtagaatgtgcgagagggaaatgcaactttactttcctgctacctataggggcaaccacaattagatctcatgaaatattgttttcaacactgttagcattaacaccgacttaaaacatacggtgaccggacatataacctttaaagtcccagtatatttaaaacaggagaaatctggtaagttgttaggattctaaattccttttagtctgttcactgagatattaaatttcagtagacagaacccaaaaagagatttcatttctttctaatcactttggcttctttcttttttgttaagtaggtaaaaaccttcttggtgggcacctaagcaggatgcagccaatagttcatgaaccagctgcgcacgtgaggcttaaaatctaagatgctgctgaagtggctgcgggaggagcggctgcgacttacttttaatttcaaatcagctgcagatgtttgggagccctctcgatgaacagaacaaatcacataacatgcagaatccactcagaggctgttattccagggaaagagcgggcaggtgtcctgaggagtacattcttgctgtcacagtctcactgctggcacagaggtgccttgtttatgagatttaaaggccacaaactctggctcaggtggggacaagggtgtgccgtggctgaaaccagcgtggtcactgtgtggctggcacggcctgcacatgctgcaggagctgctcgcagtaggtggccgagcggtgcttgtggatgacggcctccgtctccctcaccaggagatctgggaacagcccgctgccctctttgaggacctctaaaattgcatcctggatggccctctctggatcgtcaaggtgaaccagcaactctcggtacaggtactggacactgctctgatagtaggattttgcgttggcacccttgacacactgcagccaggtgaccaaggtggaggcggctgccatcctcacatcgttggacacgtcatctaggcgttttaagagttcaggataaatcttgatgagtttctctggatccgtcatgccgcccgaggtttttaagaacgtgttgataatacggcatgagatcagtcgcgtcatcttcgaatcctcctccagggtggtcaggacctggggcatcagtgtttcctgcacgtcccgtatctgctctgccgacaggacctcgctgctggtgagcgcccagaggcaggacacggcagccgtgcggatggccgcggctgtcctccccgcatgccactgcagattgggggccaggatgtcctttgtcaccgtctcgaggtagctgggaaactgcccctgggagttgatggtgtccgtggctctgagcagcacggtggacaggatggagaacagcttcaggcgcatctgcgggtcttgggagggctgcagacaggccctcagcgtgggcacgacgtgtggcagggcttctcccagggcagggcctgactgtgcgacgatgacactgaactgcaggagctccggcgagtgtgcggtccagtcaaggtgcgacgcggtcacccgctccaggaggggaccaatgtgcttgcggtagaggtcctggcagctgctgacaccctccaccatggccagtgagtccatcgtctcctgtgccttgtccctcaggccggtagcacctgcgagggccactattgtcagcagcacgtccaagagctgcaggctggccacgccacagtcctcatgacacacagacaccagagcctgcacacacagcagcaggcgctccaggtagaggtcgttttcagatgcctggcagatgtgggcctgtgccagctctgtggcgatggctgccaggtgcggctggagggcttctcgggggcaaccccgcatggcggaggccagcaccaggaggccggaggcagagggcgtcttcttcagcgtcgataagatcagcttcagaaacacctcagggctgacaaacgtcccgacgagctctgcggatctggtacaactttggaccacggctgcctcctcgtcggtgcaggcctggaacagggtccggaggacgacctccaggtgctgcgtggcgtggtcctcggcatgcagcagcagcactgggagcagctgtgccgacttcactcgggtccccaccacccagtcggtgatgtcgtggcacagggcagggaggatcttggagaggttcctgaagacgagctcccggcagcccagcacagggcggcgctcatgtggagggtaatggggtggggtgggaggggcaaagtccagcttgtccttcaggtcctcctcattctccttctgccactgcaggccaacgtcctcccagaggctggcagccagctgcctgacctcaggcacctcgtcgttgaggctactgagcagcagagggatgagcttgtggaagaaggagtaacggtcacgcagacacagcagccagccgcccaccacggaggccaccgcccgccggacctgcgggacgtcatcaaacagtcgctgagcaaaatgggaaagcacggtcgacgcggccgcgaatttagtagtagta

SEQ ID NO: 707667 - DNA, 195 bp, Homo sapiens
aggaagtggttggcagggggccttgttcctttaactgggttaacattggccatgaggaattcaaaatttaatcctttccttaccttttagggaattaggacctttttggcaagttggttggattgaaactaaggccttaattggttaatagttccggttaaaccatggattaaaacctcagggggcacctacctt

SEQ ID NO: 707668 - DNA, 3311 bp, Homo sapiens
  misc_feature (3222)..(3222): n is a, c, g, or t
agagagttgggagatgtaggtgtgtggataggatgggagaatggtaggtgtagtgtaggtggagctggtgatatgggtaggtgtatgtgagtcgatggtaagactggtggtggtggtagagaggaggtgtttatatgggagtgtaagggggaataaggttttgagagagatgaaagggatgggtagtgtggttggtgagttattaaggattgttgggggatgggttatagtgttttataattgttgataattgtagttttgatttgtggagggtgtagatttggtgtagggagatttgtggcatgttagttgtgtcattaatagatgttagggtgcggtgtcccggaggtcccagggtgttgcgtggtttccgcgtttctcgacgcgtgtgttgggtggcgtgtgccgtgtcctttgcgtgtgggatttcgcgtttcgtttttgagtgggggtcgcccgctggggtgcgaggtgatagtgtcgtgggtgagggtgtaaagctgtggtgggcgcgcgttggtgggagatatggtgtggaggggtgccggcctgtttttgttgttttgtttttttttttttaaaacaaatatttttaattaaattttcaaacatgaaagtataaacgttaatatttgttgaaaaatatatacggcatttcccccgtgtgaacacaatggcttccggtaacactacccacttacaatgagatcttttaggcacttgggtgtagaatgtgcgagagggaaatgcaactttactttcctgctacctataggggcaaccacaattagatctcatgaaatattgttttcaacactgttagcattaacaccgacttaaaacatacggtgaccggacatataacctttaaagtcccagtatatttaaaacaggagaaatctggtaagttgttaggattctaaattccttttagtctgttcactgagatattaaatttcagtagacagaacccaaaaagagatttcatttctttctaatcactttggcttctttcttttttgttaagtaggtaaaaaccttcttggtgggcacctaagcaggatgcagccaatagttcatgaaccagctgcgcacgtgaggcttaaaatctaagatgctgctgaagtggctgcgggaggagcggctgcgacttacttttaatttcaaatcagctgcagatgtttgggagccctctcgatgaacagaacaaatcacataacatgcagaatccactcagaggctgttattccagggaaagagcgggcaggtgtcctgaggagtacattcttgctgtcacagtctcactgctggcacagaggtgccttgtttatgagatttaaaggccacaaactctggctcaggtggggacaagggtgtgccgtggctgaaaccagcgtggtcactgtgtggctggcacggcctgcacatgctgcaggagctgctcgcagtaggtggccgagcggtgcttgtggatgacggcctccgtctccctcaccaggagatctgggaacagcccgctgccctctttgaggacctctaaaattgcatcctggatggccctctctggatcgtcaaggtgaaccagcaactctcggtacaggtactggacactgctctgatagtaggattttgcgttggcacccttgacacactgcagccaggtgaccaaggtggaggcggctgccatcctcacatcgttggacacgtcatctaggcgttttaagagttcaggataaatcttgatgagtttctctggatccgtcatgccgcccgaggtttttaagaacgtgttgataatacggcatgagatcagtcgcgtcatcttcgaatcctcctccagggtggtcaggacctggggcatcagtgtttcctgcacgtcccgtatctgctctgccgacaggacctcgctgctggtgagcgcccagaggcaggacacggcagccgtgcggatggccgcggctgtcctccccgcatgccactgcagattgggggccaggatgtcctttgtcaccgtctcgaggtagctgggaaactgcccctgggagttgatggtgtccgtggctctgagcagcacggtggacaggatggagaacagcttcaggcgcatctgcgggtcttgggagggctgcagacaggccctcagcgtgggcacgacgtgtggcagggcttctcccagggcagggcctgactgtgcgacgatgacactgaactgcaggagctccggcgagtgtgcggtccagtcaaggtgcgacgcggtcacccgctccaggaggggaccaatgtgcttgcggtagaggtcctggcagctgctgacaccctccaccatggccagtgagtccatcgtctcctgtgccttgtccctcaggccggtagcacctgcgagggccactattgtcagcagcacgtccaagagctgcaggctggccacgccacagtcctcatgacacacagacaccagagcctgcacacacagcagcaggcgctccaggtagaggtcgttttcagatgcctggcagatgtgggcctgtgccagctctgtggcgatggctgccaggtgcggctggagggcttctcgggggcaaccccgcatggcggaggccagcaccaggaggccggaggcagagggcgtcttcttcagcgtcgataagatcagcttcagaaacacctcagggctgacaaacgtcccgacgagctctgcggatctggtacaactttggaccacggctgcctcctcgtcggtgcaggcctggaacagggtccggaggacgacctccaggtgctgcgtggcgtggtcctcggcatgcagcagcagcactgggagcagctgtgccgacttcactcgggtccccaccacccagtcggtgatgtcgtggcacagggcagggaggatcttggagaggttcctgaagacgagctcccggcagcccagcacagggcggcgctcatgtggagggtaatggggtggggtgggaggggcaaagtccagcttgtccttcaggtcctcctcattctccttctgccactgcaggccaacgtcctcccagaggctggcagccagctgcctgacctcaggcacctcgtcgttgaggctactgagcagcagagggatgagcttgtggaagaaggagtaacggtcacgcagacacagcagccagccgcccaccacggaggccaccgcccgccggacctgcgcatgagaggaagggataaggattcgtgtangcaaaggggatgccggggctgacgccacggtgcggctctgagtgctgccatacggacgctgcctgaggcagaggcacgggcaggtcctg

SEQ ID NO: 707669 - DNA, 2998 bp, Homo sapiens
agagagttgggagatgtaggtgtgtggataggatgggagaatggtaggtgtagtgtaggtggagctggtgatatgggtaggtgtatgtgagtcgatggtaagactggtggtggtggtagagaggaggtgtttatatgggagtgtaagggggaataaggttttgagagagatgaaagggatgggtagtgtggttggtgagttattaaggattgttgggggatgggttatagtgttttataattgttgataattgtagttttgatttgtggagggtgtagatttggtgtagggagatttgtggcatgttagttgtgtcattaatagatgttagggtgcggtgtcccggaggtcccagggtgttgcgtggtttccgcgtttctcgacgcgtgtgttgggtggcgtgtgccgtgtcctttgcgtgtgggatttcgcgtttcgtttttgagtgggggtcgcccgctggggtgcgaggtgatagtgtcgtgggtgagggtgtaaagctgtggtgggcgcgcgttggtgggagatatggtgtggaggggtgccggcctgtttttgttgttttgtttttttttttttaaaacaaatatttttaattaaattttcaaacatgaaagtataaacgttaatatttgttgaaaaatatatacggcatttcccccgtgtgaacacaatggcttccggtaacactacccacttacaatgagatcttttaggcacttgggtgtagaatgtgcgagagggaaatgcaactttactttcctgctacctataggggcaaccacaattagatctcatgaaatattgttttcaacactgttagcattaacaccgacttaaaacatacggtgaccggacatataacctttaaagtcccagtatatttaaaacaggagaaatctggtaagttgttaggattctaaattccttttagtctgttcactgagatattaaatttcagtagacagaacccaaaaagagatttcatttctttctaatcactttggcttctttcttttttgttaagtaggtaaaaaccttcttggtgggcacctaagcaggatgcagccaatagttcatgaaccagctgcgcacgtgaggcttaaaatctaagatgctgctgaagtggctgcgggaggagcggctgcgacttacttttaatttcaaatcagctgcagatgtttgggagccctctcgatgaacagaacaaatcacataacatgcagaatccactcagaggctgttattccagggaaagagcgggcaggtgtcctgaggagtacattcttgctgtcacagtctcactgctggcacagaggtgccttgtttatgagatttaaaggccacaaactctggctcaggtggggacaagggtgtgccgtggctgaaaccagcgtggtcactgtgtggctggcacggcctgcacatgctgcaggagctgctcgcagtaggtggccgagcggtgcttgtggatgacggcctccgtctccctcaccaggagatctgggaacagcccgctgccctctttgaggacctctaaaattgcatcctggatggccctctctggatcgtcaaggtgaaccagcaactctcggtacaggtactggacactgctctgatagtaggattttgcgttggcacccttgacacactgcagccaggtgaccaaggtggaggcggctgccatcctcacatcgttggacacgtcatctaggcgttttaagagttcaggataaatcttgatgagtttctctggatccgtcatgccgcccgaggtttttaagaacgtgttgataatacggcatgagatcagtcgcgtcatcttcgaatcctcctccagggtggtcaggacctggggcatcagtgtttcctgcacgtcccgtatctgctctgccgacaggacctcgctgctggtgagcgcccagaggcaggacacggcagccgtgcggatggccgcggctgtcctccccgcatgccactgcagattgggggccaggatgtcctttgtcaccgtctcgaggtagctgggaaactgcccctgggagttgatggtgtccgtggctctgagcagcacggtggacaggatggagaacagcttcaggcgcatctgcgggtcttgggagggctgcagacaggccctcagcgtgggcacgacgtgtggcagggcttctcccagggcagggcctgactgtgcgacgatgacactgaactgcaggagctccggcgagtgtgcggtccagtcaaggtgcgacgcggtcacccgctccaggaggggaccaatgtgcttgcggtagaggtcctggcagctgctgacaccctccaccatggccagtgagtccatcgtctcctgtgccttgtccctcaggccggtagcacctgcgagggccactattgtcagcagcacgtccaagagctgcaggctggccacgccacagtcctcatgacacacagacaccagagcctgcacacacagcagcaggcgctccaggtagaggtcgttttcagatgcctggcagatgtgggcctgtgccagctctgtggcgatggctgccaggtgcggctggagggcttctcgggggcaaccccgcatggcggaggccagcaccaggaggccggaggcagagggcgtcttcttcagcgtcgataagatcagcttcagaaacacctcagggctgacaaacgtcccgacgagctctgcggatctggtacaactttggaccacggctgcctcctcgtcggtgcaggcctggaacagggtccggaggacgacctccaggtgctgcgtggcgtggtcctcggcatgcagcagcagcactgggagcagctgtgccgacttcactcgggtccccaccacccagtcggtgatgtcgtggcacagggcagggaggatcttggagaggttcctgaagacgagctcccggcagccgggtgtggggccgccacggcctccgccacccccagcgccgccatcttgcccgcgtcagccggccaccccgct

SEQ ID NO: 707670 - DNA, 2362 bp, Homo sapiens
agagagttgggagatgtaggtgtgtggataggatgggagaatggtaggtgtagtgtaggtggagctggtgatatgggtaggtgtatgtgagtcgatggtaagactggtggtggtggtagagaggaggtgtttatatgggagtgtaagggggaataaggttttgagagagatgaaagggatgggtagtgtggttggtgagttattaaggattgttgggggatgggttatagtgttttataattgttgataattgtagttttgatttgtggagggtgtagatttggtgtagggagatttgtggcatgttagttgtgtcattaatagatgttagggtgcggtgtcccggaggtcccagggtgttgcgtggtttccgcgtttctcgacgcgtgtgttgggtggcgtgtgccgtgtcctttgcgtgtgggatttcgcgtttcgtttttgagtgggggtcgcccgctggggtgcgaggtgatagtgtcgtgggtgagggtgtaaagctgtggtgggcgcgcgttggtgggagatatggtgtggaggggtgccggcctgtttttgttgttttgtttttttttttttaaaacaaatatttttaattaaattttcaaacatgaaagtataaacgttaatatttgttgaaaaatatatacggcatttcccccgtgtgaacacaatggcttccggtaacactacccacttacaatgagatcttttaggcacttgggtgtagaatgtgcgagagggaaatgcaactttactttcctgctacctataggggcaaccacaattagatctcatgaaatattgttttcaacactgttagcattaacaccgacttaaaacatacggtgaccggacatataacctttaaagtcccagtatatttaaaacaggagaaatctggtaagttgttaggattctaaattccttttagtctgttcactgagatattaaatttcagtagacagaacccaaaaagagatttcatttctttctaatcactttggcttctttcttttttgttaagtaggtaaaaaccttcttggtgggcacctaagcaggatgcagccaatagttcatgaaccagctgcgcacgtgaggcttaaaatctaagatgctgctgaagtggctgcgggaggagcggctgcgacttacttttaatttcaaatcagctgcagatgtttgggagccctctcgatgaacagaacaaatcacataacatgcagaatccactcagaggctgttattccagggaaagagcgggcaggtgtcctgaggagtacattcttgctgtcacagtctcactgctggcacagaggtgccttgtttatgagatttaaaggccacaaactctggctcaggtggggacaagggtgtgccgtggctgaaaccagcgtggtcactgtgtggctggcacggcctgcacatgctgcaggagctgctcgcagtaggtggccgagcggtgcttgtggatgacggcctccgtctccctcaccaggagatctgggaacagcccgctgccctctttgaggacctctaaaattgcatcctggatggccctctctggatcgtcaaggtgaaccagcaactctcggtacaggtactggacactgctctgatagtaggattttgcgttggcacccttgacacactgcagccaggtgaccaaggtggaggcggctgccatcctcacatcgttggacacgtcatctaggcgttttaagagttcaggataaatcttgatgagtttctctggatccgtcatgccgcccgaggtttttaagaacgtgttgataatacggcatgagatcagtcgcgtcatcttcgaatcctcctccagggtggtcaggacctggggcatcagtgtttcctgcacgtcccgtatctgctctgccgacaggacctcgctgctggtgagcgcccagaggcaggacacggcagccgtgcggatggccgcggctgtcctccccgcatgccactgcagattgggggccaggatgtcctttgtcaccgtctcgaggtagctgggaaactgcccctgggagttgatggtgtccgtggctctgagcagcacggtggacaggatggagaacagcttcaggcgcatctgcgggtcttgggagggctgcagacaggccctcagcgtgggcacgacgtgtggcagggcttctcccagggcagggcctgccttccaagcacgagcgctcctgctggcggacacttctgcccggagccacgtgtccgccctcccagcactagcgctcctgcttgcagcagggacacttccacgggaccatgtgtctgccctcccagcgtgagctcctgctcgcagcagggacacttccacccggaccacgtgtct

SEQ ID NO: 707671 - DNA, 358 bp, Homo sapiens
ctctctctctctctctctctctctctctctctctctctctctctctctgtctgtctctctctctctgtctcaccatgcttggagcagagggtagaagactattacagctactgcaatcaattgaactacaatcgtaatgccgacggtcctgcgtcacttgaactaccgagaaagtgactgagggaaattatcaatgaggtcatctgccagagacagtcagtgagtcagtacggatgagagactgtcaagaagacagaggaggagaatgacagactgtcgagccaaacccgccaacgagcaccgacagatgaaggtatacaccggaagtgaacctgagagtgaggatgatggtggccgc
